United States Patent 11,098,302 (IDENTIFICATION OF POLYNUCLEOTIDES ASSOCIATED WITH A SAMPLE) - sequence listing, part 57

SEQ ID NO: 195906 - DNA, 630 bp, Homo sapiens
  misc_feature: GYAE6OF01A15XX.16.68.G02.1.454.CMB.1.raw
  modified_base (234)..(234): a, c, t, g, unknown or other
  misc_feature (234)..(234): n is a, c, g, or t
  modified_base (240)..(240): a, c, t, g, unknown or other
  misc_feature (240)..(240): n is a, c, g, or t
  modified_base (568)..(568): a, c, t, g, unknown or other
  misc_feature (568)..(568): n is a, c, g, or t
  modified_base (574)..(574): a, c, t, g, unknown or other
  misc_feature (574)..(574): n is a, c, g, or t
  modified_base (578)..(578): a, c, t, g, unknown or other
  misc_feature (578)..(578): n is a, c, g, or t
  modified_base (583)..(583): a, c, t, g, unknown or other
  misc_feature (583)..(583): n is a, c, g, or t
  modified_base (592)..(592): a, c, t, g, unknown or other
  misc_feature (592)..(592): n is a, c, g, or t
  modified_base (594)..(596): a, c, t, g, unknown or other
  misc_feature (594)..(596): n is a, c, g, or t
  modified_base (598)..(598): a, c, t, g, unknown or other
  misc_feature (598)..(598): n is a, c, g, or t
  modified_base (601)..(601): a, c, t, g, unknown or other
  misc_feature (601)..(601): n is a, c, g, or t
  modified_base (603)..(606): a, c, t, g, unknown or other
  misc_feature (603)..(606): n is a, c, g, or t
  modified_base (608)..(611): a, c, t, g, unknown or other
  misc_feature (608)..(611): n is a, c, g, or t
  modified_base (613)..(613): a, c, t, g, unknown or other
  misc_feature (613)..(613): n is a, c, g, or t
  modified_base (616)..(618): a, c, t, g, unknown or other
  misc_feature (616)..(618): n is a, c, g, or t
  modified_base (620)..(622): a, c, t, g, unknown or other
  misc_feature (620)..(622): n is a, c, g, or t
  modified_base (624)..(625): a, c, t, g, unknown or other
  misc_feature (624)..(625): n is a, c, g, or t
  modified_base (628)..(628): a, c, t, g, unknown or other
  misc_feature (628)..(628): n is a, c, g, or t
  modified_base (630)..(630): a, c, t, g, unknown or other
  misc_feature (630)..(630): n is a, c, g, or t
tcagtgtactactccacgaccggtgctcgatttagtcgatagtgaagggaaagggactggagtggattgcctatatctcttacagtgggagcagcaactacaacccctccctcaagagtcgagtcgacatattagtagacacgtccaagaaccagtttttccctgaggctgagtctgtgacccgctgcggacaccggtccctttattactgtgcgcgagggcccctatcgagtnacttangactcccaggtcccctttgacctccgtgggccacgggaccctggcaccgtcctcctcagcccaccacccgaagggcccctacgtccggttcccttcccccgtgggccctccccggtctcccgtcccgaagggaccgacccgacccgttcccggaagtacgccaaccgggacggtcccgggtaccccggtggggcccttcggcccgtttagggacccgtaaaggttacccgttaccgttaaccgggaaagtttaccgaacctaaccggttacgggaacggggccgggtagttaccggggaccgaacgggtaccccgacgaaagttacgngacgtnacgngacgncgagcgtgnannngnacngnnnngnnnngntgnnngnnnanngcngn

SEQ ID NO: 195907 - DNA, 667 bp, Homo sapiens
  misc_feature: GYAE6OF01EVTTG.16.68.G02.1.454.CMB.1.raw
  modified_base (200)..(200): a, c, t, g, unknown or other
  misc_feature (200)..(200): n is a, c, g, or t
tcagtgtactactccacgaccggtgctcgatttagtcgatagtgaagggaaaggggcaggagtcagacccagtcaggacacagcatggacatgagggtccccgctcagctcctggggctcctgctgctctggcctccaggtcgcagatgtgacatcagatcgacccagtcctcctccaccctgtctgcatcgtgtagganacgagcgtacaccatcacgttcggccggtccagtcaagtaataagttacgttagggtcggttaggtccgtaggtacgtcgaagtaccgtaaacggaaaccgaacggggaaaccgtaccccggtaaggttctagtaacgttaatagtacgtaccgtactttacgttaacgtttaaggaacggttcgggtacctatacgtaagttcgagcggacgaggtgagtcgtggactagtactctaactctaccagtacctacgacctacgtcgtacgaccctaagtcgttatgttaacgtttactaacgttactttaacttacgtccgtaactaacgttacgtacaattactcgtattacgttaacttagttaacggtccgggtagacgggtaacgtacgggtagttaacgggactaaccggtaaggttcgcggaaattccggaactaccgttagtttctacgttcgttaaccg

SEQ ID NO: 195908 - DNA, 791 bp, Homo sapiens
  misc_feature: GYAE6OF01EG5I6.16.68.G02.1.454.CMB.1.raw
  modified_base (187)..(187): a, c, t, g, unknown or other
  misc_feature (187)..(187): n is a, c, g, or t
  modified_base (224)..(224): a, c, t, g, unknown or other
  misc_feature (224)..(224): n is a, c, g, or t
  modified_base (291)..(291): a, c, t, g, unknown or other
  misc_feature (291)..(291): n is a, c, g, or t
  modified_base (786)..(786): a, c, t, g, unknown or other
  misc_feature (786)..(786): n is a, c, g, or t
  modified_base (790)..(791): a, c, t, g, unknown or other
  misc_feature (790)..(791): n is a, c, g, or t
tcagtgtactactccacgaccggtgctcgattttagtcgatagtgaagggaaagggtctccgaagccttcggagaccctgtccctcacctgcactgtctctggtggcctccttcagcagttactactggagctggatccgtcagctcccgagggaaggactggagtggattgcctatatctcttacngtggagcagacaacctaccaaccccctcctacgaagngtcgacgtcgaactaattatttagtaacgaccaccggtaccaaacggaaccttacggtttttcccgngaacggtcgtaggtaggtccgttagtcggacccgcgttcggaccggaaccgtaccggttacccttttaacgttacgtcggtcggccgggtacgggtacccgggtaccccttacgtaccggtacgtacgtaccttacgtacgtacctaccccgtaccggttcccgtttacgacccgttccgggtccggggacccgtaaccggggtaacccgttccggtacccgtacccgttcccgttcccgtaccgtaccgcccccttacccgaaccccggtaacccggggtcccctaccggttccccggtttcccccgttcccccggtcggtaccccgtccccgtcgtcccgtacccgacgggtcccacccgtcccgcggaacgacgtccaccggacgggcccggccggtcggccgtcgtcccggtacgtaccgaacggttacctaccgttaccgggtactaacggtaccacggtcgggacggccggcgacgacgaacggcgacnggcnn

SEQ ID NO: 195909 - DNA, 915 bp, Homo sapiens
  misc_feature: GYAE6OF01ETSM3.16.68.G02.1.454.CMB.1.raw
tcagtgtactactccacgaccggtgctcgatttagtcgatagtgaagggaaagggtctccgaaggcttcaccagtcctggacctcctgtgcaagaacatgaaacatctgtggttcttccttctcctggtggcagcctcccagatgggtcctgtcccaggagcaacgtgcaggagtccgggccaggactggtgaacgtccttcggacgacccttgtcccctcaccgtgccacgttgtcctcgtggtgcctccttcagtctagttactacgtggacgtcgttcggacgttcccgtacgacgtcccgtacccgggaaggggtaacggggtacgttacggggtacggttcggtaacggtttccggtaacccgtttaagttaccttttacccgtaccggttttaaaccgggtacgggtttaccggggaacggtacccgtaacggtaacccgttaaaacccccgtttaccccgtaaaaccccccccgttacccgttaaccggtaaaccggtaaccgggttaaccgtaacggtacccgtaaacttaacgtttaaacgtttaacggaaccgtaaccgtaaacccgtaaccgtaaacgtaacccgtttaccggtttttaccccgtagggtaacccggtacgttacgggtaaccgggttacgttacgggttaccgaccggttccgaccggggacccggtaaccgttaccccgggtttaccttttaagtttacgttccggtcggtcccgggtaccgtaccgggtccccgtagttaccggagttcgaccgttagaccggttccctaccggttaacgttcccgtttacggacccttcccggggtacgggaccccgtacggggtacccttcggtaccccgacccgtttacccgtcccttacgcccgtcccgtaacccggtaaccccggg

SEQ ID NO: 195910 - DNA, 848 bp, Homo sapiens
  misc_feature: GYAE6OF01DYV8M.16.68.G02.1.454.CMB.1.raw
tcagtgtactactccacgaccggtgctcgatttagtcgatagtgaagggaagggtctccgaaggcttcaccagtcctggacctcctgtgcaagaacatgaaacatctgtggttcttccttctcctggtggcagctcccagatgggtcctgtcccaggagcaactgcaggagtccgggcccaggactggtgaagtccttcggagaccccttgtcccctcaccctgcctacgtgtctctgggtggccttccttcagtccgtaagtttaccgtacgtgggacgtccgtaggtactcccggtaccaaggtccccgtaacccggtaaggggtaacggggtaccgttggggtacggttcgggtaactttacggtaccctttaagttacgtttccgtttaccgtttaaccggtaagggttacggggtaacgaccgtaaccgtacccgtaaaacccgttaacccccgaaaccccccctttacccgtaccgtaaaaccggtaacggttaccggtaacggttaacccggtaactaagtttaacgtttaacgggtaacggtaaccctaaaccggttaacccgtaaaaccggtaaaacccgtttaccggttttaccccgtagggtaaccggtccgttaggtaacggtttcgtacggtacggacccggtactcgggacccgtaccgtacccggttaccctttagtaccgtgtcgccgtacggaccggtccctagtacgtacgtgtaccttatacgacctaccgtaccgtccgttacgaccgttcccggtacgggacccgtaccgggtacccgtacgtcccgtaaccgttccaccgtacacccgtccctacccggtaaccgg

SEQ ID NO: 195911 - DNA, 822 bp, Homo sapiens
  misc_feature: GYAE6OF01CUWIL.16.68.G02.1.454.CMB.1.raw
  modified_base (800)..(800): a, c, t, g, unknown or other
  misc_feature (800)..(800): n is a, c, g, or t
tcagtgtactactccacgaccggtgctcgatttagtcgatagtgaagggaaaggggggcagggagtcagacccagtcaggacacagcatggacatgagggtccccgctcagctccgtgggctcctgctgctctggcctcccgaggtgccagatgtgactactccagtctcgaaccctagtcccttcccttacccctacccgtcgttcgtcgctacgttcgtaggtagggacgaacaggtactaccaccgtactccgtaccgttccgggcccgggtccgaagttccaaagtaaagtttaagttaaggttaaggggttgggttcggtccgttaggttaactccgaagaccgaaacggaaaacccggaacggggtaaaccggtacccccgttaaacggttccgtttacggtaatttacgtacttaggaactttacgttttaccgttaacgtttaacgggtaacgggttacggggtcccctaaaggtcgtaaacgggtttcgacggacggtagtacggggtcggttacgtacgggtagggaacttaacggtacttttcgaaccttacctcctaaacttccgaccctacccgaccgtcctactacccgtaactttacggtaacgtttagttaccgtttacgtaaaccctttaatttcgttaaacccgtcccggtaaactacgtaaacgttctaacttcgtacttacgtttaccgtttagtttaaccgggtttagggttaccgggtaaagggggacgtaaaccggggtaggtaacggaacggtaaccggaagtgttacggcgtacngacctagtctcgttgcttaccg

SEQ ID NO: 195912 - DNA, 713 bp, Homo sapiens
  misc_feature: GYAE6OF01DYR94.16.68.G02.1.454.CMB.1.raw
  modified_base (459)..(459): a, c, t, g, unknown or other
  misc_feature (459)..(459): n is a, c, g, or t
  modified_base (685)..(685): a, c, t, g, unknown or other
  misc_feature (685)..(685): n is a, c, g, or t
  modified_base (705)..(705): a, c, t, g, unknown or other
  misc_feature (705)..(705): n is a, c, g, or t
tcagtgtactactccacgaccggtgctcgatttagtcgatagtgaagggaaagggggcaggagtcagacccagtcaggacacagcatggacatgagggtccccgctcagctcctggggctccctgctgctcgtggcctcccgaggtcgccagatgtgacacgtccagatacgaccctagtcccttccctccaccctgtctcgctgtcgtggtagacgacagacgtaccacactctacgtccggccggacacgtacgtaagtaaagttaacgtttaaggtgggttagggttccggtaccgttagggttactacgaacggtaacgaaaccggtaaaccggaaacggggaacccgtaccccggttaaggtcctagtaactacgtaagtacgtaacgttaacctttacgttaacgtttaagggtaacggtccggttacctaggtaccgtaaggtacgtacggngtacgtagtacggacgttcggaacggactaagtacttacctaccttatactacctacgaccgaccgtacgtccgtaacctacgtacgtagtacttaggttacttacgtacttaattactaccgtacgtacgtactagtaactctaactgtacttataggtttacgttacggtagggacggtaacggtagtacgggaggtaaccgtacgtaagtacgttgacgtacngtacctaactgttcgttacncgttaccc

SEQ ID NO: 195913 - DNA, 815 bp, Homo sapiens
  misc_feature: GYAE6OF01A5TVK.16.68.G02.1.454.CMB.1.raw
  modified_base (105)..(105): a, c, t, g, unknown or other
  misc_feature (105)..(105): n is a, c, g, or t
tcagtgtactactccacgaccggtgctcgatttagtcgatagtgaagggaaagggggcaggagtcagacccagtcaggacacagcatggacatgagggtccccgntcagctcctggggctcctgctgctctggctcccaggtgccagatgtgacatccagatcgacccagtcctccttccaccctgtctgcatcgtgtaaggagacgagacgtccacctatctacgttcggcccgggctagtcaagtaaattaagttaaaggtagggttgggtttacggaccgttggtaactcgagaaccgaaggaaaaccgaacggggaaaccgtaccccggtaacggtaccgtagaacgttaagtacgtaggtaacgtactttacgttaacgtttaagggtaaacggtccggggtacctaagtaacgtaacggttaccgaggaccggtaacgaggttacggtagtaccggtacgggaactaacgtaactttcgtaacttccgtaacctaacttaccaacccgtaacccgtacgacccgtttaacgaacccgtaaaccccgttagtaacgtttagttaaccgtttacgtaaacgtttaaacctttaacgtttaacccgtacgtaaacccgttaaacgtaacggttaactacgttaacttacgtaacttaacgtttacggtttaacggtttaaccggttacggggttaacgggtaaacgggtaaaccggttaggggtaacgggtaaccgggtaaacgtaaggttaaccggtgggtaacgtccgttacgaacccgttactaacgtttcgttacgttcccttaaccg

SEQ ID NO: 195914 - DNA, 853 bp, Homo sapiens
  misc_feature: GYAE6OF01BSWF3.16.68.G02.1.454.CMB.1.raw
  modified_base (822)..(822): a, c, t, g, unknown or other
  misc_feature (822)..(822): n is a, c, g, or t
tcagtgtactactccacgaccggtgctcgatttagtcgatagtgaagggaaagggggcaggagtcagacccagtcaggacacagcatggacatgacgggtcccccgctcagcctccgtggggctcctgctgcctcgtcggcctcccgaggtcgccaggactggtacgacctactaccgaagtactaccgacccctagtcccttccccttaccctacccgtcgtctcgacctacgttcgtaggaacgggacaaccgaaggtacgtaccaaccgtatcctaccggtccgggcccgggtactaacggtacctaaatagtttaaagttaaggttacggggttacgggttcggtccgttagggtactaaccgaaccgaaacggaaaaccggaacgggtaaacccgtacccgttaaggtcctaagtaatacgttaagtacgtaacgttacctttaacgttaacgttaagggtaacggtaccgggtaccctagttaaccggtaacggttcgaacggtccggtacgtagggtcggtaacgtcggtaacgggaaccgttagtaacccgttactaccgttactaaccgttaccttacgacccaccgacgtacccgtacgtaccctaacggtactaggttacctttaacggttacctaactttaacctttacggttacctaccgtaactacgtaactctaactcttaactacgttatttacggttaagttttacggtaccggggtaggtacggtaaacgggtacggttaacgggtaaccggttaaagtaacccggtaggtttacggccgtaccggtaccaaccgttacccgtnttaccgtttcccttaacgttccgttaacccc

SEQ ID NO: 195915 - DNA, 843 bp, Homo sapiens
  misc_feature: GYAE6OF01BKLLO.16.68.G02.1.454.CMB.1.raw
  modified_base (827)..(827): a, c, t, g, unknown or other
  misc_feature (827)..(827): n is a, c, g, or t
  modified_base (835)..(835): a, c, t, g, unknown or other
  misc_feature (835)..(835): n is a, c, g, or t
tcagtgtactactccacgaccggtgctcgatttagtcgatagtgaagggaaagggggcaggagtcagacccagtcaggacacagcatggacatgagggtccccgctcagctccgtggggcctcctgctgcctctaggcctcccgaggtgccagactgtagacatccagactcgacctagtccttccctccacccgtgtactcgctatcgtaggtaggacgacgagtacgtaccaacatcctaccgttcgggaccccgggtacctagtactaacggtaatttaacgttaagttacgggttcgggttacggtaccgttagggtactacggtaacgaccgtaacggaaaacggaacgggtaaaccgtacccccgttaacgggtacctaggtaattaacgttagaggtaactacgtttaacgttacgtttaaaggtaacgggttaccggggtacctacggttaacggtaacgttaccggacggtaccgggtaacgtacgggtacggtaacgttcggtacgggtaacgaacgttaaccgttccaaccgttacctaactaaccttaaccgtacccgaacctaccggtaccttaccggaacccttaaacgtacgttaacgttacgtttaaccgtttaggtaacccttttaaacttaccgtttaaccgacccgtaaccggttaactaaccgttaactaggttaacctaccttaataccgtttaagttacgttaccggtttagggtaaccggggtaacggttaaccgggtaggtaaacgggttcgggaaaccctaaggggttactggtacgtccgtacggacctacgttaccggtnttaccgtnttaccccg

SEQ ID NO: 195916 - DNA, 487 bp, Homo sapiens
  misc_feature: GYAE6OF02HBGFU.16.68.G02.1.454.CMB.1.raw
tcagtgtactactccacgaccggtgctcgatttagtcgatagtgaagggaaaggggcaggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtgggtcccatcaaggttcagcggcagtggatctgggacagaattcactctcactatcaccagcctgcaactgatgattttgctaacttattactgccaacagtatcatcatcattgtaatttcggtgaggaccaggtggaggtcaacgactgtgctgcaccatctgtctc

SEQ ID NO: 195917 - DNA, 498 bp, Homo sapiens
  misc_feature: GYAE6OF02FULK5.16.68.G02.1.454.CMB.1.raw
  modified_base (451)..(451): a, c, t, g, unknown or other
  misc_feature (451)..(451): n is a, c, g, or t
tcagtgtactactccacgaccggtgctcgatttagtcgatagtgaagggaaagggggcaggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtccctgatatatgagacttctactttagaaagtgggtcccatcaaggttcagcggcagtggatctgggacagaattcactctcactatcaccagcctgcaacctgatgtattttgactaaacttatttactgaccaacagtatcatcatcattgtaatttcggnggagggaccaggtggaggtcaaagactgtgctgcaccatctgtctac

SEQ ID NO: 195918 - DNA, 498 bp, Homo sapiens
  misc_feature: GYAE6OF02IU06U.16.68.G02.1.454.CMB.1.raw
tcagtgtactactccacgaccggtgctcgatttagtcgatagtgaagggaaagggggcaggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtccctgatatatgagacttctactttagaaagtggggtcccatcaaggttcagcggcagtggatctgggacagaattcactctcactatcaccagcctgcaacctgatgattttgctaacttattactgccaacagtatcatcatcattgtaatttcggtagagggaccaaggtggaggtcaaacgaactgtggctgcaccatctgtcttc

SEQ ID NO: 195919 - DNA, 495 bp, Homo sapiens
  misc_feature: GYAE6OF02F0T8L.16.68.G02.1.454.CMB.1.raw
  modified_base (484)..(484): a, c, t, g, unknown or other
  misc_feature (484)..(484): n is a, c, g, or t
  modified_base (490)..(490): a, c, t, g, unknown or other
  misc_feature (490)..(490): n is a, c, g, or t
tcagtgtactactccacgaccggtgctcgatttagtcgatagtgaagggaaagggggcaggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtccctgatatatgagacttctactttagaaagtggggtcccatcaaggttcagtcggcagtggatctgggacagaattcaccctcactatcaccagcctgcaacctgatgatttgcaacttattactgccaacagtatcatcatcattgtaatttcggtggagggaccaaggtgaggtcaaagaactgtgctgcacntctgtntctac

SEQ ID NO: 195920 - DNA, 537 bp, Homo sapiens
  misc_feature: GYAE6OF02I19Z0.16.68.G02.1.454.CMB.1.raw
  modified_base (394)..(394): a, c, t, g, unknown or other
  misc_feature (394)..(394): n is a, c, g, or t
tcagtgtactactccacgaccggtgctcgatttagtcgatagtgaagggaaagggtctccgaaggcttcaccagtcctggacctcctgtgcaagaacatgaaacatctgtggttcttccttctcctggtggcagctcccagatgggtcctgtcccaggagcaactgcaggagtcgggcccaggactggtgaagccttcggagaccctgtccctcacctgcactgtctctggtggctccttcagcagttactactggagctggatccgtcagctcccagggaagggactggagtggattgcctatatctcttacagtggagcagcaactaccaacccctccctacaagacgtcgagtcgacatatagtagacacgtccaagaaccagttttcccngacgctgaggtctgtcgaccgctgcggacacggccctttatactgtgcgcgacgggcccctagtcgagtgactatgactcccagtcccttgacctccgtggggcccagggacccaggtccaccgtctcctcacgcctccaccg

SEQ ID NO: 195921 - DNA, 495 bp, Homo sapiens
  misc_feature: GYAE6OF02H8MPY.16.68.G02.1.454.CMB.1.raw
  modified_base (349)..(349): a, c, t, g, unknown or other
  misc_feature (349)..(349): n is a, c, g, or t
tcagtgtactactccacgaccggtgctcgatttagtcgatagtgaagggaaagggggcaggagtcagacccagtcaggacacagcatggacatgagggtccccgctcagctcctggggctcctgctgctctggctctcaggtgccagatgtgacatccagatgacccagtctccttccaccctgtctgcatctgtaggagacagagtcaccatcacttgccgggcagtcagaatattaataggtgttggcctggtatcagcagaaaccagggaaagcccctaaggtcctgatatatgagacttctactttagaaagtggggtcccatcaaggttcagcgcagtggatcngggacagaattcactctcactatcaccagcctgcaactgatgatttgctaattattactgccaacagtatcatcatcatttgtaatttcggtgagggtacaaggtaggaggtacaaacgaatgtggctacgcacctatctgttacc

SEQ ID NO: 195922 - DNA, 565 bp, Homo sapiens
  misc_feature: GYAE6OF02G83A5.16.68.G02.1.454.CMB.1.raw
tcagtgtactactccacgaccggtgctcgatttagtcgatagtgaagggaaagggggcaggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtgggtcccatcaaggttcagcgcagtgatcgtggacagaattcactctcactatcacagcctgcaacctgatgattttgacttaactttattactgaccaactagttatcatcaattactatttacgttaatttacgggtagggtaacgggtaccgaaggggttcggaacgggttacgaaaaccggtaacgttagggtacggttacgtacggactaacccgagtttaccgttggttccctttaaccg

SEQ ID NO: 195923 - DNA, 498 bp, Homo sapiens
  misc_feature: GYAE6OF02H6LA4.16.68.G02.1.454.CMB.1.raw
  modified_base (299)..(299): a, c, t, g, unknown or other
  misc_feature (299)..(299): n is a, c, g, or t
  modified_base (427)..(427): a, c, t, g, unknown or other
  misc_feature (427)..(427): n is a, c, g, or t
  modified_base (451)..(451): a, c, t, g, unknown or other
  misc_feature (451)..(451): n is a, c, g, or t
tcagtgtactactccacgaccggtgctcgatttagtcgatagtgaagggaaagggggcaggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccggccagtcagaatattaataggtggttggcctggtatcagcaagaaaccagggaaagcccctaaggtccctgatatangagacttctactttagaaagtgggtccatcaaggttcaggcgcagtggatcgtgggacagtaattcactctacaactatcaccagcctgacaacctgatgattttgacttaatttattactgaccaanatatcatcatctaattgtaattgnggagacgaggtgtaggtacaacgatgtagctgcaccatctgtcttac

SEQ ID NO: 195924 - DNA, 556 bp, Homo sapiens
  misc_feature: GYAE6OF02F36EM.16.68.G02.1.454.CMB.1.raw
  modified_base (390)..(390): a, c, t, g, unknown or other
  misc_feature (390)..(390): n is a, c, g, or t
  modified_base (443)..(443): a, c, t, g, unknown or other
  misc_feature (443)..(443): n is a, c, g, or t
tcagtgtactactccacgaccggtgctcgatttagtcgatagtgaagggaaagggtctccgaaggcttcaccagtcctggacctcctgtgcaagaacatgaaacatctgtggttcttccttctcctggtggcagctcccagatgggtcctgtcccaggagcaactgcaggagtcgggcccaggactggtgaagccttcggagaccctgtccctcacctgcactgtctctggtggctccttcagcagttactactggagctggatccgtcagctcccagggaaggactggagtggattgcctatatctcttacagtggagcagcaactacaacccctcctcaagagtcgagtcgacatattagtagacacgtccaagaaccagttttcccngaggctgaggtctgtgaccgctgcggacaccggtcctttattactgtgcgcgngggcccctatcgagtgactatgactcccgaggtccctttgacgtccgtcggggcccacggggtaaccccttggtacccgaccggtctcccgtcacgtcccctcccgaacccgg

SEQ ID NO: 195925 - DNA, 497 bp, Homo sapiens
  misc_feature: GYAE6OF02FOVZT.16.68.G02.1.454.CMB.1.raw
tcagtgtactactccacgaccggtgctcgatttagtcgatagtgaagggaaagggggcaggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtccctgatatatgagacttctactttagaaagtggggtcccatcaaggttcagcggcagtggatctgggacagaattcactctcactatcaccagcctgcaactgatgatttgctaacttattactgccaaacagtatcatcatcattgtaatttcggagtaggaccaaggtggaggtcaaacgaactgtggctggcaccatctgtcttc

SEQ ID NO: 195926 - DNA, 496 bp, Homo sapiens
  misc_feature: GYAE6OF02HPY0Z.16.68.G02.1.454.CMB.1.raw
tcagtgtactactccacgaccggtgctcgatttagtcgatagtgaagggaaagggggcaggagtcagacccagtcaggacacagcatggacatgagggtccccgctcagctcctgggctcctgctgctctggctcccaggtgccagatgtgacatccagatgacccagtctccttcaccctgtctgcatctgtaggagacagagtcaccatcacttgccgggccagtcagaatattaataggtgttggcctggtatcagcagaaaccagggaaagcccctaaggtcctgatatatgagacttctactttagaaagtgggtcccatcaaggttcagcggacagtggatctggacagaattcactctcactatcacagcctgcaactgatgattttgctaaactttatacttgacaacagtatcatcatcattgtaattcggagacgggtacaggtggaagtcaaacggtactgtagcgtgacacctatctgtcttac

SEQ ID NO: 195927 - DNA, 507 bp, Homo sapiens
  misc_feature: GYAE6OF02GU79M.16.68.G02.1.454.CMB.1.raw
  modified_base (200)..(200): a, c, t, g, unknown or other
  misc_feature (200)..(200): n is a, c, g, or t
tcagtgtactactccacgaccggtgctcgatttagtcgatagtgaagggaaagggggcaggagtcagacccagtcaggacacagcatggacatgagggtccccgctcagctcctggggctcctgctgctctggctcccaggtgccagatgtgacatccagatgacccagtctccttccaccctgtctgcatctgtagganacagagtcaccatcacttgccgggccagtcagaatattaataggtggttggcctggtatcagcagaaaccagggaaacgcccctaaggtcctgatatatgagacttctactttagaaagtggggtcccatcaaggttcagcggcagtggatctgggacagaattcactctcactatcaccagcctgcaacctgatgtattttgctaaactttattactgaccaacagtatcatcatcatttgtaatttcggtaggagggaccgagggtggaggtacaaacgtacgtgtgctgcaccatctgtcttac

SEQ ID NO: 195928 - DNA, 579 bp, Homo sapiens
  misc_feature: GYAE6OF02HX9X8.16.68.G02.1.454.CMB.1.raw
  modified_base (322)..(322): a, c, t, g, unknown or other
  misc_feature (322)..(322): n is a, c, g, or t
  modified_base (365)..(365): a, c, t, g, unknown or other
  misc_feature (365)..(365): n is a, c, g, or t
  modified_base (389)..(389): a, c, t, g, unknown or other
  misc_feature (389)..(389): n is a, c, g, or t
tcagtgtactactccacgaccggtgctcgatttagtcgatagtgaagggaaagggtctccgaaggcttcaccagtcctggacctcctgtgcaagaacatgaaacatctgtggttcttccttctcctggtggcagctccagatgggtcctgtcccaggagcaactgcaggagtcgggcccaggactggtgaagccttcggagaccctgtccctcacctgcactgtctctggtggctccttcagccagttactactggagctggatccgtcagctcccaggggaagggactggagtggattgcctatatctcttacagtgggancagcaactacaacccctcctcaagatcgagtcgacatataganacacgtcaaagaccagttttcccngagctgaggtctgtgaccgctggcggacgacggtccctttattacgtgtcgcgcggacggcccctagtcgagtgactatcgactcccgaggtcccttttggaccttcccggtcggggtcccgaacggggtaacccctcgggtaccgtacccggtccttacccgtaccgtacgtcccgtacccaaccccgg

SEQ ID NO: 195929 - DNA, 579 bp, Homo sapiens
  misc_feature: GYAE6OF02H64TX.16.68.G02.1.454.CMB.1.raw
  modified_base (318)..(318): a, c, t, g, unknown or other
  misc_feature (318)..(318): n is a, c, g, or t
  modified_base (344)..(344): a, c, t, g, unknown or other
  misc_feature (344)..(344): n is a, c, g, or t
  modified_base (392)..(392): a, c, t, g, unknown or other
  misc_feature (392)..(392): n is a, c, g, or t
tcagtgtactactccacgaccggtgctcgatttagtcgatagtgaagggaaagggtctccgaaggcttcaccagtcctggacctcctgtgcaagaacatgaaacatctgtggttcttccttctcctggtggcagctcccagatgggtcctgtcccaggagcaactgcaggagtcgggcccaggactggtgaagccttcggagaccctgtccctcacctgcactgtctctggtggctccttcagcagttactactggagctggatccgtcagctcccagggaaggctggagtggattgcctatatctcttacagtggancagcaactacaaccccctcctcaagngtcgagtcgacatattagtagacacgtaccaagaacctagttttcccngtacggctaggacggttctgtcgaccgcgtgccggacaccggtcccttttatactgttcgcgcggacggcccctagtcgagtgactatcgactccgaggtccctttgaccttccggtcggggcccaacggggtaccccttggtccctacccggttcctcccgttcgaccgtcccctcccaaccccgg

SEQ ID NO: 195930 - DNA, 501 bp, Homo sapiens
  misc_feature: GYAE6OF02GKBJI.16.68.G02.1.454.CMB.1.raw
  modified_base (492)..(492): a, c, t, g, unknown or other
  misc_feature (492)..(492): n is a, c, g, or t
tcagtgtactactccacgaccggtgctcgatttagtcgatagtgaagggaaagggggcaggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaaggtccctgatatatgagacttctactttagaaagtgggtccatcaaggttcagcggcagtggatcgtgggacagaattcactctcactatcaccagcctgcaacctgatgtatttgactaactttattactgaccaactagtatacatcatctattagtaatttcggagacggtacaggtggagtcaaacgtactgtgctgcaccntctgtcttc

SEQ ID NO: 195931 - DNA, 817 bp, Homo sapiens
  misc_feature: GYAE6OF02H9DRP.16.68.G02.1.454.CMB.1.raw
  modified_base (201)..(201): a, c, t, g, unknown or other
  misc_feature (201)..(201): n is a, c, g, or t
tcagtgtactactccacgaccggtgctcgatttagtcgatagtgaagggaaagggggcaggagtcagacccagtcaggacacagcatggacatgagggtccccgctcagctcctggggctcctgctgctctggctcccaggtgccagatgtgacatccagatgacccagtcctccttccaccctgtctgcatctgtagganacagagtcaccatcacttgccggcagtcagaatattaagtaggtgttgcctggtatcagcaagaaacagggaaacgtaccccgtaaggtaccctagaacttaataagtagtacgtacctttactaaccgttttagaaaacggttcggggttaccccaagttaccgaaaggtttcaacggtcggtaccgaaggtagggactcggttagggaactaggtaaactttcaacgttcctacgtaacttacttaccaaccgtacgtaccccttaggaccctaaaccgttcggaacgttacgtttaacgtttttcggaaccttaaaaccgttttttaacgtttaacccgttaacgtaaacccgttaaaacgtaacgttttaacttaaaccctaacttaacctaaccttttaaccgttaaggtttttttaacgtttaaaacgggtttttccgggggtaaacggggtttaaaccgggggtaaccccgttaaagggggtttaccggggtaaccggggtttaaaccggtaaaaacccgggtaacgggtttacgggtttaaccgggcgtttaaacggcccggttaaacccgtaaggttttccggtttaccggtttcccttttaacccg

SEQ ID NO: 195932 - DNA, 546 bp, Homo sapiens
  misc_feature: GYAE6OF02F61WR.16.68.G02.1.454.CMB.1.raw
tcagtgtactactccacgaccggtgctcgatttagtcgatagtgaagggaaagggggcaggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtccctggatatatgagacttctactttagaaagtggggttccatcaaggttcagcggcagtggatctgggacagaattcactctcactatcaccagcctgcaacctgatgtattttgctaacttattactgacctaacagttatcattcattctatttagttaatttcgggtaggaacgggtaccgaagggttggaagggttaccaaacggtaacgtggttacggacgttacggcctaccgtatcgttgtcctttaccg

SEQ ID NO: 195933 - DNA, 676 bp, Homo sapiens
  misc_feature: GYAE6OF02I3HG0.16.68.G02.1.454.CMB.1.raw
  modified_base (294)..(294): a, c, t, g, unknown or other
  misc_feature (294)..(294): n is a, c, g, or t
tcagtgtactactccacgaccggtgctcgatttagtcgatagtgaagggaaagggggcaggagtcagacccagtcaggacacagcatggacatgagggtccccgctcagctcctgggctcctgctgctctggctcccaggtgccagatgtgacatccagatgacccagtctccttccacctgtctgcatctgtaggagacagagtcaccatcacttgccggcagtcagaatattaataggtggttgcctggtatcagcagaaaccgagggaacgccctaaaggtccctgattanactgagacttctacttagaaagtgggtccaatcaaggttcaagtcggactaggtacggatacgtacgggaacagtaaacgttcacttacctacgtaacctaattaccgaaacctacgtacccttacggacctaacccgttagagttacgtacgtttttagaccttaaactttacgttaactcgtaaccctaaacgtacgttaactacgtaacttacgtaacttaaccttacgttttaacggttaacgttttacgggttacgggaacggggttaacccgttaaggggttacgtaacggggttaaccgtaaaaccggttacgttacggtacgggtaccgttaacggtacgtaaccctaaggtttaccttacggttctttaaccc

SEQ ID NO: 195934 - DNA, 505 bp, Homo sapiens
  misc_feature: GYAE6OF02F15E4.16.68.G02.1.454.CMB.1.raw
tcagtgtactactccacgaccggtgctcgatttagtcgatagtgaagggaaagggggcaggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtgggtccatcaaggttcagcggcagtgatcgtggacagaattcactctcactatcaccagcctgcaacctgactgtatttgctaatttatactgaccaactagtatcatcatcatttgtaatttcggtggagggaccagggtggaggtacaaacgtacgtgtaggctggaccaccatctcgtcttac

SEQ ID NO: 195935 - DNA, 634 bp, Homo sapiens
  misc_feature: GYAE6OF02I1S8H.16.68.G02.1.454.CMB.1.raw
  modified_base (201)..(201): a, c, t, g, unknown or other
  misc_feature (201)..(201): n is a, c, g, or t
  modified_base (274)..(274): a, c, t, g, unknown or other
  misc_feature (274)..(274): n is a, c, g, or t
  modified_base (345)..(345): a, c, t, g, unknown or other
  misc_feature (345)..(345): n is a, c, g, or t
tcagtgtactactccacgaccggtgctcgatttagtcgatagtgaagggaaagggggcgaggagtcagacccagtcaggacacagcatggacatgagggtccccgctcagctcctggggctcctgctgctctggctcccaggtgccagatgtgacatccagatgacccagtctccttccaccctgtctgcatctgtagganacagagtcacatcacttgccggcagtcagaatattaataggtggtggctggtatcagcaagaaacagggaaancccgtaagtcctagatatatgagacttctactttagaaagtgggtaccatacaaggttcagtcggactagngatcgtggacagtaattacactctacgactataccacctaagtcctacgactaactcgtaatcgttaatttcgacttaaactttatttaactcgaaccaaactagttaactactaatactaacttactaatttacgttaagtttacggttagggaaccgggtaaccggtaaggggttaccgggtaaagggttaacccgtaaaaacgggttacgttaacgggttaccgggtaccggtttaagggaaccctaaccgttaacggtttaccgttcgtttaccgtttaaccccg

SEQ ID NO: 195936 - DNA, 517 bp, Homo sapiens
  misc_feature: GYAE6OF02IBUCJ.16.68.G02.1.454.CMB.1.raw
  modified_base (249)..(249): a, c, t, g, unknown or other
  misc_feature (249)..(249): n is a, c, g, or t
  modified_base (252)..(252): a, c, t, g, unknown or other
  misc_feature (252)..(252): n is a, c, g, or t
  modified_base (281)..(281): a, c, t, g, unknown or other
  misc_feature (281)..(281): n is a, c, g, or t
tcagtgtactactccacgaccggtgctcgatttagtcgatagtgaagggaaagggggcaggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccggcagtcagatatatagtgtgctgtatnagnagaacaggaagccctaagtcctgatatangagtacttactactttagaaagtgggtaccatcaaggttcagcggcagtgatcgtggacagaattcactctacactactcacagcctagccaactgattgtattttgactaactttattactacgtacaactagtactactatacattactatttagttagtttcggaggtagggtaccgtagggttaggaggtacgaaagtacgtagtaggctacgctaccatacttgtcttacc

SEQ ID NO: 195937 - DNA, 630 bp, Homo sapiens
  misc_feature: GYAE6OF02HTFO1.16.68.G02.1.454.CMB.1.raw
tcagtgtactactccacgaccggtgctcgatttagtcgatagtgaagggaaagggtctccgaaggcttcaccagtcctggacctcctgtgcaagaacatgaaacatctgtggttcttccttctcctggtggcagctcccagatgggtcctgtcccaggagcaactgcaggagtcgggcccaggactggtgaagccttcgggagaccctgtccctcacctgcactgtctctggtggctccttcagcagttactactggagctggatccgtcacgctcccaggggaagggactggagtggattgcctatatctcttacgagtggagcagcaactacaacccctccctacaagagtcgagtcgacatattagtagacacgtccaagaccctagtttttccccaggtacggtctaggtacggtctggtcgtaccgtctcggccgggacgaccggtcccttttaataccgtttggtcgcggcggtacgggccccttagtccggagtcgaacttagttcgactaccccgtagggtcccctttaggaccttcccggtcgggggacccgaacggggttaccccgtggttacccgacccggttccgttccctaccggaccgtcccgtacccgaacccgg

SEQ ID NO: 195938 - DNA, 550 bp, Homo sapiens
  misc_feature: GYAE6OF02IOXT2.16.68.G02.1.454.CMB.1.raw
  modified_base (200)..(200): a, c, t, g, unknown or other
  misc_feature (200)..(200): n is a, c, g, or t
  modified_base (231)..(231): a, c, t, g, unknown or other
  misc_feature (231)..(231): n is a, c, g, or t
tcagtgtactactccacgaccggtgctcgatttagtcgatagtgaagggaaagggggcaggagtcagacccagtcaggacacagcatggacatgagggtccccgctcagctcctggggctcctgctgctctggctcccaggtgccagatgtgacatccagatgacccagtctccttccaccctgtctgcatctgtagganacagagtcaccatcacttgccgggcagtcanatatatagtggtgctggtatcagcagaaacagggaaacgcccctaaggtcctagatatatgagacttctaactttagaaagtggggtaccagtcaaggttcagcggcagtggatcgtaggacagaattcactctactactatcaacacgcctgaccaactgatgtattttcgactaactttattactgacctaacagtaactctaatcattactatttagttaagtttcggtagggtacgggaaccgtagggtaggaacggtaactaaaacggtacgttggtacggtactcgtaccgactactacgttcgtcctttacg

SEQ ID NO: 195939 - DNA, 503 bp, Homo sapiens
  misc_feature: GYAE6OF02HKCA5.16.68.G02.1.454.CMB.1.raw
  modified_base (486)..(486): a, c, t, g, unknown or other
  misc_feature (486)..(486): n is a, c, g, or t
tcagtgtactactccacgaccggtgctcgatttagtcgatagtgaagggaaagggggcaggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtccctgatatatgagacttctactttagaaagtggggtccatcaaggttcagcgcagtggatctgggacagaattcactctcactatcaccagcctgcaacctgatgtattttcgctaactttattactgtaccaacagtatcatcatcatttgtaatttcggtaggagggtacaggtggaggtacaacgacgtgtggntgacacatctgtcttac

SEQ ID NO: 195940 - DNA, 524 bp, Homo sapiens
  misc_feature: GYAE6OF02FZVRV.16.68.G02.1.454.CMB.1.raw
tcagtgtactactccacgaccggtgctcgatttagtcgatagtgaagggaaagggggcaggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggctggtatcagcagaaaccagggaagcccctaaggtcctgatatatgagacttctacttagaaagtgggtccatcaagttcagcggcagtgatctgggacagaattcactctcactatcaccagcctgacaactgatgtattttgctaacttattactgaccaatagtatcatcatctatttagtaacgtttcggtggaacgggtacctaagggtggtaacggtacgaaacgtaacgtcggtggctacgctaacctagttcgtcgtacttaccg

SEQ ID NO: 195941 - DNA, 556 bp, Homo sapiens
  misc_feature: GYAE6OF02I9QAL.16.68.G02.1.454.CMB.1.raw
  modified_base (320)..(320): a, c, t, g, unknown or other
  misc_feature (320)..(320): n is a, c, g, or t
  modified_base (346)..(346): a, c, t, g, unknown or other
  misc_feature (346)..(346): n is a, c, g, or t
  modified_base (395)..(395): a, c, t, g, unknown or other
  misc_feature (395)..(395): n is a, c, g, or t
  modified_base (404)..(404): a, c, t, g, unknown or other
  misc_feature (404)..(404): n is a, c, g, or t
tcagtgtactactccacgaccggtgctcgatttagtcgatagtgaagggaaagggtctccgaaggcttcaccagtcctggacctcctgtgcaagaacatgaaacatctgtggttcttccttctcctggtggcagctcccagatgggtcctgtcccaggagcaactgcaggagtcgggcccaggactggtgaagccttcggagaccctgtccctcacctgcactgtctctggtgctccttcagcagttactactggagctggatccgtcagctcccgagggaagggctggagtggattgcctatatctcttacagtgggancagcaactaccaacccctcctcaagngtcgagtcgacatagttagagacacgtaccaagaaccctagttttcccngacggctgnggtctgtcgaccgcgtgcggacaccggtcctttattacgtgtcgccggcgacggcccctagtccgagtcgactctgactccgtacgtcccttgactccgtcgggaccacgggaccctcgtccaccgtcctcctcacgtccctaccgacccgg

SEQ ID NO: 195942 - DNA, 574 bp, Homo sapiens
  misc_feature: GYAE6OF02IL21N.16.68.G02.1.454.CMB.1.raw
  modified_base (130)..(130): a, c, t, g, unknown or other
  misc_feature (130)..(130): n is a, c, g, or t
  modified_base (277)..(277): a, c, t, g, unknown or other
  misc_feature (277)..(277): n is a, c, g, or t
  modified_base (436)..(436): a, c, t, g, unknown or other
  misc_feature (436)..(436): n is a, c, g, or t
  modified_base (565)..(565): a, c, t, g, unknown or other
  misc_feature (565)..(565): n is a, c, g, or t
tcagtgtactactccacgaccggtgctcgatttagtcgatagtgaagggaaagggggcaggagtcagacccagtcaggacacagcatggacatgagggtccccgctcagctcctggggctcctgctgctntggctcccaggtgccagatgtgacatccagatgacccagtctccttccaccctgtctgcatctgtaggagacagagtcaccatcacttgccgggcagtcagtaactataataggtggttggcctggtatcagcagaaccagggaacnccctaaggtcctggactatataggagtactttactacgttttaagaaacggttcggggttacccagtcgtaaggttcaggtcgggactaggtcggatcggtaggtacgagtaattcacgtctactactactccaaccacgtacctgaccgaaccgttanacttagtacttttgactaactttattactgacctaacagtacactatcatctagttacgttattcggtagacgggtaccagggtaggaacggtcaaacggatggtcgacgtcgacacctagtaccgttntaccttacg

SEQ ID NO: 195943 - DNA, 586 bp, Homo sapiens
  misc_feature: GYAE6OF02HPT6C.16.68.G02.1.454.CMB.1.raw
  modified_base (342)..(342): a, c, t, g, unknown or other
  misc_feature (342)..(342): n is a, c, g, or t
  modified_base (427)..(427): a, c, t, g, unknown or other
  misc_feature (427)..(427): n is a, c, g, or t
tcagtgtactactccacgaccggtgctcgatttagtcgatagtgaagggaaagggggcaggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtccatcaaggttcagcggnagtggatctgggacagaattcactctcactactcaccagcctgcaacctgaatgtattttgctaactttattactgacctaaacngttactctaatcaattcctaatttcgttaaagttttcggtaggggtaacgggtaaccgtaacggggttggggtaacgggttaacgaaaaccggtaacgttacgggttacgggcgttacgggtacctaacccgtagtttccgttacgttcctttaacccg

SEQ ID NO: 195944 - DNA, 674 bp, Homo sapiens
  misc_feature: GYAE6OF02IKU5F.16.68.G02.1.454.CMB.1.raw
  modified_base (263)..(263): a, c, t, g, unknown or other
  misc_feature (263)..(263): n is a, c, g, or t
  modified_base (400)..(400): a, c, t, g, unknown or other
  misc_feature (400)..(400): n is a, c, g, or t
  modified_base (670)..(670): a, c, t, g, unknown or other
  misc_feature (670)..(670): n is a, c, g, or t
tcagtgtactactccacgaccggtgctcgatttagtcgatagtgaagggaaagggtctccgaagccttcggagaccctgtccctcacctgcactgtctctggtggctccttcagcagttactactggagctggatccgtcagctcccagggaagggactggagtggattgcctatatctcttacagtgggagcagcaactacaacccctccctacaagagtcgagtcgacatattagtagacacgtcaagaaccagttttccngagctgaggtctgtgacgctgcggacacggccctttatactgtgcgcgacggcccctatcgaggtcgactagtcgactcccgaaggtcctttgacgtccgtggggccaagggaaccctggtcaaccggtctcccgtnacgtccctacaacccgaacgggccctaacgtccggttaccctttccccccgtcggcccgacccgtgcctcccgaggaccgtcctaaccctcggaacgacgccaaccgacggccggccccgttgggcccgtcgtacccgtcgggttacgaaacggtaacccgttaccgttaaccggtacggtaaccggttaacgaacccggttacggaaccgggtacccggggtaccgtacggggaacccgtaaacggggccgaacccggtaagttacggnacgg

SEQ ID NO: 195945 - DNA, 681 bp, Homo sapiens
  misc_feature: GYAE6OF02JWWYK.16.68.G02.1.454.CMB.1.raw
tcagtgtactactccacgaccggtgctcgatttagtcgatagtgaagggaaagggtctccgaaggcttcaccagtcctggacctcctgtgcaagaacatgaaacatctgtggttcttccttctcctggtggcagctcccagatgggtcctgtcccaggagcaactgcaggagtcgggcccaggactggtgaagccttcgggagaccctgtcccctcacctgcactgtctcgtggtcggctccttcagccagttactacgtggacgctgactccgtcagctccgagggaaggctggagtggtatgctatagtctacttacgaggtgggacgctacgacaaccgtaaccaccccgtcctacgaagacgtcgagtcgactatagttagtacgactacgtaccaacggtacctacgttttcccaggacggtctaggtacgttcgtcgtcgtaccgcgttacggacccggtaacgttaccggttacccttttaagttaccgtagggttcgaccgggtacggacccgggttaccccttaaggtcggtacggtacgtaccttaagtccgtaccgtacccgggtacgttacccgttcggtacccgttcgggtccggggtccgtaaccgggtaacccgttcgtacccgtaccgttcctcccgtacacccggtccctaacccgtaaccggg

SEQ ID NO: 195946 - DNA, 560 bp, Homo sapiens
  misc_feature: GYAE6OF02FZWEN.16.68.G02.1.454.CMB.1.raw
tcagtgtactactccacgaccggtgctcgatttagtcgatagtgaagggaaagggggcaggagtcagacccagtcaggacacagcatggacatgagggtccccgctcagctcctggggctcctgctgctctggctcccaggtgccagatgtgacatccagatgacccagtcctccttccaccctgtctgcatctgtaggagacagagtcaccatcacttgccgggccagtcagaatattaataggtggttgctggtatcagcaagaaaccagggaaacgacccctaaggtccctagatatatgagtacttctacttaagaaagtcgggtccagtcaaggttcagcgcagtgatcgtagggacagtacttcactctacactctacgaccagcctagccaactgatgtacttttgacttaacttattactacgaccaatacgtatactatctaatctatttagttaatttcgggaagtacgggtaacgtaggtacggtaacggtaacgaaacgtaacgtaggtacggtactcgacctaacctacgttcgttacgtcttaccg

SEQ ID NO: 195947 - DNA, 588 bp, Homo sapiens
  misc_feature: GYAE6OF02I7EZI.16.68.G02.1.454.CMB.1.raw
  modified_base (355)..(355): a, c, t, g, unknown or other
  misc_feature (355)..(355): n is a, c, g, or t
  modified_base (389)..(389): a, c, t, g, unknown or other
  misc_feature (389)..(389): n is a, c, g, or t
tcagtgtactactccacgaccggtgctcgatttagtcgatagtgaagggaaagggggcaggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggcagtcagatataataggtggtgctggtatcagcagaaaccagggaacgaccccttaaggtcctggacttatatgagacttactactttaaggaagttgggtccatcgaaggttcaggcgcagtcggatcgngggacagtattcactctacactactaccacctancctcgacctaacctgatgtaatttcgtaacttaactttattactacgacctaaatacgtacttacattacctaattcctatttaggttaacgttttcgggtagggaggtaacccgtaggtagggtacggtaactaaaacggtacgttacggtacggtacgtacggacctaacctacgtttcggtacgtttacccttacg

SEQ ID NO: 195948 - DNA, 558 bp, Homo sapiens
  misc_feature: GYAE6OF02FPBLO.16.68.G02.1.454.CMB.1.raw
  modified_base (414)..(414): a, c, t, g, unknown or other
  misc_feature (414)..(414): n is a, c, g, or t
tcagtgtactactccacgaccggtgctcgatttagtcgatagtgaagggaaaggggggcaggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcactgccgggcagtcagatattaataggtggtggctggtatcagcagaaaccagggaacgcccctaaggtcctagatatatgagacttctacttagaagtgggtaccatcaagttcagcggcagtggatcgtagggacagattcactctacactatccacagtcctgacaactgatgtatttcgactaactttattactnacctaactagttatcaattcattactatttagttaaagtttcgggtagtacgggtaccgaaggggtcggtaaggtaaccgaaacggtaacgttagggtcggtacgttacggacctaccgtaacgttcgttacgttcgtttaccg

SEQ ID NO: 195949 - DNA, 565 bp, Homo sapiens
  misc_feature: GYAE6OF02HDUW2.16.68.G02.1.454.CMB.1.raw
  modified_base (318)..(318): a, c, t, g, unknown or other
  misc_feature (318)..(318): n is a, c, g, or t
  modified_base (331)..(331): a, c, t, g, unknown or other
  misc_feature (331)..(331): n is a, c, g, or t
  modified_base (413)..(413): a, c, t, g, unknown or other
  misc_feature (413)..(413): n is a, c, g, or t
  modified_base (462)..(462): a, c, t, g, unknown or other
  misc_feature (462)..(462): n is a, c, g, or t
  modified_base (485)..(485): a, c, t, g, unknown or other
  misc_feature (485)..(485): n is a, c, g, or t
  modified_base (555)..(555): a, c, t, g, unknown or other
  misc_feature (555)..(555): n is a, c, g, or t
tcagtgtactactccacgaccggtgctcgatttagtcgatagtgaagggaaagggtctccgaaggcttcatcagtcctggacctcctgtgcaagaacatgaaacatctgtggttcttccttctcctggtggcagctcccagatgggtcctgtcccaggagcaactgcaggagtcgggcccaggactgggtgaagccttcggagaccctgtccctcacctgcactgtctctggtggctccttcagctagttactacgtggacgctggactccgtcagcctcccgagggtaaggctgggagtggattgacctatactctnttacgagtgggancagcaaactcctaacccctcctagaacgacgtcgagtccgactatacgttagacgacacgtacaaagtaccttagtttcccngtacgtcgtgtacggtctgtcgacgcgtgcggacacggtccttattcgngtcgcgcgaccggtcctagtcgngtacgtctagtcactaccgacgtccgttgaccgtcgcggcgtacggtaccgtggcctccggtctccgtcnccgcctaccg

SEQ ID NO: 195950 - DNA, 515 bp, Homo sapiens
  misc_feature: GYAE6OF02FSAZP.16.68.G02.1.454.CMB.1.raw
tcagtgtactactccacgaccggtgctcgatttagtcgatagtgaagggaaagggggcaggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggcagtcagaatattaataggtggttggcctggtatcagcagaaaccagggaaagcccctaaggtcctggatatatgagacttctactttagaaagtggggtcccatcaaggttcagcggcagtgatctgggacagaattcactctcactatcaccagcctgccaacctgatgtattttcgactaaacttattaactgaccaacagtatacatcatcatttagtaactttcggtagacgggacctagggtggtaacgtcgaaacgactggtgcgtgccaccatctgtcttacg

SEQ ID NO: 195951 - DNA, 607 bp, Homo sapiens
  misc_feature: GYAE6OF02I1T06.16.68.G02.1.454.CMB.1.raw
tcagtgtactactccacgaccggtgctcgatttagtcgatagtgaagggaaagggtctccgaaggcttcaccagtcctggacctcctgtgcaagaacatgaaacatctgtggttcttccttctcctggtggcagctccagatgggtcctgtcccaggagcaactgcaggagtcgggcccaggactggtgaagccttcggagaccctgtccctcacctgcactgtctctggtggctccttcagcagttactactggagctggatccgtcagctcccgagggaaggactggagtggattgcctatattctacttacaggtgggagcagcaacctacaacccctcctacaagagtcgagtacgacatatagtacgacacgtaccaacgaactacgttttacctagagctgacggtctcgtcgaccgtcgtcggacggaccgtaacggtcccttttacgttacgttggcgtccggcggaaccgggtcccctagtccggtagtacgtacgttagtacgacgtcccgtacggtccctttagccttccggcggggtcccgacggggtaaccctcggtacacccgtcgtccgtacaccgtcctacccgaacccgg

SEQ ID NO: 195952 - DNA, 675 bp, Homo sapiens
  misc_feature: GYAE6OF02HI8L7.16.68.G02.1.454.CMB.1.raw
tcagtgtactactccacgaccggtgctcgatttagtcgatagtgaagggaaagggggcaggagtcagacccagtcaggacacagcatggacatgagggtccccgctcagctccgtggggctcctgctgctctggctcccaggtgccagatgtgacatccagatgacccagtctccttccacctgtctgcatctgtaggagacagagtcacatcacttcgccgggcagtcagtaatattaagtaggttggtgtccgtggtatcagacaagaaacgacgggaacaccccgtaaggtcctagtactaatagtggaactactttacgtaactttaaggaaaggttcggggtaccctaagtaccgtaaggttcaacggcggactaggtaggacgttcggtaggacaagtaatcgtaactctacgtactacgtccaacctaggccttagacctaacgtcgagttagtttactttgaaaccttaacgtttattacttacgaacctaaacgtacgttaactacttaactctaattcgttaacgtttacgtttttaacggttacgggtaacgggtacggggtaaaccggtaaggggttaacggaacgggtttaaacccgaaaaggttaccggttaggacgtaaccgttcggaacctaccgacgtttcgtaccgtttacttaccg

SEQ ID NO: 195953 - DNA, 640 bp, Homo sapiens
  misc_feature: GYAE6OF02JD80C.16.68.G02.1.454.CMB.1.raw
  modified_base (104)..(104): a, c, t, g, unknown or other
  misc_feature (104)..(104): n is a, c, g, or t
  modified_base (199)..(199): a, c, t, g, unknown or other
  misc_feature (199)..(199): n is a, c, g, or t
  modified_base (292)..(292): a, c, t, g, unknown or other
  misc_feature (292)..(292): n is a, c, g, or t
tcagtgtactactccacgaccggtgctcgatttagtcgatagtgaagggaaagggggcaggagtcagacccagtcaggacacagcatggacatgagggtcccgntcagctcctggggctcctgctgctctggctcccaggtgccagatgtgacatccagatgacccagtctccttccaccctgtctgcatctgtagganactgagtcaccattcacttgccggcagtcagaatataataggtgtgctgtatcagcagaaaccagggaaacgtccctaaggtcctagatatangacgacttctacttttagaaagttcggggtccctagtctaaggttcaggcggtcagtggatcgtaggacagtaacttcactcgtcactatcacctagcctgaccaaccttgaacttagtatttacgacttaaactttattaccgttacgacctaaacacgttaactacgtacttactaaacttccgttaagttttacgttaaggttttaccgggtacgggtaacggggtacccgtaaggggttaccgggtaaggtaacccggtaaaacggttaacgtcgggttacgggttaccgttacggacccgttaacccgtacggtttaccgttaccggtttaccgtttaacccg

SEQ ID NO: 195954 - DNA, 710 bp, Homo sapiens
  misc_feature: GYAE6OF02ILZEZ.16.68.G02.1.454.CMB.1.raw
tcagtgtactactccacgaccggtgctcgatttagtcgatagtgaagggaaagggggcaggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagatataagtggtggttggctgtatcagacagaaacgaggaacgacccctaaggtcctgatatatagacgtacttcttaacgtttaaggaaaggtcgggtaccctaagtacgtaacggttcaggtccggacgtaggtaggatcgtagggaactagtaaacttccaaccttcctacctaactactaccaacctacgtcctacgacctaaccgtgtaacgtagttacttttacgaacctttaaactttaatttaccgtaacgtaaccccgtaaacgtaacgttaactacttaacttcctaactttacgttaagttttaacgttttaaaccggttttacgggggtaaacgggtaaccggggttaaccgggtaaggggtttacgggtaaaccgggttaaccggtaaaaaccggtaccgttagggtaccggtacgttaccggtaaccctaccgtacgtttacgttaccgtttacccgttaacccg

SEQ ID NO: 195955 - DNA, 633 bp, Homo sapiens
  misc_feature: GYAE6OF02JG7SX.16.68.G02.1.454.CMB.1.raw
  modified_base (258)..(258): a, c, t, g, unknown or other
  misc_feature (258)..(258): n is a, c, g, or t
  modified_base (324)..(324): a, c, t, g, unknown or other
  misc_feature (324)..(324): n is a, c, g, or t
  modified_base (451)..(451): a, c, t, g, unknown or other
  misc_feature (451)..(451): n is a, c, g, or t
tcagtgtactactccacgaccggtgctcgatttagtcgatagtgaagggaaagggtctccgaaggcttcaccagtcctggacctcctgtgcaagaacatgaaacatctgtggttcttccttctcctggtggcagctcccagatgggtcctgtcccaggagcaactgcaggagtcgggcccaggactggtgaagccttcggagaccctgtccctcacctgcactgtctctggtggctccttcagcagttactactgganctggatccgtcagctcccaggggaacggctgggatggattgcctatatctacttacaggtgggacncagccaaactaccaacccccgtcctacgaaagtcgtacgagtacgactaattattacggaacgactaccgtaccaaacgaacccttacgttttcccaggacggtctggaggttctggtacgaccgtntacggccgactcggtaccctttatacgcggtgaccgtcggacgggccccttagtccggagtcgactagtcgactcccgagtccctttgaccgtccggtcggggaccctaacggggtaccccttgggtaacccttaccccgggttcctacccgtccgtaccggtccccttacccgaacccggg

SEQ ID NO: 195956 - DNA, 614 bp, Homo sapiens
  misc_feature: GYAE6OF02GTMXG.16.68.G02.1.454.CMB.1.raw
  modified_base (200)..(200): a, c, t, g, unknown or other
  misc_feature (200)..(200): n is a, c, g, or t
  modified_base (384)..(384): a, c, t, g, unknown or other
  misc_feature (384)..(384): n is a, c, g, or t
tcagtgtactactccacgaccggtgctcgatttagtcgatagtgaagggaaagggggcaggagtcagacccagtcaggacacagcatggacatgagggtccccgctcagctcctggggctcctgctgctctggctcccaggtgccagatgtgacatccagatgacccagtctccttccaccctgtctgcatctgtagganacagagtcaccatcacttgccggcagtcagaatattaataggtggttggctggtatcagcaagaaaccgagggaaacgcccctaaggtcctagatatatggatacttctacgtttagaagtcgggtaccatactaaggttcaggcggcgaggtggatcgaggacagtaattcactctcactacncaccacgcctcgacctaacctgtattgtacttttcgaccttaaactttactttacgtcgaaccctaactacgttaactactaactacctatacttaagttttagttaacggtttacgggtaggtaaccgggtaaccgtaaggggtaggtaacgggtaacgaaaaccggtaacggttacggtacggtcgtacggtaccctaccgtacgtttaccgttcggttaccttaccg

SEQ ID NO: 195957 - DNA, 590 bp, Homo sapiens
  misc_feature: GYAE6OF02FJY8T.16.68.G02.1.454.CMB.1.raw
  modified_base (377)..(377): a, c, t, g, unknown or other
  misc_feature (377)..(377): n is a, c, g, or t
  modified_base (570)..(570): a, c, t, g, unknown or other
  misc_feature (570)..(570): n is a, c, g, or t
tcagtgtactactccacgaccggtgctcgatttagtcgatagtgaagggaaagggggcaggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccggccagtcagaatattaataggtggttggcctggtatcagcaagaaaccaggggaaacgcccctaaggtccctgatatatgagacttctaactttagaagtgggtcccatcaaggttcagcgcagtggatctgggacagaattcactctacactancaccagcctgacctaactgtaactgtattttgaccttaaactttacttaacttagaccctaaacgtagttaactacgaactacctattacctaagttttacgtaacgttttcgggtagggtaacgggtaaccgtaaggggtacgggtaacggttaacgtaaacggaacgttggtacggtactacgactaaccncgtttactgttcctttaccg

SEQ ID NO: 195958 - DNA, 664 bp, Homo sapiens
  misc_feature: GYAE6OF02JAQH0.16.68.G02.1.454.CMB.1.raw
  modified_base (254)..(254): a, c, t, g, unknown or other
  misc_feature (254)..(254): n is a, c, g, or t
tcagtgtactactccacgaccggtgctcgatttagtcgatagtgaagggaaagggggcaggagtcagacccagtcaggacacagcatggacatgagggtccccgctcagctcctggggctcctgctgctctggctcccaggtgccagatgtgacatccagatgacccagtctccttccaccatgtctgcatctgtaggagacagatcacatcactgccggccagtcagaatatagtaggtggtgctggtatcancagaacagggaaacacccgtaaggtcctagataagtatgaagtacttactaactttaagaaacgtcggggtacccatacgtaaggttcaggcggcagtggtacgtcgtagggaacaacgtaaattcccaacgttcctaacgtaaccttaataccctaaccaacggtcctacggtaacctaaacccgtagtaacgttcgttacttttacggtaactaaacttttaacgtttactacgaaacccgtaataacggttaactaaccttatacccgttaatcctttaaagttaacggttaaacggttttacggggtaacggtaacgggtaacccggttaaagggtacgggtaacggttaaacgaaaacggtaaccgtaggttacggtagtacgacctacgactcgttcttaaccg

SEQ ID NO: 195959 - DNA, 795 bp, Homo sapiens
  misc_feature: GYAE6OF02HP23W.16.68.G02.1.454.CMB.1.raw
tcagtgtactactccacgaccggtgctcgatttagtcgatagtgaagggaaagggggcaggagtcagacccagtcaggacacagcatggacatgagggtccccgctcagctcctggggctcctgctgctctggctcccaggtgccagatgtgacatccagatcgacccagtcctcctccacctgtctgcatctgagagacgagagtacacatcgacttcggaccggacagtacaagaattaagttaagtagggttggtggccgttaggtaactacgaaacgaacgaaaaccgaacggggaaaccgtaccccgttaacggttaccgtaagtaacttaagttaacgttaggaaacgttaccttttacgttaaacggttttaaaggaaaacgggtttcgggtaccctaagttacgtaaagggttccgaacggccggtacgtacggtagggtacgtacggtaagggtaacgtaacgtaactttacctaaccgtccgttacccaactttaacgtcccaaacccgtaccgacccgtttaacggaaccccgtaaacgttacggttaaactttacgttacgttttacggtaaaccctttaaagtttaaaccttacgtacccgtaaacctaaacgtacgtaacttacgaacttacttacttaacgttatttaacgggtttaacgtaccgggtaggaaacggtaacggtaagggtacggttacggtaaaaccgtaaggacgttagggtacggttacgtacggtacctaacgtacgttaccgtttacgtttaccgtattaaccccg

SEQ ID NO: 195960 - DNA, 589 bp, Homo sapiens
  misc_feature: GYAE6OF02F9LL2.16.68.G02.1.454.CMB.1.raw
  modified_base (199)..(199): a, c, t, g, unknown or other
  misc_feature (199)..(199): n is a, c, g, or t
  modified_base (204)..(204): a, c, t, g, unknown or other
  misc_feature (204)..(204): n is a, c, g, or t
  modified_base (366)..(366): a, c, t, g, unknown or other
  misc_feature (366)..(366): n is a, c, g, or t
tcagtgtactactccacgaccggtgctcgatttagtcgatagtgaagggaaagggggcaggagtcagacccagtcaggacacagcatggacatgagggtccccgctcagctcctggggctcctgctgctctggctcccaggtgccagatgtgacatccagatgacccagtctccttccacctatctgcatctgtagganacagngtcaccatcacgttcgccgggcaggtcagaattatataggtggttcgctggtatcagcaagaaaccgaagggaacgacccctaaggtcctagatatagtgacgacttacttacttagtaaacggttgggtaccatacgaaggtcacgcggacagtggatcgngggacagtactcactctcacttacacacacgcctgaccacgtgattgtatttgaacttacttattactcgtaccaagtatacttcaatccgaattactagtttacgttaagtttcgggagggtaacgggacggttagggtacgggtaacggtaacggtaaacgtaacggttcggtaacgggtcttacggacctaccgtagttaccgttcggttactttacccg

SEQ ID NO: 195961 - DNA, 586 bp, Homo sapiens
  misc_feature: GYAE6OF02IQPRK.16.68.G02.1.454.CMB.1.raw
  modified_base (215)..(215): a, c, t, g, unknown or other
  misc_feature (215)..(215): n is a, c, g, or t
  modified_base (343)..(343): a, c, t, g, unknown or other
  misc_feature (343)..(343): n is a, c, g, or t
  modified_base (347)..(347): a, c, t, g, unknown or other
  misc_feature (347)..(347): n is a, c, g, or t
  modified_base (416)..(416): a, c, t, g, unknown or other
  misc_feature (416)..(416): n is a, c, g, or t
  modified_base (473)..(473): a, c, t, g, unknown or other
  misc_feature (473)..(473): n is a, c, g, or t
tcagtgtactactccacgaccggtgctcgatttagtcgatagtgaagggaaagggtctccgaaggcttcaccagtcctggacctcctgtgcaagaacatgaaacatctgtggttcttccttctcctggtggcagctcccagatgggtcctgtcccaggagcaactgcaggagtcgggcccaggactggtgaagccttcggagaccctgtcccctnacctgcactcgtctctggtcggctccgttcagcagttactactggagctggatccgtcagctccagggaaggcctggagtcggattgcctatatctctacaggtggagcagcaactacacccctcctnaagngtcgagtcgacatattagtagactacgtacaagacctaggttttcccagacgtctagagtctgtgccgntggcgacacggtcctttagtactgtcgcgcgacgggtccctagttcgattcgaactntagtactcccgacgtcccgtttagaccttccggtaggggtaccctaacggggtaacccttgggtaccctaacccggttcttacccggcaaccgggtcccttccggaaccccgg

SEQ ID NO: 195962 - DNA, 704 bp, Homo sapiens
  misc_feature: GYAE6OF02J11EL.16.68.G02.1.454.CMB.1.raw
  modified_base (302)..(302): a, c, t, g, unknown or other
  misc_feature (302)..(302): n is a, c, g, or t
  modified_base (310)..(310): a, c, t, g, unknown or other
  misc_feature (310)..(310): n is a, c, g, or t
tcagtgtactactccacgaccggtgctcgatttagtcgatagtgaagggaaagggggcgaggagtcagacccagtcaggacacagcatggacatgagggtccccgctcagctcctggggctccgtgctgctctggctcccaggtgccagatgtgacatccagatgacccagtctccttccaccctgtctgacatctggtagagacagagtccaccatctacgttcggccggccagtcagtaatattaagtaggtggttaggcctggtatcagacgaagaaacgaggaacgccctaaggtccngtatatangaagtcttactacttagaaagttcgggtacctaagtacgtaacggttcaacggtcggtactaggtacggtagtaccgtagggtaacctaagttaaacttccaaaccgtttccgtaccgtaaccttaactcctaaacccgacgtaccgttacgaaccgtaaaccgtcgtaagttacgttaagttttacaaccgttaaacttttaacgttacgtactaacctaaacgtactaaactgttaacctacgtaacttactaacgttttacgttaaacgttttcggggaacgggtaacggtaaccggtaaggggttacggtaacggtaaaccgtaaaccggttaacgttacggttacggtacgttcggaccctaacgttacgtacgttccgttaccttacg

SEQ ID NO: 195963 - DNA, 774 bp, Homo sapiens
  misc_feature: GYAE6OF02IDCMW.16.68.G02.1.454.CMB.1.raw
  modified_base (168)..(168): a, c, t, g, unknown or other
  misc_feature (168)..(168): n is a, c, g, or t
tcagtgtactactccacgaccggtgctcgatttagtcgatagtgaagggaaagggggcaggagtcagacccagtcaggacacagcatggacatgagggtccccgctcagctcctggggctcctgctgctctggctcccaggtgccagatgtgacatccagatgacccngtcctccttccaccctgtctgctatctggtaggagacagagtcaccatcacgttcgccggacagtcagtaattattaagtaggtggttggaccgttggtatcgagacgaaagaaaccgacgggaaacgaccccgtaaggtccctagtaataactagtagtacgtactttacttaacgtttaaggaaacggttcgggtaccctaagttaccgtaaaggttacgaacggtccggacgtacgggtaggtagtcggttagggaacgtacgtaaacgtttccgaccgtttaccgtacctaccgttaactaccgaaccgtaacgtcccgttaacgacccgtaaaccgttacggtaacgttacgtttaacgtttttacggtaaccttaaaaccgtttttacgttaaccgttaaccgtaaaccgtaaacttaacgttaacttaactacgtttactaacgttacgtttaactttttacggtttaaacggttttcggggtaacgggttaacggggtaaccgttacggggttaacgggtaacggtaacgtaaaccggttaggttcgggtacgtaccgttacgacctaaaccgtacgtttacgttcgttactttaccg

SEQ ID NO: 195964 - DNA, 638 bp, Homo sapiens
  misc_feature: GYAE6OF02F2LHU.16.68.G02.1.454.CMB.1.raw
tcagtgtactactccacgaccggtgctcgatttagtcgatagtgaagggaaagggggcaggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccggccagtcagaatattaataggtggttggcctggtatcagcagaaaccagggaaacgcccctaaggtcctgatatatgagacttctactttagaaagtgggtccatcaaggttcagcggcaggtggatcgtagggacaaggtaacttcgactcgtacaacttataccaccacgtcctagacctaaacccgttgacgttagtatttttacgaccttaaactttaatttactacgaccctaaacaaggttaacttcctaattacctacttacctaagttttacgttaagttttaccgggtagggtaacggggtacccgtaaaggggtttcgggaaacgggttacgaaaaccggttaacgttacgggtacggttaccggtacgaccgtaacccgtagttacgtttccgttcctttaaccg

SEQ ID NO: 195965 - DNA, 606 bp, Homo sapiens
  misc_feature: GYAE6OF02JE69B.16.68.G02.1.454.CMB.1.raw
  modified_base (398)..(398): a, c, t, g, unknown or other
  misc_feature (398)..(398): n is a, c, g, or t
tcagtgtactactccacgaccggtgctcgatttagtcgatagtgaagggaaagggggcaggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccggccagtcagaatattaatagtgtgctgtatcagcagaaaccagggaagccccgtaaggtcctagatactaatgagacttcgtaactttaagaaagtggggtacccagtacaaggttcacgcggaccagtggatcgtggggaacagaagtttacactctactactactctaaccacnctacgaccaacctgattagtactttgacttaaacgtttattactacgtacctaaactagttaataccaactctaacgtactaatttacgttaaacgttttacgggagggacggtaacccgtaaggggtcggtaacggttaccgaaaacggttaacgtaggttacggtacgtcggtaaccaacctacgtacctttacggtcctttaccg

SEQ ID NO: 195966 - DNA, 824 bp, Homo sapiens
  misc_feature: GYAE6OF02H8SRS.16.68.G02.1.454.CMB.1.raw
tcagtgtactactccacgaccggtgctcgatttagtcgatagtgaagggaaagggggcaggagtcagacccagtcaggacacagcatggacatgagggtccccgctcagctcctggggctcctgctgctctggctccccaggtgccagatgtgacatccagatcgacccagtctccttccaccctgtctgcatctgtaggagacagagtccacctatcctacgttacggcccggggaccctaggttacaaggtaaattaagttttaaagttacgggttggggtttacggaccgtttagggtacgtacaggacgaaacggaaaacccgaaacggggaaaaccggtacccccgtaaaagggttcccctaggtaaacgtttaacgtaatcggtaaacgttaaccttttacgttaaacgtttttaaagggtaaaacgggttccgggggttaccctaagttaacggtaaacgggtttacgacggtccgggaacggtaggtcgggtaatcggtagggaactaagtaacttactcgttacctactaacgtactacgacccgtacgtacccgttcgaaccttaaccgtgtaacgttcggtttaacgtttttacgtaacctttaaacgtttacctttaacgtaccgtaactaaacgttaattaccttactaacttctaaacgttaccttacggttttaagttttaaccggtagggttaacggggaacgggaaccggtttaaggggacggttaaacggaccggaaaaccgttacggtaggttaccggacgtacgtacccgaacgtttacgtcgttttaccgttaccgttaaccc

SEQ ID NO: 195967 - DNA, 735 bp, Homo sapiens
  misc_feature: GYAE6OF02HUEZ1.16.68.G02.1.454.CMB.1.raw
  modified_base (230)..(230): a, c, t, g, unknown or other
  misc_feature (230)..(230): n is a, c, g, or t
  modified_base (242)..(242): a, c, t, g, unknown or other
  misc_feature (242)..(242): n is a, c, g, or t
  modified_base (366)..(366): a, c, t, g, unknown or other
  misc_feature (366)..(366): n is a, c, g, or t
tcagtgtactactccacgaccggtgctcgatttagtcgatagtgaagggaaagggtctccgaaggcttcaccagtcctggacctcctgtgcaagaacatgaaacatctgtggttcttccttctcctggtggcagctcccagatgggtcctgtcccaggagcaactgcaggagtcgggcccaggactggtgaagccttcggagaccctgtcccctcacctgccactgtctntggtgctccttnagctagttactacgtggagctggtactccgttacacggctccccgaagggaacgggactgggagtggtacttgctagtactctacttagagtggagcagcaaacctaccaaccccctccctaanaacgtacgtccgtagtacaacgtattaagttacgtaacgacgtaacgtaaccgaaaacgtaacccgttacgttttccccgtaggtaacggtccgtttagggaacgggttcttcgggtacggtaaccgtcgttcggacccggtaacgtacccgggttaccctttttaagttaccgttcggtacggtccggtaaccgggtacccggttaccctacggtacggtacggttacaacgtttacgtaccggtactccccgtaacggtttcccttacggtaccttcccgggtcgggaacccgtacgggtaaacccccgtcgggtttaccaccccggttcttacccgtaccgaccccgtaccgtaccccgaaccggg

SEQ ID NO: 195968 - DNA, 886 bp, Homo sapiens
  misc_feature: GYAE6OF02JNPCU.16.68.G02.1.454.CMB.1.raw
  modified_base (745)..(745): a, c, t, g, unknown or other
  misc_feature (745)..(745): n is a, c, g, or t
tcagtgtactactccacgaccggtgctcgatttagtcgatagtgaagggaaagggtcgtccgaacggcttcaccagtcctggacctcctgtgcaagaacatgaaacatctgtggttcttcttctcctggtggcagctccagatgggtcctagtcccaggacgcaactgcaggagtcgggcccaggactggtgaacgccttcggagaaccctcgtccctcacctcgcctactggtctcgttcgggtacggccttccgttacgaacggccttacggtttaacctacgtcgggtagtccgttggggaacttcccggtctaacggtccgttacccggagggggtaaaacgggtccgtaggggtaggtcggtagttttaccgggaccttaacgttacgtcctttactaaccggtaggtcggacgtacacggaaccctaactacccctaacccccgttcgtacgtaaacgcggttaccggaacgttcggaacttaacggttttaacgtaaaccggtacgaaaccctttaacccgggtaaccaaaaacggttaaccccgttaacggttttttccccgaaaggggtaggttaccccgtttacgggttaaagggtttcccgtaagggttttaccccggaaccgttacgggtgggaacccccggtaaggttaaccccgggtttacccctttttaaagttccccgggtagggtcccgtaaacccggggtccgggtaacccccggtacccggtttanaacccggtaacgtacccgttaacgtagtccgtaaaccgtcccccgagtttccccgttacacccgtcgggaacccggggtcaaacgggtcccttaaccggtctaacccggttgtccccctagccgtacccgacctaaccggg

SEQ ID NO: 195969 - DNA, 858 bp, Homo sapiens
  misc_feature: GYAE6OF02JOPBC.16.68.G02.1.454.CMB.1.raw
  modified_base (271)..(271): a, c, t, g, unknown or other
  misc_feature (271)..(271): n is a, c, g, or t
tcagtgtactactccacgaccggtgctcgatttagtcgatagtgaagggaaagggtcgtccgaaggcttcaccagtcctggacctcctgtgcaagaacatgaaacatctgtggttcttccttctcctggtggcagctcccagatgggtcctgtcccaggagcaactgcaggtagtccgggcccaggactggtgaagccttcggacgaccctgtaccctcacctgcacttcgtctcgtgggtcggccttccgttacagctacgttactacgngacgcgtggacgtccgtctacgcctacccggaaggggaacgggtaccgtaggtagttaggactttcggacgttatacgttccgtaccgttacgtacggtacgggacgacgtacggaactaaacccgttacccaaaccccccttacccggtaacaaacgggttacggtaccggtaacggtaccgaactaaacttacgttaacggtaccggtaacctaacccggttaacccgaaacgttaacccggttaccgttttttaccccgaggtaccggtaccgttagggtaacggtttaccggttcgggtaccgtaccggtacggttacgggacccgggtaacccgtacccgggtttaaccttttaacgttacggttccggacggttacggccgggttaaacccgggccctttaagggtacgtaacgggttaccgtaacttaaacgttcccggaaacttccccggacggtttacccctttaggtaaccccgggttcggtacccggggggtaacttaacccgggggaccctttccgggtaccctaccccgggttctacccgttccggacccttccccggtaaccgtaaccccggg

SEQ ID NO: 195970 - DNA, 721 bp, Homo sapiens
  misc_feature: GYAE6OF02IR0YO.16.68.G02.1.454.CMB.1.raw
tcagtgtactactccacgaccggtgctcgatttagtcgatagtgaagggaaagggtctccgaaggcttcaccagtcctggacctcctgtgcaagaacatgaaacatctgtggttcttccttctcctggtggcagctcccagatgggtcctgtcccaggagcaactgcaggagtcgggcccaggactggtgaagccttcggagaccctgtccctcacctgcactgtctctggtgctctcagcagttacacgtggacgcgtggactccggtcagcctacccgagggaacgggacgtggaggtggattgccttatatccttacttaacgtaggtgggacgacgaagaccaactacccgaaccccctccgtaacaagacgtacgagttaccggactaattagttaacgtacgaactacgtaccaaacgtaaccttacgttttaccctaggacggtcctaggtacggttacgttcggttacgacccggtcgttcgggacccggtaacgtaccgggttaaccccttttagttacccgttgtaccggccgaccgggaccggtcccgttagtccgtaagttcggtacttacgttacgacgttacccggacggttccctttacggcccgttcccgggtacgggtacccggtaaccggggtaaccccgttcgggttacccgtacccggttccctacccgtacccgtaccgtaccccgtcccgaaacccggg

SEQ ID NO: 195971 - DNA, 737 bp, Homo sapiens
  misc_feature: GYAE6OF02JX0HJ.16.68.G02.1.454.CMB.1.raw
  modified_base (165)..(165): a, c, t, g, unknown or other
  misc_feature (165)..(165): n is a, c, g, or t
  modified_base (233)..(233): a, c, t, g, unknown or other
  misc_feature (233)..(233): n is a, c, g, or t
  modified_base (324)..(324): a, c, t, g, unknown or other
  misc_feature (324)..(324): n is a, c, g, or t
tcagtgtactactccacgaccggtgctcgatttagtcgatagtgaaggggaaagggggcgaggagtcagacccagtcaggacacagcatggacatgagggtccccgctcagctcctggggctcctgctgctctggctcccgaggtcgccagatgtgacatccagntgaccctgtcctccttcccacccttgtcctgctatcgtggtaggacgacagtagtccacctatccgtnttcggcccgggccaggttcaagtaattacgttaagtagggttggttggccgttaggtattacgacacgaacgaaaccgtaacggggaaacnccccttaaggtcctagactaagtatgtacgtacttacctaagtttacgaaagggttccggtaccgtgtaccgaggtttaccaaggtcgggtactaagggtcggtacttcgggtacgggtacaaggtaacttccgaaccttactactaacgttaactaccaccgtacgtaccttggaccaaccgtagtaacttgttaaccgttttgtaaccttacctttaacgtttaccgtataccctaaagtcgttaactagttacctatacttacttaagtttacgggtttaacggttacgggttaggggaccggtaacccggtaggggttacgggtacgtaacccggtaaaggtaccgttaaggtaccggcgttaaaccgtcctaaccggttaccgttactttaccggtacctttacccgg

SEQ ID NO: 195972 - DNA, 736 bp, Homo sapiens
  misc_feature: GYAE6OF02FWHWT.16.68.G02.1.454.CMB.1.raw
  modified_base (203)..(203): a, c, t, g, unknown or other
  misc_feature (203)..(203): n is a, c, g, or t
  modified_base (208)..(208): a, c, t, g, unknown or other
  misc_feature (208)..(208): n is a, c, g, or t
  modified_base (216)..(216): a, c, t, g, unknown or other
  misc_feature (216)..(216): n is a, c, g, or t
tcagtgtactactccacgaccggtgctcgatttagtcgatagtgaagggaaagggggcaggagtcagacccagtcaggacacagcatggacatgagggtccccgctcagctcctgggctcctgctgctctggctcccaggtgccagatgtgacagtccagatcgacccagttcctccttccaccctgtcctgcatctgtaganacagngtacaccntcacgtgccggcagtcaagaatattaagtaggtgttcggctggtatcgagacaagaaaccgacgggaaacgtaccccgtaaggtcctaggattatacgtagagtactttacgtaacgtttaagaaaggttcgggtaccctaagtacgtaaacggttccgaggcggtacgaaggttggaactttcggagggtaactaaggttaactttaccctaaccgttccgtaacctaaccgttaactacccaacccgtacgtaccccgtagtaacccgtaacccgttagactttaggttacttttacggaacctttaaacgtttaacgtttacttaccggtaccctaaaaccgtagttaacttaccaattacccgtattaccttaagttttaaccggtttaacgttttacgggtaacggggttaacgggtaacccgttaggggtacggtaaccgggttaaactaaacggttaccgttaggtaccgtaacgtcgtaaccgtacctaagttccgttagtaccctttaccg

SEQ ID NO: 195973 - DNA, 890 bp, Homo sapiens
  misc_feature: GYAE6OF02JOEL9.16.68.G02.1.454.CMB.1.raw
  modified_base (202)..(202): a, c, t, g, unknown or other
  misc_feature (202)..(202): n is a, c, g, or t
  modified_base (241)..(241): a, c, t, g, unknown or other
  misc_feature (241)..(241): n is a, c, g, or t
tcagtgtactactccacgaccggtgctcgatttagtcgatagtgaagggaaagggtctccgaaggcttcaccagtcctggacctcctgtgcaagaacatgaaacatctgtggttcttccttctcctggtggcagctcccagatgggtcctgtcccaggagcaactgcaggagtcgggcccaggactggtgaagccttcgganaccctggtccctcacctgcactgtctcgtggtgctcctnagcagtttacctacgtggactcgtaggtacgtccgtcacgtcctacccgagggggaacggtacgtgggtaggtacggactttcggaccctagttaacgttccgttactttaaacggacggttaggggaccgtcgaggaaccttaacgtaaaccccaaccccccgttcccgtacgtaaacgtacggtacccgtacggtaaccgtaacgtaaactttaagttaaaacggtacgtaaacgtaacccgtaaaccctaaacggaaaccgttttaccgtttttacccgagggtaacgggtaccgtttacggaaccgggtttcttacgggtaaccgtacccggtacgttaccggggaacccgggttccggaaacccggttttacccttttaagtttttaaccccggggcgtttccggggacccggtaacccgggggtaacccgggttaaccccccttaaggttacccgggggtaactaaccggtaaccgttacgttacccggtaaaccttacccccggggttaacgttcccccttttagggtaacccggttttcccgggacccgggggtaacctaacccgggggttaacccctcggggttaaccacccggtttacccctcgtaaccggtcccgtaccccgtaacccggtaacccgg

SEQ ID NO: 195974 - DNA, 693 bp, Homo sapiens
  misc_feature: GYAE6OF02G9K3T.16.68.G02.1.454.CMB.1.raw
  modified_base (199)..(199): a, c, t, g, unknown or other
  misc_feature (199)..(199): n is a, c, g, or t
  modified_base (251)..(251): a, c, t, g, unknown or other
  misc_feature (251)..(251): n is a, c, g, or t
tcagtgtactactccacgaccggtgctcgatttagtcgatagtgaagggaaagggggcaggagtcagacccagtcaggacacagcatggacatgagggtccccgctcagctcctgggctcctgctgctctggctcccaggtgccagatgtgacatccagatgacccagtctccttccaccctgtctgcatctgtagganacagagtcaccatcacgtgccggcagtcagaatatagtaggtggtgcctgtntcagacagaacaggaacacccgtaagtcctagatatagtgagtacttctaacttagaaaggtcgggtacctagtacgtaacggttcacggcgcgtaggtggatcgtagggactaagtaacttcgaaccttcgtacctacgttaacgtaccctaaccgacgtccctacgaccctaacccgtgtacttacgttaagttttcgaactttaacctttaattaacttcgtaacccaagtaccgttaataccgtacttactaaccgttcttaacggttttaagtttaacgggttttacgggaaggggttaacccgggtaacggttaacggggttaccgggtaacgggggtttaaacccaaaacgggttaaccgttagggttacccgggttaccgtacggtaccccggtaacttaccggtttaccgttacggtttacccgttaacccgg

SEQ ID NO: 195975 - DNA, 627 bp, Homo sapiens
  misc_feature: GYAE6OF02IMO6I.16.68.G02.1.454.CMB.1.raw
  modified_base (277)..(277): a, c, t, g, unknown or other
  misc_feature (277)..(277): n is a, c, g, or t
  modified_base (406)..(406): a, c, t, g, unknown or other
  misc_feature (406)..(406): n is a, c, g, or t
tcagtgtactactccacgaccggtgctcgatttagtcgatagtgaagggaaagggtctccgaaggcttcaccagtcctggacctcctgtgcaagaacatgaaacatctgtggttcttccttctcctggtggcagctcccagatgggtcctgtcccaggagcaactgcaggagtcgggcccaggactgggtgaagccttcggagacccctgtcccctcacctgcactgtctctggtggccttccttcagctaacgttactactggagctggatccgtnagcctcccgaagggaggactggagtggattgctatatctctacagtggagcagcaactacaacccctcctacaagacgtcgagtcgactatagttagtaagacacgtccaaagaacctagttttacccngacgctagaggttctgtcgaccgcgtaggccggaactacccggttaccttttaacttacgtaggtcgccgggacggtaccgggacccttagtacgagtacgacttaacgtcgtacctcccgaccgttcccttcgaccgttccggtacggggtacccgaacggggtaacccgttcggtaccgtcccgttcctccctacgtacccgtccctaccgaacccggg

SEQ ID NO: 195976 - DNA, 713 bp, Homo sapiens
  misc_feature: GYAE6OF02HCKII.16.68.G02.1.454.CMB.1.raw
tcagtgtactactccacgaccggtgctcgatttagtcgatagtgaagggaaagggtctccgaaggcttcaccagtcctggacctcctgtgcaagaacatgaaacatctgtggttcttccttctcctggtggcagctcccagatgggtcctgtcccaggagcaactgcaggagtcgggcccaggactggtgaagccttcggagaccctgtccctcacctgcactgtctctggtgcttcctcagcagttacacgtggagccgtaggacttccgtcacgtccgtacccgaggggaacgggcgtagggaggtaggtagttgaccgttaattacttccttacgttacgaggtcgggacacgagaccgtaacctaccctaacccccgtcctacgaacgtacggtaccgacgtccgaacgtaataagttaacgacgacctaccgtaaccgaaacgtaaccgttacgttttacccgaggacgtcgtaggacggttctaggtaccgaccgtcgttcgggaccggtacgtaccggttaccctttagtaccgtgtacgtcgaccgggtccggtacccgtagtcggacgtacgtaacgtagtcgacgtcccgtacggttccctttaggacccgttccgggtaccgggacccgtaaccgggtacccgtcggttacccgtaccgttcccgttacccgacgtacccgttaccctacccggaaccccgg

SEQ ID NO: 195977 - DNA, 953 bp, Homo sapiens
  misc_feature: GYAE6OF02FXQDV.16.68.G02.1.454.CMB.1.raw
  modified_base (270)..(270): a, c, t, g, unknown or other
  misc_feature (270)..(270): n is a, c, g, or t
tcagtgtactactccacgaccggtgctcgatttagtcgatagtgaagggaaagggtctccgaaggcttcaccagtcctggacctcctgtgcaagaacatgaaacatctgtggttcttccttctcctggtggcagctcccagatgggtcctgtcccaggagcaactgcaggtagtcgggcccaggactggtgaagccttcgggagatcctgtccctcacctgctactgtctcgtggtggcctccttcagtctaagttacctactcgggacncgtaggtactcccgtcgacgccttacccggaaggggtaaacgggcgttaggggaacggtgggtaacgtttccggtaacccgttaattaacgttcccgtttacgtttaaaccgtagggttacggggtaacgaccgtaacggaacctaaacccgttaacccctaaaccccccgttccccttaacgtaaacggtacgtacccggtaaggtaccgtaactaacggttaattaacggtaaacgtaacccgaaccggtaaccctaaaaacgggttaaaccccgtttacgggtttttaccccctaacggggtaaccgggtaccggtttaacgggaacgggtttccggttacggttaccgggtaacccggggtctaacgggacccggggtaaccttacccgggtttaccccgttttacgtttacccggttagggttccggacccgggttaccgggtaaccccgggtaccccgttaacgggtacccgggtaacgttaccggtaaacgttaaccgttaccgtaaaccgggttacccgttacccggtttaccccgtttacgggtaaccccgttccggggtaccccggggttaaacccgggtaaacccgggtttaccccgggtacggtttaacccgacccggttttaccccggtacccttaacccgggaccgttacccccccgttaaaccccggg

SEQ ID NO: 195978 - DNA, 911 bp, Homo sapiens
  misc_feature: GYAE6OF02GJQHG.16.68.G02.1.454.CMB.1.raw
tcagtgtactactccacgaccggtgctcgatttagtcgatagtgaagggaaagggggcaggagtcagacccagtcaggacacagcatggacatgagggtccccgctcagctccgtggggctcctgctgctctggctcccaggtcgccagatgtgacatccagtatcgacccagtcctccttaccaccttgtctgactatcgtgaggagacagacgtccaccagtctacgttcggccggcagtacaagtaattataagtggttggtcgcgtagtatcgagtacgaacgaaaccggagggaaaccctcccgtaacggtacctggtaacttagtacgtacggaacgttacttttaaccgttaaacgtttaacgggtaaacgggtttcccggggtaacccttaagttaaccggttaagggtttaccgaaccgggtaaccggttacggtaacgggttacggtaacgttttacgggaaccgggggtaacttaaaacggttacgtttaacccgtaaccgtttaaccttacccgtaaacttaaccttaaccccggaaaccgttaccggttccgttaaccggttaacctaaaccgggtttgtaaactttacggtttaacgttttaaaccgtaccggttttaaaaccgtttccttttaacccgggtaccaaacccgtttaaaccggttaactttaaccgaacccgtttaactaaacccgtttaacgttttaaccgttaacgttttttaacgggtttaccgggtttaaacgggtaaccgggggtaacccggtttaacccggaggggtttaaaggtaccccgggttaaaaccggttaaaccgggttacggttacgggtttaaccgcccggttaaaccgtcccgttaaccttaacgggtcccggttttacgtacccgtttaccg

SEQ ID NO: 195979 - DNA, 629 bp, Homo sapiens
  misc_feature: GYAE6OF02GDHEM.16.68.G02.1.454.CMB.1.raw
  modified_base (105)..(105): a, c, t, g, unknown or other
  misc_feature (105)..(105): n is a, c, g, or t
  modified_base (130)..(130): a, c, t, g, unknown or other
  misc_feature (130)..(130): n is a, c, g, or t
  modified_base (290)..(290): a, c, t, g, unknown or other
  misc_feature (290)..(290): n is a, c, g, or t
  modified_base (341)..(341): a, c, t, g, unknown or other
  misc_feature (341)..(341): n is a, c, g, or t
tcagtgtactactccacgaccggtgctcgatttagtcgatagtgaagggaaagggggcaggagtcagacccagtcaggacacagcatggacatgagggtccccgntcagctcctggggctcctgctgctntggctcccaggtgccagatgtgacatccagatgacccagtctccttccacctgtctgcatctgtaggagacagacgtcaccatctacgtcgccggcagtcagaatattaagtaggtggttgctgtatgagcagaacgaggaacacctagtctagatatangatacttagtattaagaaggtcgggtacctagtacaaggttcacgcggtanggtagtatcggtaggactaggtaacttcgactaccgtactaacgtctaccaacacgtaccgtacgaacctaaccgtgtagttagtacgttttacgaactttaacgtttaacgttacttacgaacccgtaaacttagtttactaccttaagtaccttaacttacgtaatttacgggttaacgtttcgggtaacgggtacgggtaacggtaggtacggtacggttaactaaacggtacgtaggtaccggtattacggaacctaccgttaacgtcgttacgtccttaaccg

SEQ ID NO: 195980 - DNA, 818 bp, Homo sapiens
  misc_feature: GYAE6OF02I9EU9.16.68.G02.1.454.CMB.1.raw
tcagtgtactactccacgaccggtgctcgatttagtcgatagtgaagggaaagggtctccgaaggcttcaccagtcctggacctcctgtgcaagaacatgaaacatctgtggttcttccttctcctggtggcagcctcccagatgggtcctcgtacccgaggagcaactcgacaggtacggtccgggcccaaggacctagggtagtaacgtccctttacgggacgtacccctgtcccctccgacctgacctacgttcgtcctcgtcggtgtccttaccttcgagtaccgtacgttaacctacggtggacgtcgtggtaaccgttcccgtaccgaccgtcccgtacccgggaagggggtaacgggttaccggtgggtaacgggttggtaacgttccgtacgtagttaccttaccggttaccttaacggtacgggtacgggacgtacgtacgaaccctaaccgtaacccctaacccccgtcctaaccgtaacgacggtacggtactacggtaactagttaattacgtaccgtaaccgtaacgtaaccgaaacgtaaccgtttaccgtttaccgtacgggacgtacggtacggtacgttaccggtcgtaccgtaccgtcggacggtaccgtaccgtaccgttccgttacgttccgtcgtccggtaccggaccggtccggtacccgtacgtacggtacgtaccgtacgtctaccgaccgttccgtaccggttcctacggtaccgtccggtcgggtaccgtaccgggtacctccggtacccgtcccgtaccgtccgttacacccgtcccgtaaccgtacccgg

SEQ ID NO: 195981 - DNA, 831 bp, Homo sapiens
  misc_feature: GYAE6OF02HN558.16.68.G02.1.454.CMB.1.raw
tcagtgtactactccacgaccggtgctcgatttagtcgatagtgaagggaaagggggcaggagtcagacccagtcaggacacagcatggacatgagggtccccgctcagctccgtggggcctcctgctgctctggctcccgaggtcgccagagtgtagacatccagatcgaccctagtcctcccttaccaccctgtctcgctatcgtaggtaggacacgagtacgtccacctacgtccgtacgttcggccccgggtcctaagtacgaagtaacttaatttaagtacgggttggtttcggtccgttaggtaactaccgtaacggacgaaaccggaaaaccggaacggggtaaaccgaccccggttaacggtcccttaggaattacgtaagttcggtaacgtacctttacgtttaaccgtttaaagggtaaaacggttccgggtaccctaagttaccggtaacgttcgtaccggtgggtaccgaggttacggtatacgggtacggaactaagtacttaccacttccgacttactacgttaccctaacgacctaccgtcgaaccgtaccgttagtacttacggttatttaccgtaacttaacgtttactaaccgttacgaccgtaactaacgttactaccttacgttacctagttaccgttaagttttaacggtttaacggtttacgggtaaacgggtaaccgggtaacggggtaaccgggttacggggtaacggttaaaacccgtaacgggtaaccggtttaccgggtacgggtttaccgtacccgtaccggttacccgtttaaccgtcccgttttacggtccctttacccgg

SEQ ID NO: 195982 - DNA, 971 bp, Homo sapiens
  misc_feature: GYAE6OF02IJLM6.16.68.G02.1.454.CMB.1.raw
  modified_base (106)..(106): a, c, t, g, unknown or other
  misc_feature (106)..(106): n is a, c, g, or t
tcagtgtactactccacgaccggtgctcgatttagtcgatagtgaaggggaaagggggcaggagtcagacccagtcaggacacagcatggacatgagggtccccgntcagctccgtgggctcctgctgctcgtggcctcccaggtcgccagatcgtgtacatccgaaggtatcgaccctagttcctacccgttcccaccgtgtcgtagactagttctggtaaggacacgaaggtactccaaccgtatccgtaacgttcgggcccggactacgtaccgtaagtaacttaagtttaaaggtacgggtttcggtacggtaccgttaagggttacacgaacgtaacgaaacggtaaaccggtaaaccgggtaaaaccgccccgtttaaaggtcccctttaagggacttaaagttaacgggtacgtaaaccgttacgtttaacgtttaaacggtttaaaacgggacccggtttacccggggtaaccttaacggtaaccggtttaaaggggtacccaaggggttcccggaaacggttttacggggtaacgtaacccggtttaggggttaacccggaaaattaaacgggttaacccgtttaccctaccgggtttaacccaacctttaacgtaacccgttaaccgtaacccgtaacggttaccccgttaagaaacccgtttacgggttaagtaaccggtttaactttacccggttttaaccggtaaaactttaaacccgttttaacggttacccttaaaaggaaccctttaaaccgggttaacgttaaactttacccggaaaacgttttctaaaaccgtttacgggttttaaacgtttaaacgggttttaaccggtttaaacgggggtaacgtaaccggggttaacgaacggggtttacgggaaacggttaaacgtaaacggcggttaacgtcggtaacctcgaacccgttagttacgttcggttctaacctttaccgg

SEQ ID NO: 195983 - DNA, 764 bp, Homo sapiens
  misc_feature: GYAE6OF02FY5DA.16.68.G02.1.454.CMB.1.raw
tcagtgtactactccacgaccggtgctcgatttagtcgatagtgaagggaaagggggcaggagtcagacccagtcaggacacagcatggacatgagggtccccgctcagctcctggggctcctgctgctcgtggctcccagggtcgccagtatgtgactatccagactcgaccctagtcctccttccaccctgtctgcatctgaggacacagagtacaccatctaccgttggccgggccagttacgaagtaactaattaggtacggtggttaccggtcgtaggttatactacgacgaacggaaaccgtaaggggaaaccggtaccccttaacgggtcctaggtaactagttagacggtactaccgttttacgttaacgttttaacgtaaaaggggttcggggtacccctaagttaaccgttaagggtttccaacggtacgggactagggtacggggtaagttcggacgggtaacgaagggtttaacttaccgaccttcccgtattaacgttaacctccgaacccgtacaccccgttacgacccgtaaccgttacgtaacgttggtttaacgtttcttaaccgtttaaaccgttatttacccgtacgtaaccgaacctagtacttacgtaacttccgtacttatttacgttaggtttaacgttacggtaaggggtacgggtaacgtaaggggtcggaacggttaacggaaacggtacgttacggattcggccgtacgtaccgtaactcggttaccttagttcccg

SEQ ID NO: 195984 - DNA, 1089 bp, Homo sapiens
  misc_feature: GYAE6OF02IZQDN.16.68.G02.1.454.CMB.1.raw
tcagtgtactactccacgaccggtgctcgatttagtcgatagtgaagggaaagggtctccgaaggcttcaccagtcctggacctcctgtgcaagaacatgaaacatctgtggttctttccttctcctggtggcagctcccagatgggtcctgtcccaggagcaactgcaggagtcgggcccaggactgggtgaagccttcggagaccctgtccctcacctgcactgtctcgtggtgctccttcagctagttactacgtggacgcttggacgtccgtcgacgtcctaccccgaaggggaacgggtacgtgggaacggttcgggtaagtttcgggtaccccgttaagtttaacttcccgttaccgttttaaccggtaacggggtttacgggggacggttacccgaaacgggtaaccgtaaaaccccgtttaacccccgtaaaacccccccctttccccggttaaccgtaaaaacgggttacccggtttaaccgggtaacgggttaccccggtaaccgtttaaacgttttaacggtttaaacggtaaaccggttaaaccgttaaacccggttaacccgtaaaaaccggttaaaccccgtttaacccggtttttttaccccgtacgggtaaccgggttaccgttaacgggtaacggtttcggttacgggttaccggtacccggtaccgggttacggtaacccggggtaacccggtaaccccgggtttacccgttttttaaccgtttaacccggttcgggtttaaccggtccggaaccccgggggttaacccgggttaacccccggtttaaagggttccccgggttaaacgggtttcccggttaaaaccgtttcgggttaacccgggtttaaaccccgttaccccggggtttaaacccgggtttaccccccggtttttacgggtaaccccgggtttaccccgggggtttcccggggggtaacccccgggttaaaccgggggttaaacccccggtttacccggggtaaccccggtttaaccccccggtttccggtttacccccttacccgggtacccccggttaccccccgtttaccccggaaaaccccccgggg

SEQ ID NO: 195985 - DNA, 822 bp, Homo sapiens
  misc_feature: GYAE6OF02I5AIV.16.68.G02.1.454.CMB.1.raw
  modified_base (104)..(104): a, c, t, g, unknown or other
  misc_feature (104)..(104): n is a, c, g, or t
  modified_base (129)..(129): a, c, t, g, unknown or other
  misc_feature (129)..(129): n is a, c, g, or t
  modified_base (202)..(202): a, c, t, g, unknown or other
  misc_feature (202)..(202): n is a, c, g, or t
tcagtgtactactccacgaccggtgctcgatttagtcgatagtgaagggaaaggggcaggagtcagacccagtcaggacacagcatggacatgagggtccccgntcagctcctggggctcctgctgctntcggctcccaggtgccagatgtgacatccagatgacccagtctccttccaccctgtctgctaatctgtagganacagacgtacaccagtccagttcgccgggccaagtcaagtaatattaatacggtggtacgccgtggtatcgagacaacgaaaccgaagggaaacgacccgttaaagggtaccctaggaacttaatacgttaggaacgtacgttaccttaacgtttaaaggaaacggttcggggtaccctaagtacgaaacgggtttacacggacggtacgtaacggtacgggacgtttacggttacgggaaactaacggtaaaccgttacgtaaccgttaccggaacttaaaccttacggtaacccttaaacccggaaaccgttaccccggtaagtacccgttaaaacccgttacggtaaaacgtttcggttaaacgtttttacggtaaaccttaaacgttttaacgttaaaccggttaaccggtaaccctaaaacggtacggttaaacgtttaccgaaacctttacgaaccgtttaataccggttttaaagtttaaacgggtttcgggaaacggttacgggttaaacccgtaagggttacgggtaacggttaaacggaaaaccgtaaggttaacggtaccggtacgtaacggtacctaaccgttacgttaccttcggttaaccttaccg

SEQ ID NO: 195986 - DNA, 762 bp, Homo sapiens
  misc_feature: GYAE6OF02FK7L0.16.68.G02.1.454.CMB.1.raw
tcagtgtactactccacgaccggtgctcgatttagtcgatagtgaaggggaaaggggggcagggagtcagacccagtcaggacacagcatcggacatgagggtccccgctcagctctggggctcctgctgctctggctcccaggtgccagatgtgacactccagatcgacccagttctcccttcccacccgtgtctcgcattcgtagtagggagaccagagtccaccactacctaccgtcggcccgggcagtaccagaattattaacgttagggtggttcggacgttggtactcgaggacaacggaaaccggaacgggaaccggtacccgtaacggttcagtaatatacgtaggtaacgtactttaccgttaacgtttaaggaaaccgggtttcggggtacccctacggttaacgtaacgggtttacgacggtccggtacgaggttacgggaccggtcggtacggggtaacaaggttaaccttaccaaccgttcgtaccctaactaaccgtaccctaaccgtacccgcgttaacccgtaacccggtaaccgtaggtactttacggtactttaaacgtacgttaaacctttactttacaccgtaacctactagttacacctactcgtaacttccgttaagtttacgttaacggtttacgggacgggtaacgggtaacggttagggacgggttaacggaaaccggaacggttacgtcgtacgggttcctacggacgtacccgaggtttcccttgtacccgtacc

SEQ ID NO: 195987 - DNA, 849 bp, Homo sapiens
  misc_feature: GYAE6OF02F5INV.16.68.G02.1.454.CMB.1.raw
  modified_base (216)..(216): a, c, t, g, unknown or other
  misc_feature (216)..(216): n is a, c, g, or t
tcagtgtactactccacgaccggtgctcgatttagtcgatagtgaagggaaagggggcaggagtcagacccagtcaggacacagcatggacatagacgggtccccgctcagctcctggggctcctgctgctcgtggctcccaggtgaccagatggtggacatccagagtgaccctagtctaccttccacccgtgtctgcctatcgtagtaaggganaccgaagtacgtaccaaccgtatacctacggttcggaccggggacctaaggtaccaagtaaacttaagttaaggttacggtacggttacggtaccgttaggtaattaccgaaggaccgtaaacggtaaaacccgtagggggaaaacctaccccggttaaacggtacccgtaggtaatagtaacgttacggaacgtaactttaccgtaacttttaaggaaagggttccgggtaaccctagtaacgtaacggttacgaacggtacggtacgtaaggtcgggtaacttacgggtacgggtaaacctaagggtaaccttaccggtacctttacggtacctaacttaacctaccgtaaacccgtacgtacccgtacggtaacccttaaccgtacgtaagttacgttaacggttttacgtaaccgttaaaccgtttaactttaaccggaccgtaaaccctaaagaacggttaaccttaccaaccggttataaccttaccgttaactttaacggtttaacggttacgggttaacgggaacggggttaaaccctagggggttaacggtaacggttaacaaacggttaaaccgtgggtacgtacgtacgccgtaaccgttattcccggtattcgtttaaccc

SEQ ID NO: 195988 - DNA, 753 bp, Homo sapiens
  misc_feature: GYAE6OF02IADS2.16.68.G02.1.454.CMB.1.raw
  modified_base (106)..(106): a, c, t, g, unknown or other
  misc_feature (106)..(106): n is a, c, g, or t
  modified_base (198)..(198): a, c, t, g, unknown or other
  misc_feature (198)..(198): n is a, c, g, or t
  modified_base (206)..(206): a, c, t, g, unknown or other
  misc_feature (206)..(206): n is a, c, g, or t
  modified_base (209)..(209): a, c, t, g, unknown or other
  misc_feature (209)..(209): n is a, c, g, or t
  modified_base (583)..(583): a, c, t, g, unknown or other
  misc_feature (583)..(583): n is a, c, g, or t
tcagtgtactactccacgaccggtgctcgatttagtcgatagtgaagggaaagggggcagggagtcagacccagtcaggacacagcatggacatgagggtccccgntcagctcctggggctctgctgctctggctcccaggtgccagatgtgacatccagactgacccagtcctaccttccacccttgtctgcattcnggtagganacngagtccaacgatcacgttccggccgggctagtccgagtaacttagttaagtagggttggttcggtaccgttgggtaacttccgaagtccgaacggaaaacccgtaggggaaaaccgtcccccgtaaaggttcccctaggtacttaactacgtacgggagttacctttacgttaacggtttaaggaaaacgggtcgggttaccctaaggtccgttaaagggttccaacggccgggacaagggttggtacgtttacgtacggggaactaaggttaacttccgtaaccttctaaccgtaacttaccgtaccaacccgcggtccctaggaccctaaacggttgaacgttcgtttatttacggtacttaacctttttanacccgttcaacccgtaaagtacgttaattaccagtcctaaacttcgttagtttaacggtttacgtttcgggtaaaagggacccggagttaaacggggttcggaaagtaaccgtaaacgggtgttacgggttacgacgttccgactaaccgtcttacggtaccttatcccg

SEQ ID NO: 195989 - DNA, 230 bp, Homo sapiens
  misc_feature: GYAE6OF01BWTXP.24.71.G05.1.454.CMB.1.raw
  modified_base (229)..(230): a, c, t, g, unknown or other
  misc_feature (229)..(230): n is a, c, g, or t
tcagactactatgtcacgaccggtgctcgatttagtgtcgtcgcaagagagaggggtcaggctggaagctgaggatgtcgcagtttattactgcacacaatctacacaatttccgtacactttggccagggaccaagctggagatcaaacgaactgtggctgcaccatctgtcttcatcttcccgccatctgaacatagtagtctgagcgggctggcaaggcgcatagnn

SEQ ID NO: 195990 - DNA, 239 bp, Homo sapiens
  misc_feature: GYAE6OF01AXZC7.24.71.G05.1.454.CMB.1.raw
  modified_base (231)..(239): a, c, t, g, unknown or other
  misc_feature (231)..(239): n is a, c, g, or t
tcagactactatgtcacgaccggtgctcgatttagtgtcgtcgcaagagagaggggtcaggctggaagctgaggatgtcgcagtttattactgcacacaatctacacaatttccgtacacttttggccaggggaccaagctggagatcaaacgaactgtggctgcaccatctgtcttcatcttcccgccatctgaacatagtagtctgagcgggctggcaaggcgcatagnnnnnnnnn

SEQ ID NO: 195991 - DNA, 234 bp, Homo sapiens
  misc_feature: GYAE6OF01A4QB2.24.71.G05.1.454.CMB.1.raw
  modified_base (232)..(234): a, c, t, g, unknown or other
  misc_feature (232)..(234): n is a, c, g, or t
tcagactactatgtcacgaccggtgctcgatttagtgtcgtcgcaagagagagggggtcaggctggaagctgaggatgtcgcagtttattactgcacacaatctacacaatttccgtacacttttggccaggggaccaagctggagatcaaacgaactgtggctgcaccatctgtcttcatcttcccgccatctgaacatagtagtctgagcgggctggcaaggcgcatagnnn

SEQ ID NO: 195992 - DNA, 235 bp, Homo sapiens
  misc_feature: GYAE6OF01DSLLT.24.71.G05.1.454.CMB.1.raw
  modified_base (231)..(235): a, c, t, g, unknown or other
  misc_feature (231)..(235): n is a, c, g, or t
tcagactactatgtcacgaccggtgctcgatttagtgtcgtcgcaagagagagggggtcaggctggaagctgaggatgtcgcagtttattactgcacacaatctacacaatttccgtacactttggccaggggaccaagctggagatcaaacgaactgtggctgcaccatctgtcttcatcttcccgccatctgaacatagtagtctgagcgggctggcaaggcgcatagnnnnn

SEQ ID NO: 195993 - DNA, 231 bp, Homo sapiens
  misc_feature: GYAE6OF01CZGZ1.24.71.G05.1.454.CMB.1.raw
  modified_base (231)..(231): a, c, t, g, unknown or other
  misc_feature (231)..(231): n is a, c, g, or t
tcagactactatgtcacgaccggtgctcgatttagtgtcgtcgcaagagagaggggtcaggctggaagctgaggatgtcgcagtttattactgcacacaatctacacaatttccgtacacttttggccaggggaccaagctggagatcaaacgaactgtggctgcaccatctgtcttcatcttcccgccatttgaacatagtagtctgagcgggctggcaaggcgcatagn

SEQ ID NO: 195994 - DNA, 237 bp, Homo sapiens
  misc_feature: GYAE6OF01A3TEB.24.71.G05.1.454.CMB.1.raw
  modified_base (232)..(237): a, c, t, g, unknown or other
  misc_feature (232)..(237): n is a, c, g, or t
tcagactactatgtcacgaccggtgctcgatttagtgtcgtcgcaagagagagggggtcaggctggaagctgaggatgtcgcagtttattactgcacacaatctacacaatttccgtacacttttggccaggggaccaagctggagatcaaacgaactgtggctgcaccatctgtcttcatcttcccgccatctgaacatagtagtctgagcgggctggcaaggcgcatagnnnnnn

SEQ ID NO: 195995 - DNA, 235 bp, Homo sapiens
  misc_feature: GYAE6OF01E0Y9H.24.71.G05.1.454.CMB.1.raw
  modified_base (232)..(235): a, c, t, g, unknown or other
  misc_feature (232)..(235): n is a, c, g, or t
tcagactactatgtcacgaccggtgctcgatttagtgtcgtcgcaagagagagggggtcaggctggaagctgaggatgtcgcagtttattactgcacacaatctacacaatttccgtacacttttggccaggggaccaagctggagatcaaacgaactgtggctgcaccatctgtcttcatcttcccgccatctgaacatagtagtctgagcgggctggcaaggcgcatagnnnn

SEQ ID NO: 195996 - DNA, 234 bp, Homo sapiens
  misc_feature: GYAE6OF01A0I24.24.71.G05.1.454.CMB.1.raw
  modified_base (231)..(234): a, c, t, g, unknown or other
  misc_feature (231)..(234): n is a, c, g, or t
tcagactactatgtcacgaccggtgctcgatttagtgtcgtcgcaagagagagggggtcaggctggaagctgaggatgtcgcagtttattactgcacacaatctacacaatttccgtacacttttggccagggaccaagctggagatcaaacgaactgtggctgcaccatctgtcttcatcttcccgccatctgaacatagtagtctgagcgggctggcaaggcgcatagnnnn

SEQ ID NO: 195997 - DNA, 233 bp, Homo sapiens
  misc_feature: GYAE6OF01EU9GH.24.71.G05.1.454.CMB.1.raw
  modified_base (230)..(233): a, c, t, g, unknown or other
  misc_feature (230)..(233): n is a, c, g, or t
tcagactactatgtcacgaccggtgctcgatttagtgtcgtcgcaagagagagggggtcaggctggaagctgaggatgtcgcagtttattactgcacacaatctacacaatttccgtacacttttggccaggggaccaagctggagatcaaacgaactgtggctgcaccatctgtctcatcttccgccatctgaacatagtagtctgagcgggctggcaaggcgcatagnnnn

SEQ ID NO: 195998 - DNA, 236 bp, Homo sapiens
  misc_feature: GYAE6OF01AY99D.24.71.G05.1.454.CMB.1.raw
  modified_base (231)..(236): a, c, t, g, unknown or other
  misc_feature (231)..(236): n is a, c, g, or t
tcagactactatgtcacgaccggtgctcgatttagtgtcgtcgcaagagagagggggtcaggctggaagctgaggatgtcgcagtttattactgcacacaatctacacaatttccgtacacttttggccagggaccaagctggagatcaaacgaactgtggctgcaccatctgtcttcatcttcccgccatctgaacatagtagtctgagcgggctggcaaggcgcatagnnnnnn

SEQ ID NO: 195999 - DNA, 248 bp, Homo sapiens
  misc_feature: GYAE6OF01AJY30.24.71.G05.1.454.CMB.1.raw
  modified_base (200)..(200): a, c, t, g, unknown or other
  misc_feature (200)..(200): n is a, c, g, or t
  modified_base (237)..(248): a, c, t, g, unknown or other
  misc_feature (237)..(248): n is a, c, g, or t
tcagactactatgtcacgaccggtgctcgatttagtgtcgtcgcaagagagagggggtcaggctggaagctgaggatgtcgcagtttattactgcacacaatctacacaatttccgtacacttttggccaggggaccaagctggagatcaaacgaactgtggctgcaccatctgtcttcatccttcccgccatctgaacntagtagtctgagcgggctggaccaaggtcgacatagnnnnnnnnnnnn

SEQ ID NO: 196000 - DNA, 234 bp, Homo sapiens
  misc_feature: GYAE6OF02G2WLA.24.71.G05.1.454.CMB.1.raw
  modified_base (231)..(234): a, c, t, g, unknown or other
  misc_feature (231)..(234): n is a, c, g, or t
tcagactactatgtcacgaccggtgctcgatttagtgtcgtcgcaagagagaggggtcaggctggaagctgaggatgtcgcagtttattactgcacacaatctacacaatttccgtacacttttggccaggggaccaagctggagatcaaacgaactgtggctgcaccatctgtcttcatcttcccgccatctgaacatagtagtctgagcgggctggcaaggcgcatagnnnn

SEQ ID NO: 196001 - DNA, 235 bp, Homo sapiens
  misc_feature: GYAE6OF02IO6UP.24.71.G05.1.454.CMB.1.raw
  modified_base (231)..(235): a, c, t, g, unknown or other
  misc_feature (231)..(235): n is a, c, g, or t
tcagactactatgtcacgaccggtgctcgatttagtgtcgtcgcaagagagaggggtcaggctggaagctgaggatgtcgcagtttattactgcacacaatctacacaatttccgtacacttttggccaggggaccaagctggagatcaaacgaactgtggctgcaccatctgtcttcatcttcccgccatctgaacatagtagtctgagcgggctggcaaggcgcatagnnnnn

SEQ ID NO: 196002 - DNA, 233 bp, Homo sapiens
  misc_feature: GYAE6OF02JBUCJ.24.71.G05.1.454.CMB.1.raw
  modified_base (231)..(233): a, c, t, g, unknown or other
  misc_feature (231)..(233): n is a, c, g, or t
tcagactactatgtcacgaccggtgctcgatttagtgtcgtcgcaagagagaggggtcaggctggaagctgaggatgtcgcagtttattactgcacacaatctacacaatttccgtacacttttggccaggggaccaagctggagatcaaacgaactgtggctgcaccatctgtcttcatcttcccgccatctgaacatagtagtctgagcgggctggcaaggcgcatagnnn

SEQ ID NO: 196003 - DNA, 245 bp, Homo sapiens
  misc_feature: GYAE6OF02JSLBB.24.71.G05.1.454.CMB.1.raw
  modified_base (230)..(245): a, c, t, g, unknown or other
  misc_feature (230)..(245): n is a, c, g, or t
tcagactactatgtcacgaccggtgctcgatttagtgtcgtcgcaagagagaggggtcaggctggaagctgaggatgtcgcagtttattactgcacacaatctacacaatttccgtacacttttggccaggggaccaagctggagatcaaacgaactgtggctgcaccatctgtcttcatcttcccgcatctgaacatagtagtctgagcgggctggcaaggcgcatagnnnnnnnnnnnnnnnn

SEQ ID NO: 196004 - DNA, 234 bp, Homo sapiens; identical to SEQ ID NO: 195991
  misc_feature: GYAE6OF02FT4E5.24.71.G05.1.454.CMB.1.raw
  modified_base (232)..(234): a, c, t, g, unknown or other
  misc_feature (232)..(234): n is a, c, g, or t

SEQ ID NO: 196005 - DNA, 241 bp, Homo sapiens
  misc_feature: GYAE6OF02F687C.24.71.G05.1.454.CMB.1.raw
  modified_base (232)..(241): a, c, t, g, unknown or other
  misc_feature (232)..(241): n is a, c, g, or t
tcagactactatgtcacgaccggtgctcgatttagtgtcgtcgcaagagagagggggtcaggctggaagctgaggatgtcgcagtttattactgcacacaatctacacaatttccgtacacttttggccaggggaccaagctggagatcaaacgaactgtggctgcaccatctgtcttcatcttcccgccatctgaacatagtagtctgagcgggctggcaaggcgcatagnnnnnnnnnn

SEQ ID NO: 196006 - DNA, 246 bp, Homo sapiens
  misc_feature: GYAE6OF02H25H2.24.71.G05.1.454.CMB.1.raw
  modified_base (233)..(246): a, c, t, g, unknown or other
  misc_feature (233)..(246): n is a, c, g, or t
tcagactactatgtcacgaccggtgctcgatttagtgtcgtcgcaagagagaggggtcaggctggaagctgaggatgtcgcagtttattactgcacacaatctacacaatttccgtacacttttggccaggggaccaagctggagatcaaacgaactgtggctgcaccatctgtcttcatcttcccgccatctagaacatagtagtctgagcgggctggcaaggcgcaatagnnnnnnnnnnnnnn

SEQ ID NO: 196007 - DNA, 312 bp, Homo sapiens
  misc_feature: GYAE6OF02FKEOW.24.71.G05.1.454.CMB.1.raw
  modified_base (233)..(236): a, c, t, g, unknown or other
  misc_feature (233)..(236): n is a, c, g, or t
  modified_base (238)..(239): a, c, t, g, unknown or other
  misc_feature (238)..(239): n is a, c, g, or t
  modified_base (241)..(241): a, c, t, g, unknown or other
  misc_feature (241)..(241): n is a, c, g, or t
  modified_base (244)..(244): a, c, t, g, unknown or other
  misc_feature (244)..(244): n is a, c, g, or t
  modified_base (251)..(312): a, c, t, g, unknown or other
  misc_feature (251)..(312): n is a, c, g, or t
tcagactactatgtcacgaccggtgctcgatttagtgtcgtcgcaagagagagggggtcaggctggaagctgaggatgtcgcagtttaattactgcacacaatctacacaatttccgtacacttttggccaggggaccaagctggagatcaaacgaactgtggctgcaccatctgtcttcatccttcccgccatctgaacatagtagtctgagcgggctggcaaggcgcatgnnnntnntnagntgctagnnnnnnnnnnnnnnnnnnnnnnnnnnnnnnnnnnnnnnnnnnnnnnnnnnnnnnnnnnnnnn

SEQ ID NO: 196008 - DNA, 813 bp, Homo sapiens
  misc_feature: GYAE6OF01EWVB6.35.52.E08.1.454.CMB.1.raw
tcagtacagatcgtcacgaccggtgctcgatttagtcgagctctctcggcggggactgatcaggacctcctcagttcaccttctcacaatgaggctccctgctcagctcctggggctgctaatgctctgggtcccaggatccagtgacgtaggttgtgatgactcagtctccactctccctgcccgtcacccttggacagccgcctccatctcctgttggtgtagtcaaagtctcgtacacagagatacggaaaccaccttaacgttagtaagtttcggtttcagtacgaggacggcccgagggacctaaactcccgttaccggacgggtcccgtaaccctttaaatttttacggttttacgggttttaaccgtaaaaccgggggttaccttccggttaccgggggtacccctaaaggtaaacccgtaaggttaacgtttaccgacgggtacccgggtaccgtaacggggtcccggggttacgaacggggtacctaacggttacggttaacttttaccgaaaccgtaacgttaacggtaaaaaccgttcgaaggtaccgggtaagggggtacgggacggtaccggtaaggggtaacggttacgggtttcggggtttaaccggggtttaacttaaccgtggaccgtagtacgaaccgtaaacgtaaggtacggtaaccgtacgtaccggttacccttaccggttaccgttaccggtttcgggaacccggtaacggggaacctaagggtcgtaagggtaagtaccgtaaaccgtaaaccggagttcgggtacgacgtacgtacccgtacgttacg

SEQ ID NO: 196009 - DNA, 921 bp, Homo sapiens
  misc_feature: GYAE6OF01ELVBO.35.52.E08.1.454.CMB.1.raw
  modified_base (271)..(271): a, c, t, g, unknown or other
  misc_feature (271)..(271): n is a, c, g, or t
tcagtacagatcgtcacgaccggtgctcgatttagtcgagctctctcggcgggggggagaggagccccagccttgggattcccaagtgttttcattcagtgatcaggactgaacacagaggactcaccagtggaggtttgggctgagctggtattttccttgtcttactaagttttaaaaggtgtccagtgtgacggtgcagcgtggtggagtcgtgggggagtcgttaggtaaggtccgtcgggggtcctcgaggtactcgtcctgtacngtctcgtgtacttctagtcgtaagtcgaccgccgtaggataggaacgtcgggtaccgccgacggcctccgacgggccggaggggtccgtaggggtacggttggggttacgggtaccgtttaaaacgttaaaaaccggacggtacgggttacgggtaaggggttacgggaaacaaaccggtaacggaccgttaacgggacgttaccggggaaccccgggtaaacgggtaaacgggtaccgttaacggggttacccaccgttaacgtccgttaacgaacggtaagtacgtaacgtaacgttaaccgaaaaccggttaaaacccggtttaccccttttaaggttacccgtaacgtaaaccgttaaaacgtaacggtaaactaaaccggtttaaccccggaaaacggtaaaaccccgggtaaccgggaaaccgttaaacccgttaaacccggttttaaccccgttttaaagtttttaaacccggtttaaccccggttaaaccccctttaaccccggttaaaaccgttaaccctttaaacgtttaaaccgttagtaaacgtttaccggtaagggttacccggggttaacgtttcgggtaacccgggtacggacgggttaacctacggtacgttacccgtaccgtcccgttacccg

SEQ ID NO: 196010 - DNA, 659 bp, Homo sapiens
  misc_feature: GYAE6OF01B96MM.35.52.E08.1.454.CMB.1.raw
  modified_base (175)..(175): a, c, t, g, unknown or other
  misc_feature (175)..(175): n is a, c, g, or t
  modified_base (649)..(649): a, c, t, g, unknown or other
  misc_feature (649)..(649): n is a, c, g, or t
tcagtacagatcgtcacgaccggtgctcgatttagtcgagctctcgtcgcggggggggagaggagccccagccttggattccaagtgtttcattcagtgatcaggactgaacacagaggactcaccatggagtttgggctgagctggacttttccttgctactattttaaaggtntccagtgtgaggtgcagcgtcggtggagtcgtgggggaggcgttaggtaaagtcccgtgggggggtccctacgacgtacttcgtcctgtaactagtctcgtgtattacagtctaagtgaccgccgtggatcgacgtcggccgcgacggctccgaggccgaggggcgtgggacggtgggtcggaccgtaattaaaccgaggtcgtaggtagggtcggaacgaacgacgtacgtacgcgtacggacccggtagaacggtctaggtccacgtactcgtacaagcgtatgaataccgaacgtaaacgttcctttagtcgtagactaaagtacgaactacggacctaacggaaaccggagtacacgttaccgtaccttttagtacttacccgtaacctacccgttaagaccttaattaccgtagacctaggtacgttcgggtacccttgggtacgggacctaggtactcccgacgtccnccgtctcccg

SEQ ID NO: 196011 - DNA, 743 bp, Homo sapiens
  misc_feature: GYAE6OF01C0FWK.35.52.E08.1.454.CMB.1.raw
tcagtacagatcgtcacgaccggtgctcgatttagtcgagctctctcggcgggggggagaggagccccagccttgggattcccaagtgttttcattcagtgatcaggactgaacacagaggactcaccatggagtttgggctgagctggattttccttgctactaattttaaaaggtgtccagtgtgaggtgcagcgtggtggagtcgtgggggaggcgttaggtaaaggccggtggggggtccctcgagactctcctgtactagtctcgtggattcagtactaagtcgacgcgtaggatggaacgtgggtccgccgaggtcctccgacggccgaggggcgtggtacggtggggttcggaccgttaattaaaacccgagtcggagggagggtaggaacaaacgacggaactacggcgtacgggaaccccgtaaggaaacggcgtaacggttccaaaccgtacgttaccgtacgaaagtacgaagttacgaactttaccgaaaagttaaaaaccccgttcccttttaatccgtaagaacccgtaaaagttacggaaaaccgtacgaccgtaaacggaaaaccgggacgaaaccgtacgaaccgttaccctttaaagttacgttaacccgtaaccttaaccccgtacgaacttacgttacacgtaataacgtaggttagggtacctttcggacggggtaccgaacgggtaaccacggtaccggtaccacccggttccgtaccccg

SEQ ID NO: 196012 - DNA, 1063 bp, Homo sapiens
  misc_feature: GYAE6OF01BNMRA.35.52.E08.1.454.CMB.1.raw
tcagtacagatcgtcacgaccggtgctcgatttagtcgagctctctcggcgggggggagaggagccccagccttgggattcccaagtgttttcattcagtgatcaggactgaacacgagaggactcaccagtggtaggtttgggctggagtcgtggtactttttccgttgtacttaactttaaagttttaaaagggtcgttacctaggttggtaggtagggttcgacgtaggtcggttgggtagggtaggttcgggttaggggggtacgttacgggtttaagggtaaaccgggtcccggggttcggggggttaccctacgtaacggttccttccgttaccgtacgtaaccgtacggttccttacggttcgttaacgttacgtacgttaacggtaacggtaccggtaccggtcggttacggtaacggttaccgggtaacccgggttccggggtaccccggtaccggtaccggtaccccggtaaccgggaccggggtaccggggtacgggggttacggttagggggttaccggggtttacggggttaaccggtaaaccgggtttaaaaccgttaaaacgggtacggggttaccggggtaacgggggtaacggggtaaacgggaaaccgtaaacggtaaccggtaaaccggtaaccggtaccgggttaacccgggtaaacccgggttaaacggggaaccggtaccgggttaaacccgtaaccgtaaaccgttaacgtaccggtaaacggtaacggtaacgttacgttaacggtaaaccgtaacggttaaaccgttaacccgttacgtttacgtaaccgttaacgaaacgtaacgtaacgaaaccgtaaccggtaaccggtaaaccggtaacggtaaccgtaacgttaacccgttaacgtttaacccgttttaacgttaacccgttaccgttaacccgttaaccgtaacttaaccttaacgttacgtacgttaaacggtacggtacgggttaccgggtaacggttcgggaccgggtaacggtacgtacccggtacgttaacccggtcccgtaccggttaccgacccg

SEQ ID NO: 196013 - DNA, 1002 bp, Homo sapiens
  misc_feature: GYAE6OF01CBGBF.35.52.E08.1.454.CMB.1.raw
  modified_base (156)..(156): a, c, t, g, unknown or other
  misc_feature (156)..(156): n is a, c, g, or t
  modified_base (566)..(566): a, c, t, g, unknown or other
  misc_feature (566)..(566): n is a, c, g, or t
  modified_base (642)..(642): a, c, t, g, unknown or other
  misc_feature (642)..(642): n is a, c, g, or t
tcagtacagatcgtcacgaccggtgctcgatttagtcgagctctctcggcgggggggagaggacgccccagtccgttgggacttcccaagttgttttcattcagtgatcgaggactgaacacagacgtactaccgacagtggtagtttgggactgngtctggttacttttctagtcttaacgttaatttttaaacggcgtactgttcgtaggaggtcgcagtcgtaggtggtaggtcggtgggggaacgtcgttaggtaacgggtccggtcgggggttcctcgacgtacttccgtaccgtacgttacgtacgttctcgttacggtacgttccaaggtttaccgtaaagttccggtaaccgtcccgggttaggtaaacgttaccggtaacggccccggggttcccgtaccgggaacggttcccgtaccgggaacccgggggttccgggaaccggggggttctacgggggttaagggtttacggggggtttacccgggaaccccgtttttaaaaacggtttaaaaccggaaccggggttacggggtaacgggtttaacggggggtaanaaaccggtaacggtaaccgtttaaacgtacccgggtaccggttaaccgggttaaacccggaggaaaccccgggttnttaaacccgggttaccaccgttaaccgtaccgttaagaacggtttaccagttaaccgttaaagtttaccccgaaacgttaaaaccccgttccgttttaaagcccggtaacgtaaccgtaaagttacccgaaaacgtcccggttaaaccgaacggaaaaccggttgggaaacccctaacggttttacccttttaaccccgggttaattttaaccgggtacctaaaccccctttacgttaccgaagtttaccgttaaccgataaaccggttacttcggggtaaagtttccggtacccgggtacccgggagttaaccgggtacttacccggttaccggtacccgttcgggtttcacccccggg

SEQ ID NO: 196014 - DNA, 620 bp, Homo sapiens
  misc_feature: GYAE6OF02HTLJ1.35.52.E08.1.454.CMB.1.raw
  modified_base (367)..(367): a, c, t, g, unknown or other
  misc_feature (367)..(367): n is a, c, g, or t
  modified_base (435)..(435): a, c, t, g, unknown or other
  misc_feature (435)..(435): n is a, c, g, or t
tcagtacagatcgtcacgaccggtgctcgatttagtcgagctctctcggcgggggggagaggagccccagccttgggattcccaagtgttttcattcagtgatcaggactgaacacagaggactcaccatggagtttgggctgagctggattttccttgctactattttaaaaggtgtccagtgtgaggtgcagctggtggagtctgggggaggcttggtaaagccgtggggggtccctcgagactctcctgtacagtctctggattcagtctaagtgacgcctggatgaactgggtccgccaggctccgaggccgaggggctgggagtgggtgacgtattaaaccagcgtggagggtggacaacgngactacgcgtggacccgtgaaacggcaggttcaccatctacaagagatgattcaagaaactcctttanactagacaaatagaacagcctaagaaaccgaggaaccaacgtacgtaccctttaattaacgttacgtaaccctaacccttaacgaacctacttaaccgtagtaactaacgaaggttacggggtactttaccggtcggggacctaaggggtaactcccggtaggtacccgtacccgttcttacccg

SEQ ID NO: 196015 - DNA, 807 bp, Homo sapiens
  misc_feature: GYAE6OF02J3NTL.35.52.E08.1.454.CMB.1.raw
  modified_base (653)..(653): a, c, t, g, unknown or other
  misc_feature (653)..(653): n is a, c, g, or t
tcagtacagatcgtcacgaccggtgctcgatttagtcgagctctctcggcggggactgatcaggactcctcagttcaccttctcacaatgaggctccctgctcagctccgtggggctgctatcgcctcgtcgggtacccaggtactccgaggtcgacggtaggttgtagactcgtacctctacgtcctacctacctccgtcccgtccggtccccgttccgtacccggttacggaccgccggtcccggtcccttaccgtacttccgttcggttacggtttaggtacggttacgtaccgtaacgttccgtaccgtaacgacggaagtacgaactaccggtaaccttaccgttcgttaggtacgttttcggtacgacgacggaacggcggaccacggtaccctagtcccggtacggacggttacctttacgtttaacgttttacgttacgggttaaccggttaaccgggttcctccgggtaccgggtaacctagacgtacgtacgtaccggacggtcggtacggccgggtaccggtacgaacggtacctagtaccgttaccgtaacctaacggtaactaaaggaccgtacgacgggtaacggggtacgggtacgtacggtacggtacggtaaggttcggttcgggttaacgttacngctacgtacgtacaacgtagtacggtgaaccggttccgtaccgttacccgttctacggtaaccggtccggtaccgggagtaccggtacggaaccgttcaaacggttccgtaacgtacccggtggtccggtaccactccggtaccttcggtaacc

SEQ ID NO: 196016 - DNA, 785 bp, Homo sapiens
  misc_feature: GYAE6OF02HLOCX.35.52.E08.1.454.CMB.1.raw
  modified_base (511)..(511): a, c, t, g, unknown or other
  misc_feature (511)..(511): n is a, c, g, or t
tcagtacagatcgtcacgaccggtgctcgatttagtcgagctctctcggcgggggggagaggacgccccagccttgggattcccaagtgttttcattcagtgatcaggactgaacacagaggactcaccatggagtttgggctgagctggtatttccttgctacttatttaaaaggtgtccagtgtgaggtgcagctggtggagtcgtgggggaggcgttggtaaagccgtgggggtccctcgagactctcctgtacagtctctggattcagtctaagtcgacgctaggatgaacgtgggtccgccaggcctccgacgggccagggggcctaggggaggttcggggttcggaccggttaaagtttaaaaaacccggaggtaccggtagggaggggtacggaaccaaacgagtaactacgcgtacggacccgtagaaacggctaaggttaccaccgataccgtcgaaagtagtattagaacttacgaaacgtaaaacccgtccgttttaaanaccgttagaacgtaaaattacgaaacctaacggtacccttaaaggaaaaacccggtacgaaccgtaaccgtaaccgttaccccgttttaaattaccgtttaaccggttaaacccctaaccccggtttaaaccgaaaccgttaagtttaccgttagtaaaccgttaccgtaaacggttcggggttaacctttaccggggtacggggtaacccgtaacggggttaaaccgtacccggttaaacgggttaccccgtacccgttcccgttaaccccgg

SEQ ID NO: 196017 - DNA, 895 bp, Homo sapiens
  misc_feature: GYAE6OF02GRBJP.35.52.E08.1.454.CMB.1.raw
tcagtacagatcgtcacgaccggtgctcgatttagtcgagctctctcggcggggggggagaggagccccagccttgggattcccaagtgttttcattcagtgatcaggactgaacacagaggactcaccatggagtttgggctgagctggtattttccttgcttactaattttaaaaggtgtccagtgtgagtgcagtcgtggtggagtcgtgggggacggtacgttaggtaaagccggtgggggtcccctcgagtactccgtcctacgtacgtactctcgttaggtcttagtacgtacgtaaggttcgaccgtaccgtggtattacggtaacccggtcggggtacccggacccgtacgggtccctacccggacggggcccggtaacgggggccgttcgggggtaacgggtttacgggggttccgggtaaccggttaaaagttaaaaaggggaaggttaaagttacgggtaaggtacggggtacgggaaacctaaacggtaaacggtaaccgttaaccgtaccgtttaaccccggttacccggttacgacgggtacctacggtaacgtttaccgaacccggttccctaccgggtaagtaacggtattaccggttaccgttacccgaagttaccgggtcttaaaccggtttcctacgttaccgtttaaccctaaaggaaccttaacggaacccgtactaaccggtacggtaaacccggaaacccggtagtaacccgacgtaccgttcccgttaaaactttcgttaaaccccggtctaaacccggtcttcccgtaacgtaccctaaggttaccccgtcgggtaacccctttaacgccggtttaaaccccaggtttaacccgggtaccggggttaacccggggccggggtttaacccg

SEQ ID NO: 196018 - DNA, 915 bp, Homo sapiens
  misc_feature: GYAE6OF02FZYKA.35.52.E08.1.454.CMB.1.raw
tcagtacagatcgtcacgaccggtgctcgatttagtcgagctctctcggcggggggggaagaggagcccagccttgggacttcccaagttgttttcattcagtgatcaggactgaacacagaggactcaccagtggagtttcgggctagagccgttgggtactttttcccgttggtaccttaacttaagttttttaaaaacggtcgttcctaaggttggttacggaagggttcgccaaggtcgttaggggtcgggtaggtcggtggggggacggttaccgtttagggtaaacggtccgggtacgggggggttccctacgaacggtaccttccgtaccgttacgttacgtacgttcgttacggttacgttaccgttcccgtaccgtttaacgtacggttaaccgtcgtaaccggtagggtacttccgggtactaaccgggttccgggttacccgttaaaccgtaccgggtttaccggaaggggggtacggggttacgtgggggttaccgtttcggggttacgttacggtttaaccgtaggtaggtagtaggtacggggtactcgaacctaacaacggttcgaaccggtcggtcgtaccggaggtacggaacttcctacccacccgttcgaaacgacgaaacccgaccgtaaaccaagaacccctagttaaacctatacgtacgtaataaaccgtaaagtaccggtaaactacggttacgtaggaaaggaacggacccgggaaacggacccggttaaccgggtccgtttaataccggtttaacgttaacttaggtaaccggtaacgtaggtacgggtacgaacgtacccgttaaggtacttaacggttttccggttaagtccgttacgggttacgggtaaacgggtaccggtaaaggaccggtttaggtaaccccgg

SEQ ID NO: 196019 - DNA, 534 bp, Homo sapiens
  misc_feature: GYAE6OF01EGAHV.36.65.F10.1.454.CMB.1.raw
  modified_base (424)..(424): a, c, t, g, unknown or other
  misc_feature (424)..(424): n is a, c, g, or t
tcagtacgctgtctcacgaccggtgctcgatttagctacgctctaagggggagcatcacccagcaaccacatctgtcctctagagaatcccctgagagctccgttcctcaccatggactggacctggaggatcgtcttcttggtggcagcagtcacaggagcccactccccggtgaaattggtgcagtccggggttgaggtgacgaagcctggggcctcagtgaaggtcccctgccaggcttctggatacctcttcaacgcctattatatacactgggtgcgccaggcccctggacaaggggcctgagtggatgggatgcgtcaaccccaacactggcgacacaaagtctgcacagaagtttcagggccgtgtcgccttgacccgggacacgtccatcaatacagcctacatggaattcagtanctaaatctgacgacacgcgtctattactgtgcgagaggcaggacgttccgacgtggggaataaggtgacgtaagtttcgattgtcttttagactatcgtggggtaaccgg

SEQ ID NO: 196020 - DNA, 570 bp, Homo sapiens
  misc_feature: GYAE6OF01EF37F.36.65.F10.1.454.CMB.1.raw
tcagtacgctgtctcacgaccggtgctcgatttagctacgctctaagggggagcatcacccagcaaccacatctgtcctctagagaatcccctgagagctccgttcctcaccatggactggacctggaggatcgtcttcttggtggcagcagtcacaggagcccactccccggtgaaattggtgcagtccggggttgaggtgacgaagcctggggcctcagtgaaggtcccctgccaggcttctggatacctcttcaacgcctatatatacactgggtgcgccaggcccctggacaagggcctgagtggatgggatggcgtacaaccccaacactggccgacacaaagtctgcacagaagtttcgagggtccgtgtccgccgttcggacccgggacacgtccatcaatacacgcctacatggaattcagtactacctaaaatctagacgacgaccggccgtactaacgttactggtacgacggagacggacgaggtacgttccacggtaggggaactaaggtgtacggtaatttcgagttacgtcttttagactatcggtggggtaccgg

SEQ ID NO: 196021 - DNA, 840 bp, Homo sapiens
  misc_feature: GYAE6OF01BTPQI.36.65.F10.1.454.CMB.1.raw
tcagtacgctgtctcacgaccggtgctcgatttagctacgctctaagggggagcatcacccagcaaccacatctgtcctctagagaatcccctgagagctccgttcctcaccatggactggacctggaggatcgtcttcttggtggcagcagtcacaggacgcccactccccggtagaaagttggtgcgaggtccggggttgaggtgacgaagccgtggggcctcgagtgaacggtcccctgccgaggtccttcgtggacttacctccttaccaacgccttaattataacgtacacgttgggtagccgaccgacgggcccccgtagggaaccgaaacggggcccgtaggtaggtacgggacgttaggggtacgtcggacccggtaaccccgaaaccccccgaaacgaccggttacgggaaccgaacgaaaccgaaaacggttcgtacgacccgtaacgtaacggttaacgttttacggacggggtcccgtaggtcccggtacccgtttacgggaaacccccgggtaccaccggtaccctaacgtaccgtaaacgtaacccgacgtaccccgttaaacaacggttaacggtaaactttaccgaacgttaaccgaaacccttaaaagttccgtaacggaacccggtaaccggaaccgggttacccgttactttaaccgttaccgttacgggttacggaaccgggtaaggtacgggaccgtaacggtaccggttaccgaagggttacgggggtaagttaaacgggtcgttaacggttaacggtttaccggaatttcgggtttacttttacgggaactacggttcgggtaacgggggtaaaccg

SEQ ID NO: 196022 - DNA, 603 bp, Homo sapiens
  misc_feature: GYAE6OF01D8W7Q.36.65.F10.1.454.CMB.1.raw
  modified_base (359)..(359): a, c, t, g, unknown or other
  misc_feature (359)..(359): n is a, c, g, or t
tcagtacgctgtctcacgaccggtgctcgatttagctacgctctaagggggagcatcacccagcaaccacatctgtcctctagagaatcccctgagagctccgttcctcaccatggactggacctggaggatcgtcttcttggtggcagcagtcacaggagcccactccccggtgaaacttgggtgcagtccggggttgaggtgacgaagcctggggcctcagtgaaggtgtcctgcaagacttcaggatacaccttcactagtttatgaaatcaactgggtgcgacaggccagaggacaagggcttggagtggagtggggatggggtagaacccttagtagtggtagacacagattangacagagaagttccgagggcagaatcaaccagtacgaccgaagaacagacctacaataaacactaagttaacagtaggaactagaactagtacgtagacgcgtaccggaaggaccgaccgggtaccgttaagttaacgttacgtgtacggacgtagacgaacgtacgttagttttaggacgttggtacgtaagtacggtaacggggttaccgaccccgggtcgggcccgtacgggtaaccccgg

SEQ ID NO: 196023 - DNA, 809 bp, Homo sapiens
  misc_feature: GYAE6OF01AU07E.36.65.F10.1.454.CMB.1.raw
tcagtacgctgtctcacgaccggtgctcgatttagctacgctctaagggggagcatcacccagcaaccacatctgtcctctagagaatcccctgagagcctccgttcctcaccatggactggacctggaggatcgtcttcttggtgcagcagtcacgaggacgcccacctccccggtagtaaacgttggtgcgtaggtccggggttgaggtgacgacgccgtgggcctgagtcgacggtccctgccaggtcttcgtggacttacctcttaccgaaccgtccttaattatactaccgacggtgggtcgccgccgaccggtccccgtaggaaccgaacgggtcctaggacggtaggacgtggggtacttcggacccgtaacccgaaaacccccgtaagtaccggtacggaacctaaacgaaaccgtaaacggttctacgaacctaacgtaaacggttaaccggtttccggaacggggtttcccggtacgttacccgggtaccccggtttaaccgggaacccccgggtaacctaacccggttacccgtaagtaacccgtaaaccgtaaccgtaaccgtacccttaaacgacggttaaggttaaaccttacggaaacgttaaccgtaaactaaaccgttcgaaccggaacgtacccgtaaccggttacttactttaacgttcgtacgtacggaacgtacgggtacgaccgtaaggttaccgttaccggaagggtacgggtaacgtaaggtcgtaacgttaagtttcgagttcgtttagtacgaccgtaggttcccggggtaaggtaacccggg

SEQ ID NO: 196024 - DNA, 668 bp, Homo sapiens
  misc_feature: GYAE6OF01B6QRD.36.65.F10.1.454.CMB.1.raw
  modified_base (292)..(292): a, c, t, g, unknown or other
  misc_feature (292)..(292): n is a, c, g, or t
  modified_base (351)..(351): a, c, t, g, unknown or other
  misc_feature (351)..(351): n is a, c, g, or t
  modified_base (453)..(453): a, c, t, g, unknown or other
  misc_feature (453)..(453): n is a, c, g, or t
tcagtacgctgtctcacgaccggtgctcgatttagctacgctctaaggggggagcatcacccagcaaccacatctgtcctctagagaatcccctgagagctccgttcctcaccatggactggacctggaggatcgtcttcttggtggcagcagtcacaggacgcccactccccggtgaaattggtgcaggtccgggggttgaggtgacgaagccgtggggcctcagtgaacggtcccctgccaggcttctggatacctcttaccaacgccttattactatacacgtgggtcncgccacggcccctggacaacgggcctggagtggatgggatcggccgtaccaaccccaancgtggaccacaacaagtctgacacgagtaacgtttcgagggtccgtggtccgtccgttacggacccgggactaccgtaccatacaactaccgacgtcctaanacgtaggtaacttcgaaggtactaaccgtaaactcgtaacggaccgtacgtaccggtccgttacttaacgttacgtacggtacgacggaggacggtacacggttacggttacccgacgggtacggggtaacttacgggtacgtaacggttaacgttacggtacgttcggttacgttttacggaaccgtacggttccgggtcgggggtaaacccgg

SEQ ID NO: 196025 - DNA, 740 bp, Homo sapiens
  misc_feature: GYAE6OF01CVKD6.36.65.F10.1.454.CMB.1.raw
  modified_base (606)..(606): a, c, t, g, unknown or other
  misc_feature (606)..(606): n is a, c, g, or t
  modified_base (705)..(705): a, c, t, g, unknown or other
  misc_feature (705)..(705): n is a, c, g, or t
  modified_base (721)..(721): a, c, t, g, unknown or other
  misc_feature (721)..(721): n is a, c, g, or t
tcagtacgctgtctcacgaccggtgctcgatttagctacgctctaagggggagcatcacccagcaaccacatctgtcctctagagaactccctgagagcctccgttcctcaccagtggactcggacctgggaggactcgttcttcgtggtgcagcagtcacgaggacgcccaccgttcccggtagtaaagttcggtcgacgtacgggttccgggggttagagggtacgaaccggacgcccggtcgggaccttacgaggttacggaacccggtccccctggacccgtaggtacctttcgtaggtaccttacccgttaccttaccgtaacgtacccttaattaacttacgtaccgtacggtcggggtcacccggaccgaccgggtacccccgtaggaaccggaaccgggtccgttaggtaacggtggtacgggtagggaccttcggacccgtaacccaaacccctaagacgtacggacctaacaactaacgtctacgacacgtaagtacgttcggacggtcgtcgtccgtccgtacggacccggtactacgtcaagtacaacctacgactacccgtaatagtacgttaatcgtagtaactaacgtaanccgtaacggacacccgtacggtacgttactaagttccgtggtcgacgtagacggtcaacggttactccggaaaggtggaactaggacttagtattacgngtttacgtaccttagntacggtcggtagggtaacg

SEQ ID NO: 196026 - DNA, 591 bp, Homo sapiens
  misc_feature: GYAE6OF02G66YZ.36.65.F10.1.454.CMB.1.raw
  modified_base (337)..(337): a, c, t, g, unknown or other
  misc_feature (337)..(337): n is a, c, g, or t
tcagtacgctgtctcacgaccggtgctcgatttagctacgctctaagggggagcatcacccagcaaccacatctgtcctctagagaatcccctgagagctccgttcctcaccatggactggacctggaggatcgtcttcttggtggcagcagtcacaggagcccactccccggtgaaattggtgcaggtccggggttgaggtgacgaagccgtggggcctcagtgaacggtcccctgccaggcttcgtggatacctcttcaacgcctattatatacactggtgcgccaggcccctggacgaagggcctgagtggagtggatcgcgtacaaccccaanactcggacgacacaaacgtcagcacgagtaacgtttcgaacgggtccgtagtccgccgttacgggaaccccgggactaccgtccacgtacctaaactacacgtacctaacacgtacggtaacttacgagtaacgacctaaatctacgacgacgacggccgtctacttacgtgtgtacgagcgacgagtacgtccgagtagggagtaagtcgtacgtagttacgagttcgtctttagactagtcggtggtaacgg

SEQ ID NO: 196027 - DNA, 539 bp, Homo sapiens
  misc_feature: GYAE6OF02I9UG4.36.65.F10.1.454.CMB.1.raw
  modified_base (281)..(281): a, c, t, g, unknown or other
  misc_feature (281)..(281): n is a, c, g, or t
tcagtacgctgtctcacgaccggtgctcgatttagctacgctctaagggggagcatcacccagcaaccacatctgtcctctagagaatcccctgagagctccgttcctcaccatggactggacctggaggatcgtcttcttggtggcagcagtcacaggagcccactccccggtgaaattggtgcaggtccggggttgaggtgacgaagcctggggcctcagtgaaggtcccctgccaggcttctggatacctcttcaacgcctattatatacactgggtncgccaggcccctggacaagggcctgagtggatgggatgcgtcaaccccaacactggcgacacaaagtctgcacagaagtttcgagggccgtgtcgccgttggacccgggtacacgtccatacaatacacgcctacatgtaattcagtagtacctaaatctagacgacacggccgtactattactgtgcgagaggcagagtccagtgggagtaggtgacgtaagtttcgattcgtcttttgactagtcgtgggtaccgg

SEQ ID NO: 196028 - DNA, 517 bp, Homo sapiens
  misc_feature: GYAE6OF02GQVHC.36.65.F10.1.454.CMB.1.raw
  modified_base (281)..(281): a, c, t, g, unknown or other
  misc_feature (281)..(281): n is a, c, g, or t
tcagtacgctgtctcacgaccggtgctcgatttagctacgctctaagggggagcatcacccagcaaccacatctgtcctctagagaatcccctgagagctccgttcctcaccatggactggacctggaggatcgtcttcttggtggcagcagtcacaggagcccactccccggtgaaattggtgcagtccggggttgaggtgacgaagcctggggcctcagtgaaggtcccctgcccaggcttctggatacctcttcaacgcctattatatacactgggtncgccaggcccctggacaagggccctgagtggatgggatgcgtcaaccccaacactggcgacacaaagtctgcacagaagtttcaagggccgtgtcgccttgacccgggacacgtccatcaatacagcctacatggaattcagtagctaaatctgacgacacggcgtctattactgtgcgagaggcagagttccactgggataagtgcgaattcgatgctttgactatctgggaccg

SEQ ID NO: 196029 - DNA, 744 bp, Homo sapiens
  misc_feature: GYAE6OF02HG3U8.36.65.F10.1.454.CMB.1.raw
  modified_base (267)..(267): a, c, t, g, unknown or other
  misc_feature (267)..(267): n is a, c, g, or t
  modified_base (436)..(436): a, c, t, g, unknown or other
  misc_feature (436)..(436): n is a, c, g, or t
tcagtacgctgtctcacgaccggtgctcgatttagctacgctctaagggggagcatcacccagcaaccacatctgtcctctagagaatcccctgagagctccgttcctcaccatggactggacctggaggatcgtcttcttggtggcagcagtcacaggagcccactccccggtgaaattggtgcagtccggggttgaggtgacgagcgtgggcctcagtgaaggtcccctgccaggcttcgtggatacctcttcaacgcctattanatacactggtgcgcacggcccctaggacgaacgggcctaggagtggagtgggatggccgtacaaccccaaactacgtaggccgaacgtaactaaaaggtccttaggacaacgaaggtaagttttcgaacggggtccggtgtcgacccgtttcgggaaccccgggtaacnccggttaccgactactaaacgttaacaacggacccttacgaacgtacgggttaaactttacgagttaacggtaacctttaaaaacttcgttaacggaacgtacgaacccgggtaccgtaaccgttaacgtttaccgttacggtacgtaccgggaagacgggtaacgtaacgtaaccggttaccccgtaacggttacggggggtaaagttaaacgggttaggtacggtttaaaaccgttttacggtaacgtttggttaccgtttttacggaacgttaacggttaccgggttaggggtaaacccccgggg

SEQ ID NO: 196030 - DNA, 561 bp, Homo sapiens
  misc_feature: GYAE6OF02H768C.36.65.F10.1.454.CMB.1.raw
  modified_base (280)..(280): a, c, t, g, unknown or other
  misc_feature (280)..(280): n is a, c, g, or t
  modified_base (331)..(331): a, c, t, g, unknown or other
  misc_feature (331)..(331): n is a, c, g, or t
tcagtacgctgtctcacgaccggtgctcgatttagctacgctctaagggggagcatcacccagcaaccacatctgtcctctagagaatcccctgagagctccgttcctcaccatggactggacctggaggatcgtcttcttggtggcagcagtcacaggagcccactccccggtgaaattggtgcagtccggggttgaggtgacgaagcctggggcctcagtgaaggtcccctgccaggcttctggatacctcttcaacgcctattatatacactgggtncgccaggcccctggacaagggcctgagtggatgggatgcgtcaaccccaanactggacacacaaagtctagacacagtaagtttcagggccgtgtcgccttcggacccgggacacgtcatacaatacagcctacatggaacttcagtaagaccttaaaactctacgaacgtacgaccggtccgtactaacttactcgtgacgagaggcagtagttccacgtgggagtaagtagacgtaagtttcgagttgtacttttgactagttacggtagggtaaccgg

SEQ ID NO: 196031 - DNA, 726 bp, Homo sapiens
  misc_feature: GYAE6OF02JCCOM.36.65.F10.1.454.CMB.1.raw
  modified_base (352)..(352): a, c, t, g, unknown or other
  misc_feature (352)..(352): n is a, c, g, or t
tcagtacgctgtctcacgaccggtgctcgatttagctacgctctaagggggagcatcacccagcaaccacatctgtcctctagagaatcccctgagagctccgttcctcaccatggactggacctggaggatcgtcttcttggtggcagcagtcacaggagcccactccccggtgaaattggtgcgaggtccggggttgaggtgacgaagccgtgggcctcgagtgaaggtccctgccaggcttcgtggactacctcttacaacgccttattatactcacgtggtcgcgccgaggcccctggacgtaacgggcctagaggtggatggggatcggccgtaccaaccccgtaanaccgtcggacgaaccaactaaacgtcaggacaacgaagtaacgtttcgaacgggtccggttagtacccggtccgttacgggaacccgggtacaaccgtccgtaacgtaccgtaaacgtacccaacggacccttaacgaacgttcggtaaacttaccgaaacggttaacgaacccgtttaaaatccgtaacgtaacgaaccgtaccggtacccgttcttaacgttaccgtagtacggacgtaaggtacggacgtaacggtacgttaccgacggtacggggtaacgttaacggtacggtaccggttaaacgtttcggtaagttacggtttcgttttaacggaacccgtacggttaccggtaccgggggtaacccgg

SEQ ID NO: 196032 - DNA, 555 bp, Homo sapiens
  misc_feature: GYAE6OF02G4NC4.36.65.F10.1.454.CMB.1.raw
  modified_base (220)..(220): a, c, t, g, unknown or other
  misc_feature (220)..(220): n is a, c, g, or t
  modified_base (337)..(337): a, c, t, g, unknown or other
  misc_feature (337)..(337): n is a, c, g, or t
tcagtacgctgtctcacgaccggtgctcgatttagctacgctctaagggggagcatcacccagcaaccacatctgtcctctagagaatcccctgagagctccgttcctcaccatggactggacctggaggatcgtcttcttggtggcagcagtcacaggagcccactccccggtgaaattggtgcagtccggggttgaggtgacgaagccgtggggcctnagtgaaggtcccctgccaggcttctggactacctcttcaacgcctattatatacacgtgggtgcgccaggccccctggacgaagggcctggagtggatgggatgccgtcaaccccanacgtggccgacacaaagtcagcacagtaagtttcacgggccgtgtccgtcgttcggacccggactacgtccatacaatacacgacctacagtggaactcagtacgactaaatctagacgacgacgccgtctacttacgtcgtgacgagacggcagtacgtccacggtagggataaggtcgacgtaagttacgattgtctttgactagtcgtggtaacg

SEQ ID NO: 196033 - DNA, 557 bp, Homo sapiens
  misc_feature: GYAE6OF02I65AD.36.65.F10.1.454.CMB.1.raw
  modified_base (280)..(280): a, c, t, g, unknown or other
  misc_feature (280)..(280): n is a, c, g, or t
  modified_base (331)..(331): a, c, t, g, unknown or other
  misc_feature (331)..(331): n is a, c, g, or t
  modified_base (350)..(350): a, c, t, g, unknown or other
  misc_feature (350)..(350): n is a, c, g, or t
tcagtacgctgtctcacgaccggtgctcgatttagctacgctctaaggggggagcatcacccagcaaccacatctgtcctctagagaatcccctgagagctccgttcctcaccatggactggacctggaggatcgtcttcttggtggcagcagtcacaggagcccactccccggtgaaattggtgcagtccggggttgaggtgacgaagcctggggcctcagtgaaggtccctgccaggcttctggatacctcttcaacgcctattatatacactgggtncgccaggcccctggacaagggcctgagtggatgggatgcgtcaacccaacnctgcgacacaagtctgcanagaagtttcagggcgtgtcgccttgacccgggacaccgtcactacaactacacgacctacagtgaattcagtacgacctaaaattctagaccgacacggaccgtctacttacgtagtcgtacgagacgcgagtacgttccacgtgggagtaaggtgacgttaatttcgaagttcgtacgttttgaactacgttcgtagggtaaccgg

SEQ ID NO: 196034 - DNA, 826 bp, Homo sapiens
  misc_feature: GYAE6OF02IUFPI.36.65.F10.1.454.CMB.1.raw
  modified_base (243)..(243): a, c, t, g, unknown or other
  misc_feature (243)..(243): n is a, c, g, or t
tcagtacgctgtctcacgaccggtgctcgatttagctacgctctaagggggagcatcacccagcaaccacatctgtcctctagagaatcccctgagagctccgttcctcaccatggactggacctggaggatcgtcttcttggtggcagcagtcacaggagcccactccccggtgaaattggtgcagtccggggttgaggtgacgaagcctggggcctcagtgaaggtccctgccaggcttcnggatactcttcaacgcctattatatacacgtggtgcgccacggcccctggacaagggcctagaggtggatggggatcggcgtaccgaaacccccaacgtacgtacgggaccgaacaactaaaacggtctacggacctaaccgaaggtaaagttttaccgaacgggggtcccgttaggtcccggtacgtttacccgggaacccggggtacctaacccggtaccgtaacacccgtaaacgttaacgacggtacccctaacgtaacgtacgggtaaactttaccgaacggttaacggtaaaccttaaaaacgtcgttaacggaaccggtaaccgtaacccgggttacccgttaccgtttaacgttttaaccgtacgggtttacggaacccggggtaacgtaccggggtaaaccgtaaacgggttaaccggtttacccgggtaaaccgttaacgggggggttaaactttaaacggggtaaccgggttaaccgggttaaacgttttaccggaaacgttttccgggttacgttttttaccgggaaacggtttaaccgtttacccgggtaccggggggttaaaccccggg

SEQ ID NO: 196035 - DNA, 762 bp, Homo sapiens
  misc_feature: GYAE6OF02FWOQ6.36.65.F10.1.454.CMB.1.raw
tcagtacgctgtctcacgaccggtgctcgatttagctacgctctaagggggagcgatcacccagcaaccacatctgtcctctagagaactcccctgagagctccgttcctcaccatggactggacctggaggatcgttcttcttggtggccaggtccagtcacaggagcccactccccggtgaaattggtgctaggtccggggttgaggtgacgaaggccgtggggcctcaggtcgaacggtcccctgcccaggtccttcgtggactacccgtcttacaaccgtcccttagttactactactacgtagggtcgccgaccgtacggccccctgggaaccgaacgggtccctggaggtcgggagttcgggggatcggccgtaccgaaaccccaagtaccgtcgggaccgaaccaacgtaaacggttcctacggacctacgtaacggttaagttttcccggaacggggtcccgttgtaccggtcccgttacgggacccccgggactacccggtccacgttaccaaagttaccacgtaccctaacgtacgttagggtaaactttccgaacgttacgtaaccttaaaagttcccgttacggaacccgtacgacccgggtccgttacgttaacgttaccgtggttacggtaccggaagtaacgggtccgtaacgggtaccgttaccgtacggtagggaacgttaacggcggtacgttacgttacgtgttcgttacgtttaggacctcggttaccggagggtaacccgg

SEQ ID NO: 196036 - DNA, 580 bp, Homo sapiens
  misc_feature: GYAE6OF02FLL17.36.65.F10.1.454.CMB.1.raw
  modified_base (332)..(332): a, c, t, g, unknown or other
  misc_feature (332)..(332): n is a, c, g, or t
  modified_base (340)..(340): a, c, t, g, unknown or other
  misc_feature (340)..(340): n is a, c, g, or t
tcagtacgctgtctcacgaccggtgctcgatttagctacgctctaagggggagcatcacccagcaaccacatctgtcctctagagaatcccctgagagctccgttcctcaccatggactggacctggaggatcgtcttcttggtggcagcagtcacaggagcccactccccggtgaaattggtgcagtccggggttgaggtgacgaagccgtggggcctcagtgaaggtcccctgccaggcttctggatacctcttcaacgcctattatatacactgggtgcgccaggcccctggacaagggcctggagtggatgggatgcgtcaaccccanactggcanacaaagtctgcacagagtttcagggcgtgtccgctcgacccgggactaccgtccgataccaatacgacgacctacgatacgggaattacgagtagacctaaaatctacgacgacgacggccgtcttattactgtgcgagaggactagacgttaccgacgtaggggtaataaggtcggtaggtaacttttaccggaagttggtcctttttaggacgttacgttaccggtggggtaacccgg

SEQ ID NO: 196037 - DNA, 694 bp, Homo sapiens
  misc_feature: GYAE6OF02JQQC7.36.65.F10.1.454.CMB.1.raw
  modified_base (283)..(283): a, c, t, g, unknown or other
  misc_feature (283)..(283): n is a, c, g, or t
tcagtacgctgtctcacgaccggtgctcgatttagctacgctctaagggggagcatcacccagcaaccacatctgtcctctagagaatcccctgagagctccgttcctcaccatggactggacctggaggatcgtcttcttggtggcaggcagtcacaggtacgcccacctccccggtgaaattggtgcaggtccggggttgaggttgacgagccgtggggcctcagtgaacggtcccctgccgaggcttcctggactaccttcttacaaccgtctagtttanactactacgtgggtcgcgaccgacggcccctagggacaaggggtccctaggagttcgggatggggtatcggtacggtaccccaaaccccaagcgtggaccgaacaacgtaacgtcgtacggtacaacgacggtagtttacgacggggcttaggtacggtcctacgggaacccggacacgtaccgactactaactacgaacgtacctaacgtagtaggttaaacttacggtaagtaaccgtaacctttaaaacgtcgtaccgaaccgtaccgtaccggtaccgtacttacttacgttgacggtacgaaggtacggacgtaacgtacgttaccctagggtaccggtaagtaacggtgtacgttaagtttacggacttacggtctttacgacgtacggttcgacggggttaccg

SEQ ID NO: 196038 - DNA, 717 bp, Homo sapiens
  misc_feature: GYAE6OF02GMYPR.36.65.F10.1.454.CMB.1.raw
  modified_base (270)..(270): a, c, t, g, unknown or other
  misc_feature (270)..(270): n is a, c, g, or t
  modified_base (376)..(376): a, c, t, g, unknown or other
  misc_feature (376)..(376): n is a, c, g, or t
tcagtacgctgtctcacgaccggtgctcgatttagctacgctctaagggggagcatcacccagcaaccacatctgtcctctagagaatcccctgagagctccgttcctcaccatggactggacctggaggatcgtcttcttggtggcagcagtcacaggagcccactccccggtgaaattggtgcaggtccggggttgaggtgacgaagcctggggcctcagtgaagtcccctgccgaggcttctggataccgtcttcaacgcctattanatacacgtggtgcgccaggcccctggaacaagggccctaggaggtggagtgggatggcgtccaaccccaacaccttgggaccgtaaccaacgaaacgtctagcaanacgtaaagttttcgaggggtccgttaggtccgtacccgttacgggaacccccggggacaacccgggttacccaacgtacccaaataaccgaacggaccccttaacgaagttacgggtaaactttaccgtaaacggttaacgtaacccgtaaaaacttccgttaacggaaacccggtaccgaaccgggtcccggttacttaacgttaccgttggacgtaccggaggacggaccgtaaggtaacgttacccgacgttacggggaagttaaggtacggtaacggtaatttacggtagttacgttacggttttagaacctacgttaccgggtacgggtaaccggg

SEQ ID NO: 196039 - DNA, 831 bp, Homo sapiens
  misc_feature: GYAE6OF02FN5GE.36.65.F10.1.454.CMB.1.raw
tcagtacgctgtctcacgaccggtgctcgatttagctacgctctaagggggagcatcacccagcaaccacatctgtcctctagagaactccctgagagctccgttcctcaccatggactggacctggaggattcgtcttcgttggtcggcaagcgagtcacgaggacgcccaccgtcccggtagtaaagttggtgcgaggttccggggttgacggttggacggaaacggtccgtagggggtccttcgaggtacgtaacggtccccctaggccgacggtcttcgtaggacttaccctcttaccgaacgtcctaattatactactacggtggttacgcgccgtaacggcccctaggaacgtaacgggtcctagggaaggtggtacggtagggtatccggtacggttaaccaaacccccgaaacgtcgtacgggaaccgtacaaacgtaaacgtcgtacggacctaacgacggtttaacggtttcccgaacgggggtcccgttgtacccgttacccgtttacgggaaccccgggtaaccgtaacggtaccctacgtaaacctaacgaacgtacgtacccgtaacacggttaaggtacgttacgaacggttacccgttaaacgtaaaacgttccgtaaacgtaaccggtacccgacgggttaacccgtacttaaccgttaagttccggtacggtaacgtagggaaaccgtcgtaacggtaccgtttaccggagttacggggaacgttaaaggtacgttaacggttaaccgttaggtaacgttcggtttcccggttttaaggtaaacttcggtttaccgggacgggttaaaccggg

SEQ ID NO: 196040 - DNA, 130 bp, Homo sapiens
  misc_feature: GYAE6OF01C1FA0.40.35.D02.1.454.CMB.1.raw
  modified_base (130)..(130): a, c, t, g, unknown or other
  misc_feature (130)..(130): n is a, c, g, or t
tcagtctagcgactcacgaccggtgctcgatttagcacacgatagttgggtttgggcacagcggccctgggctgcctggtcaaggactacttccagtcgctagactgagcgggctggcaaggcgcatagn

SEQ ID NO: 196041 - DNA, 130 bp, Homo sapiens; identical to SEQ ID NO: 196040
  misc_feature: GYAE6OF01BS04D.40.35.D02.1.454.CMB.1.raw
  modified_base (130)..(130): a, c, t, g, unknown or other
  misc_feature (130)..(130): n is a, c, g, or t

SEQ ID NO: 196042 - DNA, 130 bp, Homo sapiens; identical to SEQ ID NO: 196040
  misc_feature: GYAE6OF01AYA9C.40.35.D02.1.454.CMB.1.raw
  modified_base (130)..(130): a, c, t, g, unknown or other
  misc_feature (130)..(130): n is a, c, g, or t

SEQ ID NO: 196043 - DNA, 129 bp, Homo sapiens
  misc_feature: GYAE6OF02FISA3.40.35.D02.1.454.CMB.1.raw
  modified_base (129)..(129): a, c, t, g, unknown or other
  misc_feature (129)..(129): n is a, c, g, or t
tcagtctagcgactcacgaccggtgctcgatttagcacacgatagttgggtttgggcacagcggccctgggctgcctggtcaaggactacttccagtcgctagactgagcggctggcaaggcgcatagn

SEQ ID NO: 196044 - DNA, 130 bp, Homo sapiens; identical to SEQ ID NO: 196040
  misc_feature: GYAE6OF02I1BYU.40.35.D02.1.454.CMB.1.raw
  modified_base (130)..(130): a, c, t, g, unknown or other
  misc_feature (130)..(130): n is a, c, g, or t

SEQ ID NO: 196045 - DNA, 130 bp, Homo sapiens; identical to SEQ ID NO: 196040
  misc_feature: GYAE6OF02FT9J9.40.35.D02.1.454.CMB.1.raw
  modified_base (130)..(130): a, c, t, g, unknown or other
  misc_feature (130)..(130): n is a, c, g, or t

SEQ ID NO: 196046 - DNA, 130 bp, Homo sapiens; identical to SEQ ID NO: 196040
  misc_feature: GYAE6OF02IRXL5.40.35.D02.1.454.CMB.1.raw
  modified_base (130)..(130): a, c, t, g, unknown or other
  misc_feature (130)..(130): n is a, c, g, or t

SEQ ID NO: 196047 - DNA, 131 bp, Homo sapiens
  misc_feature: GYAE6OF02JGX1Q.40.35.D02.1.454.CMB.1.raw
  modified_base (130)..(131): a, c, t, g, unknown or other
  misc_feature (130)..(131): n is a, c, g, or t
tcagtctagcgactcacgaccggtgctcgatttagcacacgatagttgggtttgggcacagcggccctgggctgcctggtcaaggactacttccagtcgctagactgagcgggctggcaaggcgcatagnn

SEQ ID NO: 196048 - DNA, 493 bp, Homo sapiens
  misc_feature: GYAE6OF01ASE3N.4.52.E08.1.454.CMB.1.raw
  modified_base (201)..(201): a, c, t, g, unknown or other
  misc_feature (201)..(201): n is a, c, g, or t
  modified_base (470)..(470): a, c, t, g, unknown or other
  misc_feature (470)..(470): n is a, c, g, or t
  modified_base (487)..(487): a, c, t, g, unknown or other
  misc_feature (487)..(487): n is a, c, g, or t
tcagagcactgtagcacgaccggtgctcgatttagtcgagctctcagagagaaaggggaggaactgctcagttaggacccagagggaaccatggaagccccagctcagcttctcttcctcctgctactctggctcccagataccaccggagaaattgtgttgacacagtctccagccaccctgtctttgtctccagggaanagccaccctctcctgcagggccagtcagagtgttagcagctacttagcctggtaccaacagaaacctggccaggctcccaggctcctcatctatgatgcatccgacagggccactggcatcccagccaggttcagtggcaggtgggtctgggacagacttcactctcaccatcaccagcctagagctgaggtatttgctagtttattactgtcagcagcgtagcaactggcctctgctctactttcggcggagggaccgaaggtggagntacaaacgactgtcggntgcaca

SEQ ID NO: 196049 - DNA, 610 bp, Homo sapiens
  misc_feature: GYAE6OF01B8VKK.4.52.E08.1.454.CMB.1.raw
  modified_base (205)..(205): a, c, t, g, unknown or other
  misc_feature (205)..(205): n is a, c, g, or t
  modified_base (296)..(296): a, c, t, g, unknown or other
  misc_feature (296)..(296): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccgaggggaaanagcccaccctctcctgcagggccagtcagagtgtagcagctactagcctggtaaccaacagaaacctggccaggcctcccgaggcctcctnatctatgatgctatccgacacgggccacgtcggcactcccagccgtaggttcaggtcggcgtaggtcgggtctggggaacaggtaccttcactctcaaccactccaaccacgccctaagacgccgtaggaaggttatttcgacttagtttattactgtcgagctaggcgtagctaacgtcggaccttcgtcgtcctccgtacggtttccggggacgggtaacggggtaacccgtaaggggtagggaacggtaacgtaaccgaaaaacggtacgttacgggtacgggtaccctacggtacccgtaaccgttaccg

SEQ ID NO: 196050 - DNA, 499 bp, Homo sapiens
  misc_feature: GYAE6OF01ERTS0.4.52.E08.1.454.CMB.1.raw
  modified_base (204)..(204): a, c, t, g, unknown or other
  misc_feature (204)..(204): n is a, c, g, or t
  modified_base (388)..(388): a, c, t, g, unknown or other
  misc_feature (388)..(388): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaanagccaccctctcctgcagggccagtcagagtgttagcagctacttagcctggtaccaacagaaacctggccaggctcccaggctcctcatctatgatgcatccgacagggccactggcatcccagccaggttcagtggcagtgggtctgggacagacttcactctcaccatcaccagcctagancctgaggattttgctagtttattactgtcagcagcgtagcaactggcctctgctcactttcggcggagggaccgaaaggtggagatcaaaacgaactgtaggctgcactac

SEQ ID NO: 196051 - DNA, 505 bp, Homo sapiens
  misc_feature: GYAE6OF01EC9NW.4.52.E08.1.454.CMB.1.raw
  modified_base (205)..(205): a, c, t, g, unknown or other
  misc_feature (205)..(205): n is a, c, g, or t
  modified_base (432)..(432): a, c, t, g, unknown or other
  misc_feature (432)..(432): n is a, c, g, or t
  modified_base (442)..(442): a, c, t, g, unknown or other
  misc_feature (442)..(442): n is a, c, g, or t
  modified_base (496)..(496): a, c, t, g, unknown or other
  misc_feature (496)..(496): n is a, c, g, or t
  modified_base (501)..(501): a, c, t, g, unknown or other
  misc_feature (501)..(501): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagngccaccctctcctgcagggccagtcagagtgttagcagctacttagcctggtaccaacagaaacctggccaggctcccaggctcctcatctatgatgcatccgacagggccacgtggcactcccagccaggttcagtggcaggtgggtctgggacagacttcactctcaccatccaccagcctagacgcctagaggtatttgctagtttatactgtcagcagcgtancaactgcctntgctctacgttcggcggaggaccgaagggtgagactacgaaacgacgtgacggntgccnctac

SEQ ID NO: 196052 - DNA, 512 bp, Homo sapiens
  misc_feature: GYAE6OF01EG5ZS.4.52.E08.1.454.CMB.1.raw
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccgacagggccactggcatcccagccaggttcagtgcagtgggtctgggacagacttcactctcaccatcaccagcctagacgcctgaggtattttgctagtttattactgtcagcagcgtagctaacgtggcctctgctctacgtttcgggcgggagggaccgaagggtggaagactacgaaacgacgtggtggctgccacgtacg

SEQ ID NO: 196053 - DNA, 518 bp, Homo sapiens
  misc_feature: GYAE6OF01A6TEZ.4.52.E08.1.454.CMB.1.raw
  modified_base (204)..(204): a, c, t, g, unknown or other
  misc_feature (204)..(204): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaanagccaccctctcctgcagggccagtcagagtgttagcagctacttagcctggtaccaacagaaacctggccaggctcccaggctcctcatctatgatgcatccgacacgggccacgtggcatcccagccaggttcagtgcaggtggtctgggacagacttcactctcaccatcaccagcctagacgccgtgaggtatttgctagtttattactgtcagcagcgtagcaacgtcggcctctgctctaccgtttcggcggacgggaccgaagggtggacgagtaccgaaacgaacgtggtacgctcgccacgtacg

SEQ ID NO: 196054 - DNA, 513 bp, Homo sapiens
  misc_feature: GYAE6OF01BIXH3.4.52.E08.1.454.CMB.1.raw
  modified_base (204)..(204): a, c, t, g, unknown or other
  misc_feature (204)..(204): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctctcctgcagggccagtcagagtgttagcagctacttagcctggtaccaacagaaacctggccaggctcccaggctcctcatctatgatgcatccgacagggccactggcatcccagccaggttcagtggcagtgggctgggacagacttcactctcaccatcaccagcctagagcctgaggtatttgctagtttattactgtcagcagcgtagcaactcggcctctgctctctttcgggcggtacgggaccaagggttaggaggtactacgaaaacggactggtcggacttgcaccgtacg

SEQ ID NO: 196055 - DNA, 583 bp, Homo sapiens
  misc_feature: GYAE6OF01CO71I.4.52.E08.1.454.CMB.1.raw
  modified_base (205)..(205): a, c, t, g, unknown or other
  misc_feature (205)..(205): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccgaggggaaancgccaccctctcctgcagggccagtcagagtgttagcagctacttagcctaggtaccaacagaaacctggccaggcctcccaggcctcctcatctatgatgcatccgacagggccacgtggcactccccagcctaggttcaggtcggcgaggtcgggtcgtgggactagtacttcacttctcaccactccaccacgacctacgacgtccgtgtacgtatttcgtacgttagtttacttacgtgtacgagtacgagtacgtagacgtaacgtcggtccttcgtcgtccgttaccgtacgtttccgggaccgggtacgggaaccgtaagggtacggaagtactaacgaaacgtacgtacggacgtcgtacgccacgtacg

SEQ ID NO: 196056 - DNA, 508 bp, Homo sapiens
  misc_feature: GYAE6OF01EZCJ3.4.52.E08.1.454.CMB.1.raw
  modified_base (204)..(204): a, c, t, g, unknown or other
  misc_feature (204)..(204): n is a, c, g, or t
  modified_base (498)..(498): a, c, t, g, unknown or other
  misc_feature (498)..(498): n is a, c, g, or t
  modified_base (503)..(503): a, c, t, g, unknown or other
  misc_feature (503)..(503): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaanagccaccctctcctgcagggccagtcagagtgttagcagctacttagcctggtaccaacagaaacctggccaggctcccaggctcctcatctatgatgcatccgacagggccactggcactcccagccaggttcagtggcagtgggtctgggacagacttcactctcaccatcaccagcctagacgcctagaggtattttgcttagtttattactgtcagcagcgtagctaacgtcgcctctgctctcgtttcggcggagggaccgagggtgagatacgaaacgtactggtagntcgcncgtac

SEQ ID NO: 196057 - DNA, 509 bp, Homo sapiens
  misc_feature: GYAE6OF01ERV9C.4.52.E08.1.454.CMB.1.raw
  modified_base (204)..(204): a, c, t, g, unknown or other
  misc_feature (204)..(204): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaanagccaccctctcctgcagggccagtcagagtgttagcagctacttagcctggtaccaacagaaacctggccaggctcccaggctcctcatctatgatgcatccgacagggccatggcatcccagccaggttcagtggcaggtggtctgggacagacttcactctcaccatcaccagcctagagcctgacggtattttgcttagtttattactgtcagcagcgtagcaactcggccttctgcctctacgtttcggcggacgggaccgaagggtggagacgtacaaacgactggtaggctgcactag

SEQ ID NO: 196058 - DNA, 560 bp, Homo sapiens
  misc_feature: GYAE6OF01EFVBF.4.52.E08.1.454.CMB.1.raw
  modified_base (206)..(206): a, c, t, g, unknown or other
  misc_feature (206)..(206): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggcctcccagataccaccggagaaattgtgttgacacagtctccagccaccctgtctttgtctccgaggggaaanagcccaccctctcctgcagggccagtcagagtgttagcagctacttagcctggtaccaacagaaacctggccaggctcccaggctcctcatctatgatgcatccgacacgggccacgtggcactcccagccaggttcagtggcagtgggtctggacagacttcactctacaccatcaccagcctagacgcctagagtattttgcttagtttattactgtcagcagcgtagactaacgtcggccttcgtgtctacgtaccgtttcgggccggggtaacgggtacccgtaaggggtagggaagtacgtaacgaaaacggtaaccgttggtacgggtccgttcggcccgaccgtacg

SEQ ID NO: 196059 - DNA, 549 bp, Homo sapiens
  misc_feature: GYAE6OF01DQ0YQ.4.52.E08.1.454.CMB.1.raw
  modified_base (204)..(204): a, c, t, g, unknown or other
  misc_feature (204)..(204): n is a, c, g, or t
  modified_base (311)..(311): a, c, t, g, unknown or other
  misc_feature (311)..(311): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaanagccaccctctcctgcagggccagtcagagtgttagcagctacttagcctggtaccaacagaaacctggccaggctcccaggctcctcatctatgatgcatccgacncgggccactggcactcccagccaggttcagtggcagtgggtctgggacagacttcactctcacatcaccagcctagcgtcctgagtagttttgactagttttattacttgtacagcagtcgtagacgaacgtcggccttcgtcgtctcgtaccgtttcgggacgggtacgggaccgtaaggggtaggaggtagtaaccgaaacggtaacgttcggtacgggctcggccgtaccgtacg

SEQ ID NO: 196060 - DNA, 776 bp, Homo sapiens
  misc_feature: GYAE6OF01D9HES.4.52.E08.1.454.CMB.1.raw
  modified_base (205)..(205): a, c, t, g, unknown or other
  misc_feature (205)..(205): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccgaggggaaancgccacctctcctgcagggccagtcaggtgtgtagcagtcttacgtacgccgttacggtaaccaacgaacgtaaaccgtcggaccgacggtccctacccgacggtcccttcctactacttctagtgtacgtcgactaccgtcccgaacggaccgggaccctacgtcggactaccgtcccgacggtccgtaggttccgagggtcggacgtaggggttcggtacgtaggggaactacgtccgttaccacttccgacccaacctactacccgaaccgtacgtaccgtaaggacccgtaccggttaggtacggtttacttttcgacttttaagttttaccttacgtcggtaacgacgtacgaacggttaccggtaacgtaccgtacgggttcccgtccccgttgtacccggtaccgtttaacccggttaccggggtttacccgggggaaccggggtaaacccgggtaaccgggttaaacggggtaggggtaaacctaaacccggttaaacccggtaaaaccggttacgggttccgggtacgggtacccgtaccggtaaccctaacccgttaccgg

SEQ ID NO: 196061 - DNA, 556 bp, Homo sapiens
  misc_feature: GYAE6OF01CTDNP.4.52.E08.1.454.CMB.1.raw
  modified_base (208)..(208): a, c, t, g, unknown or other
  misc_feature (208)..(208): n is a, c, g, or t
  modified_base (314)..(314): a, c, t, g, unknown or other
  misc_feature (314)..(314): n is a, c, g, or t
  modified_base (362)..(362): a, c, t, g, unknown or other
  misc_feature (362)..(362): n is a, c, g, or t
  modified_base (379)..(379): a, c, t, g, unknown or other
  misc_feature (379)..(379): n is a, c, g, or t
tcagagcactgtagcacgaccggtgctcgatttagtcgagctctcaggagagaaagggggaggaactgctcagttaggacccagagggaaccatggaagccccagctcagcttctcttcctcctgctactctggctcccagatacccaccggagaaattgtgttgacacagtctccagcccaccctgtctttgtctccgaggggaaanagccaccctctcctgcagggccagtcagagtgttagcagctacttagcctggtaccaacagaacctggccaggctcccaggcctcctcatctatgatgcatccganaggaccacgtggcactcccagcctaggttcaggtcggcaggtgggtcngggacagacttcactcncacatcacagcctagacgctgaggtatttgctagtttatactgtcagctagcgtagactaacgtggccttcgtcgtcttcgtaccgtttccggggaccgggtacggggaccgtaagggtggaacggtacgtaaccgaaaacggtaaccgtggtacggccgtacggcctaaccgtacg

SEQ ID NO: 196062 - DNA, 799 bp, Homo sapiens
  misc_feature: GYAE6OF01B20B6.4.52.E08.1.454.CMB.1.raw
  modified_base (205)..(205): a, c, t, g, unknown or other
  misc_feature (205)..(205): n is a, c, g, or t
  modified_base (297)..(297): a, c, t, g, unknown or other
  misc_feature (297)..(297): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccgaggggaaangcccaccctctcctgcagggccagtcagagtgttagcagctacttagcctggtaccaacagaaacctggaccaggcctcccgaggcctcctnatctatgatcgacactcccgacgacggggccctaacgtcgggacctacgtccccgaggtcccgtaagggtttccgaagggttcggggaccgtaaggggtttcggggttccgttacggggggaaccctaacggttaacccgtttacccaaacccgtttcccttacccgaaaccccttaacttaccccgtaaacccgtaaccggtaccccgtttaaacgggaacccggttaccccgtttaagggtaaacggggtttaacgttttttacgggaaccgttttaaacgggttttttaacttttaaccgtttacggtttaccgtaaggtaccgtaacggtaccggttaacgtacccgtaaaccggttccgggtcccttacggttcgtccgttaccgttaccggtttccggggaccgggtaacgggtaacccggtaagggttacggaaggtaaccgtaaccggtaaaacggtacgttcgggtacggtaccgttcgaccgtaccgtaacg

SEQ ID NO: 196063 - DNA, 662 bp, Homo sapiens
  misc_feature: GYAE6OF01AB6UL.4.52.E08.1.454.CMB.1.raw
  modified_base (203)..(203): a, c, t, g, unknown or other
  misc_feature (203)..(203): n is a, c, g, or t
tcagagcactgtagcacgaccggtgctcgatttagtcgagctctcagagagaaaggggaggaactgctcagttaggacccagagggaaccatggaagccccagctcagcttctcttcctcctgctactctggctcccagataccaccggagaaattgtgttgacacagtctccagcccaccctgtctttgtctccaggggaangccaccctctcctgcagggccagtcagagtgtagcagctacttagcctggtaccaacagaaacctggccaggcctcccgaggcctcctcactctagtgactcgacagtcccgacacggggcccacgttggaccactccccaaggccctaagggtttcaacgggttcggacgtaagggttcggggtcgtaggggtaccaaggttaccctttcgaaccttcctaccaacccacttacccaacccgtacggcccttaacggacgtacccgttagggtaacggtttactttttacggactttaacgttttacgtttaaccgtcgttacgacgaccgtacggtcgtaacgaccgtaacgttcggtacccttcgtcgtcctacgtaccggtttcgggccgggtaacgggacccgtaagggtcggacgtacgtacgaaacgtacgtggtacggctcgcctactacg

SEQ ID NO: 196064 - DNA, 567 bp, Homo sapiens
  misc_feature: GYAE6OF01CEI8U.4.52.E08.1.454.CMB.1.raw
  modified_base (204)..(204): a, c, t, g, unknown or other
  misc_feature (204)..(204): n is a, c, g, or t
  modified_base (313)..(313): a, c, t, g, unknown or other
  misc_feature (313)..(313): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagcccaccctgtctttgtctccaggggaangccaccctctcctgcagggccagtcagagtgttagcagctacttagcctaggtaccaacagaaacctggaccaggcctcccaggcctcctcatctatgatgcatccganacgggccacgtggcatcccagccctaggttccaggtcggctaggtcgggtctggggaacaggacctttcgaccttctacaccactccaccagacctagacgcctaggagtatttgactagtttactacgtgtcgagtcagcgtagccaacgtcggcctctgtcctcgtacgtttcgggccggtaagggaccgtaagggtggaacggtactaaccgaaaacgtacgtacggtacgggtacctacggccacgtacg

SEQ ID NO: 196065 - DNA, 763 bp, Homo sapiens
  misc_feature: GYAE6OF01ACIU1.4.52.E08.1.454.CMB.1.raw
  modified_base (206)..(206): a, c, t, g, unknown or other
  misc_feature (206)..(206): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagcccaccctgtctttgtctccgaggggaaangcccaccctctcctgcgagggccagtcagagtgttagcagctacttagcctggtaccaacagaacctggccaggcctcccaggcctcctcatctatgatgcagtcccgacgacgggcccacgtcggcctactccccgaggccctacgggtttccaagggttcggacgtaggggttcggggtacgtacgggggtaacctacgggtaccctttccgtaccctttcccgttacccaacccgtaacgttacccaacccgtacggtaccccgtaacgggaaccggtcccggttagggtaacgggtttaacgttttttacgggaccgtttaaggttttttaacctttaaccgttacggttaccgtaacggtaccgtaacggtaccggttaacggacccgttaaacggttccgggtcccttacggtccgtacccgttccgttaccggtttccggggaccggggtaaccggggtaacccgtaagggggtacggtaaacggtaacgttaacccggaaaaccgttacggttacgggttacggacccgttcgacccgtaaccgttacg

SEQ ID NO: 196066 - DNA, 512 bp, Homo sapiens
  misc_feature: GYAE6OF01A4G8O.4.52.E08.1.454.CMB.1.raw
  modified_base (204)..(204): a, c, t, g, unknown or other
  misc_feature (204)..(204): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctctcctgcagggccagtcagagtgttagcagctacttagcctggtaccaacagaaacctggccaggctcccaggctcctcatctatgatgcatccgacagggccactggcatcccagccaggttcagtggcagtgggtctgggacagacttcactctcaccatccacagcctagacgcctgagtatttgctagtttattactgtcagcagcgtagcacgtggcctctcgctcgtacgtttcggacggacgggaccgaagggtggagacgtacaaacgacttggtacggactgccgactacg

SEQ ID NO: 196067 - DNA, 511 bp, Homo sapiens
  misc_feature: GYAE6OF01BL6PD.4.52.E08.1.454.CMB.1.raw
  modified_base (204)..(204): a, c, t, g, unknown or other
  misc_feature (204)..(204): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctctccagcagggccagtcagagtgttagcagctacttagcctggtaccaacagaaacctggccaggctcccaggctcctcatctatgatgcatccgacagggccacgtggcatcccagccaggttcagtggcagtgggtctgggacagacttcactctcaccatcaccagcctagacgcctgagtatttgctagtttatactgtcagcagcgtagcaacgtggcctctgcttctacgttcggcggacgggaccgaagggtggagtatacgaaacgacgtggtacggactcgccacgtacg

SEQ ID NO: 196068 - DNA, 747 bp, Homo sapiens
  misc_feature: GYAE6OF01AHSMN.4.52.E08.1.454.CMB.1.raw
  modified_base (205)..(205): a, c, t, g, unknown or other
  misc_feature (205)..(205): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccgaggggaaangccaccctctcctgcagggccagtcagagtgttagcagctacttagcctggtaccaacagaaacctggccaggcctcccgaggcctcctcatctatgatgcataccgacgacgggcccacgtcggccaacgtccccagccctaacgggtttccaagggttgggaccgagggttcgggggtctgggggaacctaggtacctttccgaccttccgtacccaaccctacgtacccaacccgacggtaccccttaacggaaccgtacccgttacggtaacgggtttacgtttttacggtaccgtttaacggtttttaacgtttaacgtttacggttaccgtaaggtaccgtaacggtaccggttaacgaccgtaaaccgttccgggtacccttccgttaccgtccgttccgttaccggttttccggggaccgggtaacgggggtacccggtaaacggggttacggggaacggtaaccgttaaccggtaaaaaccggttaaccggttacgggttacgggtaccgttacggaccgtaacccgttaacg

SEQ ID NO: 196069 - DNA, 515 bp, Homo sapiens
  misc_feature: GYAE6OF01EXNT3.4.52.E08.1.454.CMB.1.raw
  modified_base (205)..(205): a, c, t, g, unknown or other
  misc_feature (205)..(205): n is a, c, g, or t
  modified_base (506)..(506): a, c, t, g, unknown or other
  misc_feature (506)..(506): n is a, c, g, or t
  modified_base (508)..(508): a, c, t, g, unknown or other
  misc_feature (508)..(508): n is a, c, g, or t
  modified_base (512)..(512): a, c, t, g, unknown or other
  misc_feature (512)..(512): n is a, c, g, or t
  modified_base (515)..(515): a, c, t, g, unknown or other
  misc_feature (515)..(515): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccgaggggaaanagccaccctctcctgcagggccagtcagagtgttagcagctacttagcctggtaccaacagaaacctggccaggctcccaggcctcctcatctatgatgcatccgacacgggccacgtggcactcccagccaggttcaggtggctaggtgggtctggggacagtacttcactcctacaccatccaccacgcctagacgccgtgaggtatttgactagtttattctgtcagcgagcgtagctaacgtgcctctcgctcgtcgttcggcggaggaccgtaggtaggagacgacgaacgactgngncgcnctn

SEQ ID NO: 196070 - DNA, 607 bp, Homo sapiens
  misc_feature: GYAE6OF01DBUMQ.4.52.E08.1.454.CMB.1.raw
  modified_base (232)..(232): a, c, t, g, unknown or other
  misc_feature (232)..(232): n is a, c, g, or t
  modified_base (437)..(437): a, c, t, g, unknown or other
  misc_feature (437)..(437): n is a, c, g, or t
  modified_base (581)..(581): a, c, t, g, unknown or other
  misc_feature (581)..(581): n is a, c, g, or t
  modified_base (597)..(597): a, c, t, g, unknown or other
  misc_feature (597)..(597): n is a, c, g, or t
  modified_base (601)..(602): a, c, t, g, unknown or other
  misc_feature (601)..(602): n is a, c, g, or t
tcagagcactgtagcacgaccggtgctcgatttagtcgagctctcagagaggaaagggggaggaactgctcagttaggacccagagggaaccatggaacgccccagctcagcttctcttcctcctgctactctcggctcccagactaccacggagtaaattgtgtgacacagtctccacgcccacccgtgttctttcgtcgtaccgaagggaaacgcgcccaccctctccgngcgacgggccagtcagtagtgtagcagtctacgttacgccgtaggaaccaacgacgaaaccgtcggaccacggcctcccgacgcctcctatactactatgactcgacactaccgacgacggccagtcgactaccgaccgacgccgtaggtcgaggtcggacgtagggtcggtacggtggactacgtactacactctaccactacncccgaaccgagtaccgtaacggactcggtaggtaaggtttattacgggacttaaggttttactaccgttggaacctaggacgtaacggtcgtaacgtacgtacgtccgtctacgtcgactcggtacgtgggacgacgacggagnacacgtacaagcgtgngacnncagtc

SEQ ID NO: 196071 - DNA, 694 bp, Homo sapiens
  misc_feature: GYAE6OF01ET3DE.4.52.E08.1.454.CMB.1.raw
  modified_base (205)..(205): a, c, t, g, unknown or other
  misc_feature (205)..(205): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccgaggggaaanagccaccctctcctgcagggccagtcagagtgttagcagctacttagcctggtaccaacagaaacctggccaggctcccaggctcctcatctatgatgcactccgacgacgggccacgtcggccactcccagcctaggttcgagtggcgtaggtcgggtccgtaggggactacggtaccttacgaccttcctccaacctactcccaaccgacgtacccgtaaggacgtacccgtggacgggtttaactttttcggacgtttaagtttttacgtttaaccgttcggtacgtaacggtcgtaacggtcccggttaaacgaccgtaaacccggttcgggtcccttcgttcggtacccttcccggttaaccggttttccgggggacccggggaaacggggtacccggtaaaggggttacgggaacgtaaacgttaaccgaaaaccgggttaacgtggggttacggacccgttacgtaccgtaacccgttaacg

SEQ ID NO: 196072 - DNA, 585 bp, Homo sapiens
  misc_feature: GYAE6OF01EOJ7C.4.52.E08.1.454.CMB.1.raw
  modified_base (206)..(206): a, c, t, g, unknown or other
  misc_feature (206)..(206): n is a, c, g, or t
tcagagcactgtagcacgaccggtgctcgatttagtcgagctctcagagaggaaagggggaggaactgctcagttaggacccagagggaaccatggaagccccagctcagcttctcttcctcctgctactctggctcccagataccaccggagaaattgtgttgacacagtctccagccaccctgtctttgtctccgaggggaaancgccaccctctcctgcagggccagtcagagtgtagcagctacttagcctggtaccaacagaaacctggccaggcctcccgaggcctcctcatctatgatgcagtccgacgacgggccacgtggcatcccagccaggttcaggtggcaggtgggtctgggacagtacttcgactctcaccatccaccagcctagacgccgtagagtatttgcttagtttatacgtgtcagcaggtcgtagacctaacgttcgggcccttcgtcgtccgttaccgtaccggtttccggggaccggggtaacggggaacccgtaagggggtaggaacggtacgtaaaccgaaaaccggtaacgttgggtacgggacctcggaccaccgtacg

SEQ ID NO: 196073 - DNA, 758 bp, Homo sapiens
  misc_feature: GYAE6OF01EOE7Z.4.52.E08.1.454.CMB.1.raw
  modified_base (205)..(205): a, c, t, g, unknown or other
  misc_feature (205)..(205): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccgaggggaaanacgcccacccgtctcctgcgagggccagtcagtagtgttagcagtctacgttagccttaggtaacccaacgaacgtaaaccctgggacccgaacgggtcctacccgaggtcccttaccctactaacttccttaagtcggtaacttcggacctaaccgtacccggaaccggacgggtccccacgttcgggaccctaaccgttccccgaaggtcccgtaagggtttccaagggtcggaccggtagggttcgggtacgtacggggtaactaacggttccttaccgaccttccgtacccgaacctataccccgaaacctacggtaccctaaggtacccgtccgttaagggtaacggtttacttttacggacgtttaagttttacgttacgtcgtacgtaggaccgtaggtacgtaacgcgtaacgtcggttccctacgttccgtaccgttaccggtacgggttccgggacgggtaaaccgggtacggtaaggggtacggaaacgtaaccgaaccggtaaaacgtcgttagggaccgtactacgaccctaacgttccg

SEQ ID NO: 196074 - DNA, 652 bp, Homo sapiens
  misc_feature: GYAE6OF01BY1Y8.4.52.E08.1.454.CMB.1.raw
  modified_base (204)..(204): a, c, t, g, unknown or other
  misc_feature (204)..(204): n is a, c, g, or t
  modified_base (288)..(288): a, c, t, g, unknown or other
  misc_feature (288)..(288): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccacgccaccctgtctttgtctccgagggaancgccacctctcctgcgaggccagtcagagtgtagcagctactagcctggtaccaacagaacctggccaggctcccaggctcctnatctatgactgcacgtaccgagacgggtccagtcggcacctcccagacccgtaggttcacgggttggacgtaggttcgggtcaggggaccaggtacgttcaccgtctccgaccactccaactacgcccgttagacgtccgtaggtacgttactttgaccgtttagttttactaccgtgtacagtcgacgtacggttacgaccgtaacgtccggtaccttaccgttcggtacccttacggttaccgggttaccggggtcccgggtaaaccggggaacccggttaaggggtaacggaacgttaaaccgtaaaccggtaaaacggacgtttacggggacggtaccgtaccggacgttaacccgtacg

SEQ ID NO: 196075 - DNA, 850 bp, Homo sapiens
  misc_feature: GYAE6OF01CP6KD.4.52.E08.1.454.CMB.1.raw
  modified_base (204)..(204): a, c, t, g, unknown or other
  misc_feature (204)..(204): n is a, c, g, or t
tcagagcactgtagcacgaccggtgctcgatttagtcgagctctcagagaggaaagggggaggaactgctcagttaggacccagagggaaccatggaagccccagctcagcttctcttcctcctgctactctggctcccagataccaccggagaaattgtgttgacacagtctccagccacctgtctttgtctccgaggggaanacgccaccctctcctgcgagggccagtcagagtgttagcagcttacgttacgccgtaggtaaccaaacaacggtaaaacctcgggaccctaagggccctcccgaacgggtccttaccctactacttacctaagttggaacttcgacctaacgtacccggaacgacgggaccctaacgtcgggacctaccgtacccccgaaggtcccgtaagggttccaagggttcgggaccgtaggggttcgggtacgtacgggaactacggtaccctttcgaaccgttcctacctaaccctaacgtacccaacccgtaaccgtacccgttaaacggtacggttaccccgttaaggggtaaccggtttacgtttttacgggtacccgttttaaaggtttttaaccgtttaccgtttacggttaccggtaacggtaccgtaacgggttaccgtaacggtaccgtaaacccggttccggtacccgttccttaacggtccgttaacccgtttaccgggtttaccgggggaccggggtaaccgggtaaaccggtaacggggttacgggaacgtaaaccggttaaacccgggaaaaacccgggttacggttaaccgggttacgggtacccgtaacgggttaaccccgtaccggtttaaccg

SEQ ID NO: 196076 - DNA, 535 bp, Homo sapiens
  misc_feature: GYAE6OF01AS0A9.4.52.E08.1.454.CMB.1.raw
  modified_base (204)..(204): a, c, t, g, unknown or other
  misc_feature (204)..(204): n is a, c, g, or t
  modified_base (367)..(367): a, c, t, g, unknown or other
  misc_feature (367)..(367): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaanagccaccctctcctgcagggccagtcagagtgttagcagctacttagcctggtaccaacagaaacctggccaggctccaggctcctcatctatgatgcatccgacagggccacgtggcatcccagccaggttcagtgcagtggtctgggacagacttcactcncacatcaccagcctagacgcctgaggtattttcgctagtttacttactgtcagctagcgtagcaacgtcggcctctcgctcgtacgtttcggcgggtacgggtacccgaagggttggaagtacgtaccgtaaaacgacgtcggtacggacctacgaccgaccgtaacg

SEQ ID NO: 196077 - DNA, 536 bp, Homo sapiens
  misc_feature: GYAE6OF01EXBX8.4.52.E08.1.454.CMB.1.raw
  modified_base (205)..(205): a, c, t, g, unknown or other
  misc_feature (205)..(205): n is a, c, g, or t
  modified_base (530)..(530): a, c, t, g, unknown or other
  misc_feature (530)..(530): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacaatctccagccaccctgtctttgtctccgaggggaaanagccaccctctcctgcagggccagtcagagtgttagcagctacttagcctggtaccaacagaaacctggccaggcctcccaggcctcctcatctatgatgcatccgacgagggccacgtggcactcccagcctaggttcaggtggctaggtcgggtctgggacaggaccttcgactctcacctatccaccagcctagacgcctaggagtatttcgctagttttatactgtcagcagtcgtagacacgtggccttcgtgcctcgtacgttcgggaggtacgggacgaggtggaagacgtaccgaaagacgtggtacgacgtcgccncgtacg

SEQ ID NO: 196078 - DNA, 917 bp, Homo sapiens
  misc_feature: GYAE6OF01CYFWJ.4.52.E08.1.454.CMB.1.raw
  modified_base (202)..(202): a, c, t, g, unknown or other
  misc_feature (202)..(202): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccacggagaaattgtgttgacacagtctccagccacctgtctttgtctccgagggaaanacgccacctctcctgcacgggccagtcagagtgtagcagctacttacgcctaggtaacccaacgtacgaaaacccgtcggaccgtaacgggcccttaccccgaagggtccctacctacgtaacttccttaagtgtattggttaacgtacccggaacgacggggacccctaacgttcgggacctaaccgtccccgtaacggcccgtaaacggggttttccaacggggttcgggtaccgtaacggggtttcgggggttacccgtacgggggggtaacctaacggggttaacccttttccgaaccccggttttaccaacccctaacccgtaaccgttacccctaaaccccgaacggtaccccgttaaacggaaccggtccccgttaagggtaacgggtttacgtttttttacggaacccgttttaagggttttttaaacttaaccggttcggtttaacccgtaacgggtaccgttaacgggtttaacccgttaacggaacccgttaaccggtttccggggtccctttaccgggttacgtaccccgtttccggtttaaaccgggttttccggggggaacccggggtaaccggggttaaaacccgggaacgggggttaacgggtaaaccggtaaacccggtttaaacccgaaaaaccggggttacggttaccggttacggggaacccttaccggtaaccccggacttaccggtttacccg

SEQ ID NO: 196079 - DNA, 581 bp, Homo sapiens
  misc_feature: GYAE6OF01EFEVK.4.52.E08.1.454.CMB.1.raw
  modified_base (204)..(204): a, c, t, g, unknown or other
  misc_feature (204)..(204): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccgaggggaanagccaccctctcctgcagggccagtcagagtgttagcagctacttagcctggtaccaacacgaaacctggaccaggcctcccgaggcctcctcatctatcgatgcagtccgacgacgggccacgtggccactcccagcctaggttcagtggctaggtgggtctgggacagacttcactctacaccatccaccagcctagacgcgtagtagtatttgcgttagtttattactgtacagctagcgtagcctaacgtcggtccttcgtcgtccttccgtaccgtttccggggacgggtacgggtaacccggtaaggggtcggaacgtacgtaaccgtaaaacggtaaccgttcgggtacggacctacgacctaccgtacg

SEQ ID NO: 196080 - DNA, 549 bp, Homo sapiens
  misc_feature: GYAE6OF01AVO5O.4.52.E08.1.454.CMB.1.raw
  modified_base (205)..(205): a, c, t, g, unknown or other
  misc_feature (205)..(205): n is a, c, g, or t
  modified_base (378)..(378): a, c, t, g, unknown or other
  misc_feature (378)..(378): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccgaggggaaanagccaccctctcctgcagggccagtcagagtgttagcagctacttagcctggtaccaacagaaacctggccaggctcccaggctcctcatctatgatgcatccgacagggccacgtggcactccccagccaggttcagtggcagtgggtctgggacagacttcactctcaccntcagcacgcctgcagtctagactgtatgttcgcttagtttacttcgtgttcatactaattgtaggtcgacccggtcctacggttccggaccgtaaacgggaccgtaaagggtacggaaactaccgtaaaacggaaccttgggtacggtcctacgaccaactgttcgttacg

SEQ ID NO: 196081 - DNA, 531 bp, Homo sapiens
  misc_feature: GYAE6OF01DH2SB.4.52.E08.1.454.CMB.1.raw
  modified_base (205)..(205): a, c, t, g, unknown or other
  misc_feature (205)..(205): n is a, c, g, or t
  modified_base (265)..(265): a, c, t, g, unknown or other
  misc_feature (265)..(265): n is a, c, g, or t
  modified_base (314)..(314): a, c, t, g, unknown or other
  misc_feature (314)..(314): n is a, c, g, or t
  modified_base (363)..(363): a, c, t, g, unknown or other
  misc_feature (363)..(363): n is a, c, g, or t
  modified_base (391)..(391): a, c, t, g, unknown or other
  misc_feature (391)..(391): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccgaggggaaangccaccctctcctgccagggcccagtcagagtgttagcagctacttagcctggtaccaanagaaacctggccaggctcccgaggcctcctcatctatgatgcatccganagggccagtggcactcccagcctaggttcaggtgcaggtggtctggacngacttcactctcacatcaccagcctagngcctagagtatttgcttagtttattactgtacacgctagtcgtagactaacgtcggtccctgtcgtctcgtaccgttcggacggtacgggaccgaagggtggagtactacgaaacgacgttggacgcttcgctacgtacg

SEQ ID NO: 196082 - DNA, 645 bp, Homo sapiens
  misc_feature: GYAE6OF01AV4RD.4.52.E08.1.454.CMB.1.raw
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagcccaccctgtctttgtctccgaggggaaagcgcccaccctctcctgcagggccagtcagagtgtagcagctacttagcctggtaccaacagaaacctggccaggcctcccgaggcctcctcatctatgatgccatcccgacgacgggccctacgtcgggccactcccgagcccgtaaggttccaggtcggacgtaggttcggggtctggggaactacggtactttccgactcctaccaacctactaccaccgtacgccgtaacgacgtaccgtaggtacggttattttcggactttagtttacttacgtggtactaggactaaggtccgtaagtaccgtaacgtcggtaccttcgtgtcctccgttacggttccggggacggtaaccggggtaaccgtaaggggttacggaacggtaacgtaaccgaaaacggttacgtcgggtaccgtacgtcgacccgtaccgtacg

SEQ ID NO: 196083 - DNA, 573 bp, Homo sapiens
  misc_feature: GYAE6OF01A9U2Q.4.52.E08.1.454.CMB.1.raw
  modified_base (205)..(205): a, c, t, g, unknown or other
  misc_feature (205)..(205): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccgaggggaaangccaccctctcctgcagggccagtcagagtgtagcagctacttagcctggtaaccaacagaaacctggccaggctcccgaggcctcctcatctatgactgcatccgagacgggccacgtcggcactccgagcctaggttcaggtgcgaggtcgggtcgtgggacagtaccttcactcctacacatccaccacgcctaagacgtccgtaggtaggtactttgacttagtttacttacgtgtcacgcgtagacgtagacctaacgtcggtccttcgtcgtcctacgtaccgttcggggacggtacgggtaacgaagggtaggacgtacgtaacgaaacggtacgttggtacggaccgtacgccacgtacg

SEQ ID NO: 196084 - DNA, 595 bp, Homo sapiens
  misc_feature: GYAE6OF01CIAVQ.4.52.E08.1.454.CMB.1.raw
  modified_base (205)..(205): a, c, t, g, unknown or other
  misc_feature (205)..(205): n is a, c, g, or t
  modified_base (266)..(266): a, c, t, g, unknown or other
  misc_feature (266)..(266): n is a, c, g, or t
  modified_base (317)..(317): a, c, t, g, unknown or other
  misc_feature (317)..(317): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccgaggggaaancgccaccctctcctgcagggccagtcagagtgttagcagctacgttagcctaggtaccaanacgaaacctggcccaggcctccgaggcctcctcatctatgatgcatccgancgggccacgtggccactcccgagccgtaggttccagggtcggactagggtcgggtctaggggactagtacttccactcctacaccactccaccgacgtccgtacgacgtccgtaggtaggtattttcgacttagtttacttacgtgtcgtagcgtacgtcgtagccgtaacgtcgtccttcgtcgtcgtcgttaccgttcgggacggtacgggaccgtagggtacggaaggtacgtaacgaaacggtacgttacggtacgtccgtagccctacgtacg

SEQ ID NO: 196085 - DNA, 672 bp, Homo sapiens
  misc_feature: GYAE6OF01DGDPI.4.52.E08.1.454.CMB.1.raw
  modified_base (205)..(205): a, c, t, g, unknown or other
  misc_feature (205)..(205): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccgaggggaaangccaccctctcctgcagggccagtcagagtgttagcagctacttagcctggtaccaacacgaaacctggccaggcctccaggtctcctcatctatgatgcactccgacgacgggccacgtggccactcccgagcctaggttcaggttggcgtagggtcgggtcgtagggaacctggtaccttccaacgttcctaccaaccctacgtacccaacccgacgtacccgtaacggtaccgtccgttacggtaaggttacgtttttacggtactttaaggtttttaacttacgttacgttacgaacgtcgtacggtacgttacgtaccgtaacgttcggtcccttcgttcgtccttaccgtaccggtttccggggaccggggtaggggtaacccggtaagggtacgggtaacggtaacgtaaccgtaaaaccggtaacgttcggtacggtaccgtacgccgtaacccgtacg

SEQ ID NO: 196086 - DNA, 764 bp, Homo sapiens
  misc_feature: GYAE6OF01BKSD8.4.52.E08.1.454.CMB.1.raw
  modified_base (206)..(206): a, c, t, g, unknown or other
  misc_feature (206)..(206): n is a, c, g, or t
tcagagcactgtagcacgaccggtgctcgatttagtcgagctctcgagagagaaagggggaggaactgctcagttaggacccagagggaaccatggaagccccagctcagcttctcttcctcctgctactctggctcccagactaccaccggagaaattgtgttgacacagtctccagccaccctgtctttgtctccgaggggaangcccaccctctcctgcgacgggccagtcagagtgttagcagctacttagcctggtaaccaacgaagaaaccctggacccacgggcctcccgaggcctccctcatcctatgtatgcactccgacgacgggcccacgttcggcctactccccgaaggcccgtaacgggtttcgaaggttcgggaccgtaggggtttcggggttccggtcggggtaacaacggttacctttaccgaaccgttccttaccaacccgtaacgttaccccgaacccgaacgtacccgttaacgggaccgtaccgttagggtaacgggtttaatttttcgacgttttaagttttacctttaccgttacggttactaacggtaccgtaagggtaccgtaacggtacccgtaacggttccgggtacccctttacggttccgtccctttaaccggtacccgggttttcgggggaaccgggaacgggggtaacccgtaaagggggttacgggtaaacggtagtaaacccggtaaaacggacccggttgggttacggtacgtccggtacccacggttacg

SEQ ID NO: 196087 - DNA, 701 bp, Homo sapiens
  misc_feature: GYAE6OF01BEC3R.4.52.E08.1.454.CMB.1.raw
  modified_base (204)..(204): a, c, t, g, unknown or other
  misc_feature (204)..(204): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccgaggggaangccaccctctcctgcagggccagtcagtagtgttagcagtcttacttacgcctaggtaccaacagaaacctggaccaggcctacccaggtcctcctcactctatgatcgacactacccgacgtacgggccacgtcggacactcccgacgtccgtaggttcgacggtggacgagggttcgggtacgtgggaactacgtaccttacaccgttcctaccaacctacgtacccaaccgtacgtacccgttaacggaccggtaccgtaggttaacggtttacgtttttcggtacctttaacggtttttaactttaccgttacgttaccgaacggtccgtaacgggtcgttaacgtaccgtaacgttcccggtaccttccgttcgtaccttccgttaccgggttccgggaccgggtaacgggtaaccggtaacggggttggaaaccggtaacttaaccgaaaaccgttacggtacggtcggacgttccgaccgtaccgttacg

SEQ ID NO: 196088 - DNA, 559 bp, Homo sapiens
  misc_feature: GYAE6OF01D7FDB.4.52.E08.1.454.CMB.1.raw
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcagctacttagcctggtaccaacagaaacctggccaggcctcccaggctcctcatctatgatgcatccgacacgggccacgtggcactcccagccaggttcaggtggcaggtgggtctgggacagacttcactctacaccatcaccagcctagacgtcctagaggtattttcgacttagttttacttacgtgtcacgcagtcgtagactaacgtcggccttcgtactccgtacgtttcgggacgggacgggaaccgtaagggtcggaagtacgtaaccgaaacgtaagtacgggtcggacgtacgacaccgtgttaccg

SEQ ID NO: 196089 - DNA, 658 bp, Homo sapiens
  misc_feature: GYAE6OF01DDEXW.4.52.E08.1.454.CMB.1.raw
  modified_base (208)..(208): a, c, t, g, unknown or other
  misc_feature (208)..(208): n is a, c, g, or t
  modified_base (310)..(310): a, c, t, g, unknown or other
  misc_feature (310)..(310): n is a, c, g, or t
  modified_base (373)..(373): a, c, t, g, unknown or other
  misc_feature (373)..(373): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagatacccaccggagaaattgtgttgacacagtctccagcccaccctgtcttttgtctccgaggggaaanagcccaccctctcctgcagggccagtcagagtgttagcagctacttgcctggtaccaacagaacctggccaggctccagctctcatctatgatgcatccganacgggccacgtggcacgtcccaggcctaggttccaggtggacgtaggtcgggtctggggaacncgtacttcgacctctacactactaccaccacgactacgacgtccgtaggtacggttatttttcggactttaacggtttttaacttaacgttcgttaacgtacgtaccgtaacgggtcggtttaacgaaccggttaaccgttcgggtcccgtttctacggttcccttaccggttaacccggttttaccgggggaccgggtaaacggggacccggttaaaggggtacgggaagtacgtaaaccgaaacgggtaaacgttcggtacggtcttaccggctaaccgtacg

SEQ ID NO: 196090 - DNA, 669 bp, Homo sapiens
  misc_feature: GYAE6OF01D7X7L.4.52.E08.1.454.CMB.1.raw
  modified_base (205)..(205): a, c, t, g, unknown or other
  misc_feature (205)..(205): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccgaggggaaanacgcccaccctctcctgcagggccagtcagagtgtagcagctacttagcctaggtaccaacagaaacctggaccaggcctcccgaggcctcctcatctatgatcgcagtccgacgacgggccacgtggcactcccagtccaggttcaggtcggacgtagggtcgggtcgtaggggacacggtaccttcgacttcctaccacctactccaaccgacgacccgtaaggacgtcctaggtaaggttacttttcggactttaacggttttactttaaccgttgtacgtacggtaccgtaggtaccggttaacgacctaaacgtccgggtacccttcgttacgccgtttacccgttaccgggtttccggggaccggggtaacggggaacccgtaaaggggttagggaacgtaacgtaaccgaaacggttaacggttcggtacgggtcctacggaccctaacggttaccg

SEQ ID NO: 196091 - DNA, 668 bp, Homo sapiens
  misc_feature: GYAE6OF01BTD37.4.52.E08.1.454.CMB.1.raw
  modified_base (203)..(203): a, c, t, g, unknown or other
  misc_feature (203)..(203): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaattgtgttgacacagtctccagccaccctgtctttgtctccgagggaagngccaccctctcctgcagggccagtcagagtgttagcagctactagcctggtaccaacagaacctggccaggcctcccgaggcctcctcatctatgatcgcatccgacacgggcccacgtggaccactcccagccgtaggttcaggtggactaggtgggtcgtacggggacacggtaccttctaccgttcctaccgaacctacgtacccaacccgacgtaccctaagggacccgtacccgttaggtaacggttacgtttttacggaccttttaaggtttttaactttacgttacgtacgtaacgtacgtacggtcgttaacgaccgtaaccggttccggtccttacgttcgtaccgttcgtaccggtttcggggaccggggtaacgggtaacccggtagggtagggaacgtacgtaaccggaaaccgtacggttcgggtacgtacgtccgtaaccgtaccttaccg

SEQ ID NO: 196092 - DNA, 578 bp, Homo sapiens
  misc_feature: GYAE6OF01C4IR5.4.52.E08.1.454.CMB.1.raw
  modified_base (204)..(204): a, c, t, g, unknown or other
  misc_feature (204)..(204): n is a, c, g, or t
  modified_base (292)..(292): a, c, t, g, unknown or other
  misc_feature (292)..(292): n is a, c, g, or t
  modified_base (572)..(572): a, c, t, g, unknown or other
  misc_feature (572)..(572): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccacggagaaattgtgttgacacagtctccagccacctgtctttgtctccgaggggaaaangcccaccctctcctgcgagggccagtcagagtgttagcagacttacttagcctggtaccaacagaaactggtcaggctccaggctccncatctatgatcgcacgtccgacgacggccacgtcggcactccccagccgtaggttcagtggctaggtgggtcgtggactgacttcacgtctaccacactaccacacgcctaaggacgtccgtaggtaagttcgttttacgacttaagtttactacgtgtacgagtcgagtacgtagaccgtaactcggccttcgtgtcctacgtaccggtttcgggggaccggggtacggagggtacggaagtacgtaacgaaacgtagtgtcggactcggaccaccgtnttaccg

SEQ ID NO: 196093 - DNA, 618 bp, Homo sapiens
  misc_feature: GYAE6OF01EKYS0.4.52.E08.1.454.CMB.1.raw
  modified_base (203)..(203): a, c, t, g, unknown or other
  misc_feature (203)..(203): n is a, c, g, or t
  modified_base (342)..(342): a, c, t, g, unknown or other
  misc_feature (342)..(342): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccgagggaanagccacctctcctgcagggccagtcagagtgttagcagctactagcctggtaccaacacgaaaccgtggaccaggcctcccgaggcctcctcactctagtgatcgactacgtcccgaacgacgggcccacgtcggaccntacgtcccgacgtaccgtacggtacgaggtcggacgtacggtgggtacgtacgggactacgtaccgttacctacgttcctaccaccgtactaccgaccgtacgtaccgtaacggacgtccgtaggtaacgttactttagtacttacgtttacttacgtcgtacacgtcgacgtacggtacgtacgtacgtcgtactcgtcgacctcgtacggttacgggacggtacggtacgtagggacgacgagtaacgaacgtacgtggtacgcgtcgcctacg

SEQ ID NO: 196094 - DNA, 743 bp, Homo sapiens
  misc_feature: GYAE6OF01CFZI2.4.52.E08.1.454.CMB.1.raw
  modified_base (203)..(203): a, c, t, g, unknown or other
  misc_feature (203)..(203): n is a, c, g, or t
  modified_base (262)..(262): a, c, t, g, unknown or other
  misc_feature (262)..(262): n is a, c, g, or t
  modified_base (336)..(336): a, c, t, g, unknown or other
  misc_feature (336)..(336): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagactaccgaccggagaaattgtgttgacacagtctccagccacctgtcttgtctccgagggaancgccacctctcctgcacgggccagtcagagtgtagcagctacttagcctggtaaccaanacgaaacctggacctacggcctcccgaggcctctctactctatgatcgctacgtccggacgacgggccctacgnggaccacgtcccgagtcccgtaggttccaaggtcggccgtagggttcgggtcgtacgggaactacgtacctttcgaccctcgtaccaacctacgtaccaacccgtacgtaccgttaacggaccgtaccgttacggtaacggtttaacgttttacggtaaccgtttaacggtttttaacgtttacgttacgggttaaccctaggtacccgtaacgggttacggtaaccggtaaccgtaaacccggttccgggtacccgtttccgtaccggttcccgttaacccggttaccgggtttcccgggggaaaccggggtaaccggggtaaacccggtaaggggtacgggaaacgtaccgtaaacgtaaaaccggtacgtacgggttacgacgttacggacccgtaacgttacg

SEQ ID NO: 196095 - DNA, 661 bp, Homo sapiens
  misc_feature: GYAE6OF01CQCS3.4.52.E08.1.454.CMB.1.raw
  modified_base (208)..(208): a, c, t, g, unknown or other
  misc_feature (208)..(208): n is a, c, g, or t
tcagagcactgtagcacgaccggtgctcgatttagtcgagctctcagagaggaaagggggaggaactgctcagttaggacccagagggaaccatggaagccccagctcagcttctcttcctcctgctactctggctcccagataccaccggagaaattgtgttgacacagtctccagcccaccctgtctttgtctccgaaggggaaanacgccaccctctcctgcagggccagtcagagtgtagcagtctacttagctggtaccaacagaaacctggaccaggcctcccaggcctctcatctatgatcgacatcccgaacacgggccaacgtcggcaacgtccccgagcctaaggttccaggttggacaggtgggtacgtgggactagctttcgacttccacaccactccaaccgacgtaccgtaagacgtccgtaggaaggtagttttgacgttaagtttaacttacgtagtacctaggcctaaggtaccgttaagcccgtaaacgttcgggtccctcgttacgtactccgttaaaccgggtttccggggaaccgggtaacggggtaaccccggtaaagggttagggaacggttaaacgtacccggtaaaaacggttacgttacgggtacgggaccttacgggaccctaacccggttacg

SEQ ID NO: 196096 - DNA, 753 bp, Homo sapiens
  misc_feature: GYAE6OF01BP386.4.52.E08.1.454.CMB.1.raw
  modified_base (204)..(204): a, c, t, g, unknown or other
  misc_feature (204)..(204): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccgaggggaangcccaccctctcctgcagggccagtcagagtgtagcagctacttagcctggtaccaacagaaacctggccaggcctcccaggctcctcatctatgatcgcacgtccgacgacgggcctacgtcggccactcccgacgtccgtaggttccgaggtcggacgtaggtcggggtacctaggggacacgggtacctttccgaaccttccctacctaacccgtacttacccgaaccccgtaacggtccccttaaacgggaccgtacccggttacggtaaacgggtttaccttttttaccggaacgttttaacggtttttaacctttaaccggttgttaacccggtaacgtaccgtacggttccggttaacgtacccgtaaacccggtttcggtacccgttcgtaccggtaccttacccggttaaccgggtttccggggaacccggggtaaacgggtaaccccggtaaggggtaaccgggaacggtaaaccgtaacccggtaaaaccggttacggttacggtacgggtacctaccgggtaacctacccgttaacg

SEQ ID NO: 196097 - DNA, 701 bp, Homo sapiens
  misc_feature: GYAE6OF01DDKVJ.4.52.E08.1.454.CMB.1.raw
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagcccacctgtctttgtctccgaggggaaagagccaccctctcctgcacgggccagtcagagtgttagcagctacttcgctaggtaccaactacgaaacctcggaccaggcctcccgacggacctccctctacttctattgaactcggcacgtccgacgacgggacccacgtggccactcccgagaccgtaggttcgagggtcggcgtaggttcgggtcgtacgggacgtacggtaccttcctaaccgttcctacccacctaaccttacccgaacccgtaaccgtacccgtaacgggaccgtccgtaaggttacgggttacttttacggtactttaaggttttactttacggttacgtcgtacggtcgtacggtacgttacgtacctaaccggtcgggtacccttccgttcgtaccttcgttacccggtttccgggacggggtacgggaaccggtaaagggtagggtaacgtaacgtaaccggtaaaacgtaccggttggtacggccgtaacgccgtaccgttaccg

SEQ ID NO: 196098 - DNA, 511 bp, Homo sapiens
  misc_feature: GYAE6OF01BW0KV.4.52.E08.1.454.CMB.1.raw
  modified_base (204)..(204): a, c, t, g, unknown or other
  misc_feature (204)..(204): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctctcctgcagggccagtcagagtgttagcagctacttagcctggtaccaacagaaacctggccaggctcccaggctcctcatctatgatgcatccgacagggccactggcatcccagccaggttcagtgcagtggtctgggacagacttcactctcaccatcaccagcctagagcctagagtatttgctagtttattactgtcagcagtcgtagcaacgtggacctctcgctcgtacgtttcgggacggagggaccgaagggtggaagatacgaaacgacgtggtacggctgctacgtac

SEQ ID NO: 196099 - DNA, 628 bp, Homo sapiens
  misc_feature: GYAE6OF01DDJ52.4.52.E08.1.454.CMB.1.raw
  modified_base (203)..(203): a, c, t, g, unknown or other
  misc_feature (203)..(203): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccacctgtctttgtctccgagggaaancgccacctctcctgcgacgggccagtcagagtgttagcagcttacttacgccttaggtaaccaaacgacgaaacctcggaccacggcctcccgaggtcctcctcatcgtaatgatgcacgtcccggacgacgggacccacgtcggaccaacgtccccgagccgtacggtttccgaagggtcggcgtagggttcgggtcgtacgggactacggtaccttcgaaccttctaccacctactaccctaccacgtacctaacggaacgtccgtaggtaaggttacgttttcgtacgttaagttttacttacgttgtactagtacgacggtacgtacgtacctaacgtcggccttcgtctctcgtacgttcggacggtacggaacgtagggtaggaagacgtaacgaacgtacgtggacgctcgcactacg

SEQ ID NO: 196100 - DNA, 744 bp, Homo sapiens
  misc_feature: GYAE6OF01D7TIU.4.52.E08.1.454.CMB.1.raw
  modified_base (210)..(210): a, c, t, g, unknown or other
  misc_feature (210)..(210): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccacggagaattgtgttgacacagtcctccagccctaccctgttctttgcctaccggaggggaaacncgcccaccctctccgtgcgacgggccagtcagtagtgttagcagcttacgtgccgtaggtacccaacacgtaaaccgtggacccaagggtccctcccgaggtccttcccgtactaacttcctagtaggtaactcggactacgtacccggaacgtacggggccctaacggtcgggacccaacgtcccgaaacgccgtaagggttccaagggtggaccgtagggttccgggtacggtacggactaacgtcccgtttaccaacgttcctacgaaccctctaccgaaccgacgtacccgttaacggacgttacccggtagggttaacgttacgttttaggacctttaaggtttttacgtacttcgtacgaggtaccgtaggtaccgtaagtacccgtaacgttccggtaccttcggttctacccgttaccgttaccggggtttaccgggacgggtaaccgggtaaccggtaagggtacgggaacgtacgaaacccggtaagtacggttcggtcggtacctacggcccttaacgtacgg

SEQ ID NO: 196101 - DNA, 749 bp, Homo sapiens
  misc_feature: GYAE6OF01EFQ5S.4.52.E08.1.454.CMB.1.raw
  modified_base (205)..(205): a, c, t, g, unknown or other
  misc_feature (205)..(205): n is a, c, g, or t
tcagagcactgtagcacgaccggtgctcgatttagtcgagctctcgagagagaaagggggaggaactgctcagttaggacccagagggaaccatggaagccccagctcagcttctcttcctcctgctactctggctcccagataccacggagaaattgtgttgacacagtctccagccaccctgtctttgtctccgaggggaaangccaccctctcctgcagggccagtcagagtgttagctagtctacttagcctacggtaaccaacacggaaacctggacccacggcctacccgaggtcctcctctacttctatcgatcggactacgtaccgacgacgggtccacgtggacctacgtcccacgccgtaggttcgaggtcggacgtagggtcgggtacgtaggactacgtacctttacgaccttaccgtacctaacccgtactacccgtaacccacgtaccccgtaaggaccgtccggttaggtacggtttaacgttttcgtaaccgtttaaggttttaacttacgttaccgttaacacggtaccgtaaggttacccggtaacgtacccgttaaccgggttcggttaacccccgttgttcccgtaccggttaccccggttaacgggtttacccgggggaccggggtaaaccgggtaaaccgggtaacggggttaggaaacggtaacgtaaccggtaaaaccggttacggttacggtacgggaaccttcgggtaacccgtaccgttacg

SEQ ID NO: 196102 - DNA, 640 bp, Homo sapiens
  misc_feature: GYAE6OF01AX4KL.4.52.E08.1.454.CMB.1.raw
  modified_base (300)..(300): a, c, t, g, unknown or other
  misc_feature (300)..(300): n is a, c, g, or t
  modified_base (307)..(307): a, c, t, g, unknown or other
  misc_feature (307)..(307): n is a, c, g, or t
tcagagcactgtagcacgaccggtgctcgatttagtcgagctctcagagaggaaagggggaggaactgctcagttaggacccagagggaaccatggaagccccagctcagcttctcttcctcctgctactctggctcccagataccaccggagaaattgtgttgacacagtctccagcccaccctgtctttgtctccgaggggaaagcgcccaccctctcctgcacgggccagtcagagtgttagcagcttactagcctaggtaccaacagaaacctggccaggcctcccaggcctcctnactctangatcgctacgtccgacgacgggccacgtggaccactcccgagccgtaggttcaggtggactagggtcggtcgtgggactagtacttcacttcctaccaacctactaccaccgacgtacctacgacgtcgtaggtacgtttatttcggactttaagttttacttacgtacgtcaacggtctaggtacgtaaccgtacctaacggtcggtcccttacgtcgtaccgttaccgttacgggttccggggacgggacgggtaaaccggtaggggttacggaagtaaccgtaaaccggaaacgttacggttaggacggtactccgtacccgtaacttcg

SEQ ID NO: 196103 - DNA, 720 bp, Homo sapiens
  misc_feature: GYAE6OF01BWSFH.4.52.E08.1.454.CMB.1.raw
  modified_base (212)..(212): a, c, t, g, unknown or other
  misc_feature (212)..(212): n is a, c, g, or t
  modified_base (671)..(671): a, c, t, g, unknown or other
  misc_feature (671)..(671): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccacggagaattgtgttgacacagtctccacgccctaccttgttctttgtcctaccggaaggggaaacncgccctaccctctcccgtgacgacgggcccagtccgaggtacgttgttagctagtccttacgttacgccgttacggtaacccaaacgaaccgtaaaccgtcggacccgtacggtcctacccgacggtcccttccgtactacttacttacgtagtacgtcgacctaccgtacccggacggaacgggccctacgtcggacctaccttacccgacgtaccgtaggttacagggtcggtacgtgggtacgggtcgtacggacgtacgtacttccacgttcctaccaccgtactacccgaccgtacgtccgtacggtccgacgttagggtacgtttacgtttacgtacttttacgttacgttacgttgtacgtaacgtcgtaaggtacctcgaaccgttccgttcggtaccttcgtccgtccttaacgttccggttagggaccggtaaggacggtacggggtanacggtaacgacgtaacgtacggttcgacgtactaccgtcgtcccgtacg

SEQ ID NO: 196104 - DNA, 687 bp, Homo sapiens
  misc_feature: GYAE6OF01AJA32.4.52.E08.1.454.CMB.1.raw
  modified_base (205)..(205): a, c, t, g, unknown or other
  misc_feature (205)..(205): n is a, c, g, or t
  modified_base (218)..(218): a, c, t, g, unknown or other
  misc_feature (218)..(218): n is a, c, g, or t
  modified_base (297)..(297): a, c, t, g, unknown or other
  misc_feature (297)..(297): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagcccaccctgtctttgtctccgagggaaangccaccctctccngcagggtccagtcagatgttagcagctacttagcctagtaccaacagaacctgccaggctcccgagcctcgtcatctancgtatcgcactccgaacacgggccacgtggaccacgtcccacggtccgtaacggttccgagtcggcctaggtcgggtacgtgggaacctacgtaacctttcacccgttaccgtacaacctacttacccgaacctacgacccgtaagtacccggtccgtaggtaacgggtttacttttacggaccgtttaaggttttcgtttaaccgtgttaacgaacgtccgttacggtcgtaacgtaccgaacgttcccgggaaccttccggtcttaaccgtccgtttaccgggttacgggttaccgggaaacgggttacccgtaggggttacccggggaataccgtaaacggttaacccgtaaggttacggtcgaacttaccggacccttaacgttcg

SEQ ID NO: 196105 - DNA, 572 bp, Homo sapiens
  misc_feature: GYAE6OF01BHZU3.4.52.E08.1.454.CMB.1.raw
  modified_base (203)..(203): a, c, t, g, unknown or other
  misc_feature (203)..(203): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgctccaggggaaangccaccctctcctgcagggccagtcagagtgttagcagctacttagcctggtaccaacagaacctggccaggcctccaggctcctcatctatgatgcatccgacagggccactggcactcccagccaggttcaggtggcaggtgggtctggggacaggtaccttcgacctctacacccatccacccacgcctagacgccgtaggagttatttcgcttagtttatactgtcagctaggcgtaacgcgtaacgtcggtcctcgtcgccttcgtacgtttcgggacgggtacgggtaccgtaaggggtacggaaggtactacccgaaaacggtacgttacgggtacggtacccgttgaccccgtactaacgg

SEQ ID NO: 196106 - DNA, 621 bp, Homo sapiens
  misc_feature: GYAE6OF01D9GQF.4.52.E08.1.454.CMB.1.raw
  modified_base (205)..(205): a, c, t, g, unknown or other
  misc_feature (205)..(205): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagactaccaccggagaaattgtgttgacacagtctccagccaccctgtctttgtctccaggggaaanagccaccctctcctgcagggccagtcagagttgtagcagctacttagcctaggtaccaacagaaacctggccaggctccgaggcctcctcatctatgatgcatcccgacgacgggcccagtggccactcccagccaggttcaggtgcgaggtgggtctgggacagtacttcacctcctacacctactccaccacgcctaagacgcctaggaagtacttttgacttagtttatacttgtcacgcgtacgtacgtacgactaacgtcggtcccttacgtcgtcccgttacgtccggttttaccggggaccgggtaacggggtaacccggtaaaggggtacggtaaacggtaaccgttaaaccgtaaacggtaaacccggttggtaacgggtccttaacggacccgtaaccggttaacc

SEQ ID NO: 196107 - DNA, 721 bp, Homo sapiens
  misc_feature: GYAE6OF01DC7Z2.4.52.E08.1.454.CMB.1.raw
  modified_base (206)..(206): a, c, t, g, unknown or other
  misc_feature (206)..(206): n is a, c, g, or t
tcagagcactgtagcacgaccggtgctcgatttagtcgagctctcagagagaaagggggaggaactgctcagttaggacccagagggaaccatggaagccccagctcagcttctcttccctcctgctactctggctcccagataccaccggagaaattgtgttgacacagtctccagccaccctgtctttgtctccgaggggaaancgccaccctctcctgcagggccagtcaggagtgttagcagctacttagcctaggtacccaacacgaaacctggcccaggcctcccgaggtcctccgtcatctactgatgccatcccggagacgggccacgtggccactcccgagtcctaggttcgaggtcgggactagggtcggggtctacggggacacggtaccttaccgaacgttccctacccaaccctaaccgttacccaaaccccgtacggtccccgtaacggacgtccccggttaagggtaacgggtttagttttaccggtcgtttaacgtttttaacgtttaccgtttcggttaccgacggtaccgtacgggtaaccggttaacggacccgtaaacgttcgggtcccttaccgttccggtccgttcccgttaccggtttccggggacggggtaaccggggtaacccgaacggggttaggtaacggtaacggtaaccgaaaacggtacgtacgggtacgtcgtaccgccgtaccgtaccg

SEQ ID NO: 196108 - DNA, 694 bp, Homo sapiens
  misc_feature: GYAE6OF01CDBSQ.4.52.E08.1.454.CMB.1.raw
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccgagggaaacgcgcccaccctctcctgcgacgggccagtcagtagtgttacgcagctacttacgcctaggtaaccaacacgaaaccgtggaccacgggcctacccgacggtcctccgtcactctaagtcgatcgaccacgtacccggacgacgggccaaccgtcgggacctactacccgagcccgtaggttccgaggtcggacgtagggttcgggtacgtgggactacggtccttacgacttcctaccgacctatacccgaccacgacctaaggaccgtcgtaggttacggttactttcgactttaacggttttacgtacgttcgtacgacgtacgtacggtacgtacgtaccgaacgttcggtccttacggtcgtacccgttacgtaccgggtttaccggggacggtaacgggggtacccgtaaggggtacggtaacgtaaccgtaaccggtaaaacggtccgttaggacggttaccgccggtacgtaacccgttacgg

SEQ ID NO: 196109 - DNA, 799 bp, Homo sapiens
  misc_feature: GYAE6OF01A28BZ.4.52.E08.1.454.CMB.1.raw
  modified_base (207)..(207): a, c, t, g, unknown or other
  misc_feature (207)..(207): n is a, c, g, or t
  modified_base (237)..(237): a, c, t, g, unknown or other
  misc_feature (237)..(237): n is a, c, g, or t
  modified_base (264)..(264): a, c, t, g, unknown or other
  misc_feature (264)..(264): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggcctcccagataccaccggagaaaattgtgttgacacagtcctccagccaccctgtctttgtctccaggggaaangccacctctcctgcagggccagtcagagtnttagcagctacttagcctggtaccaanagaaacctggccaaggcctacccgaggcctcctcatcctatgatcgaccacgtcccgacgtacgggcccaagtcggtaccacttaccccgaagtacccgtaaggtttccgaggttgggaccgtagggtcggggttaccgtaggggaacctacggtaacctttccgaacttcccgttaccaaccctacgtacccgaacccgtacggtaccccgtaacggacgtacccgttaagggtaacggtttaaccggttttttacgaccggttttaaacgggttttttaaacctttaacccggttagggtttacccgtaacgggtaccgttaaccgggttaaccgggttaacgtaccccgttaaaaccgggttcggtaccccgtttacgttccgggttacccttaccggttaacccgggttttcccgggggaaacgggtaaccggggtaaaccggtaaggggttacggaacggttaacgtaaaccggaaaacccggttaacggttcggtacgggtcccgtaacgaacccggtaaccgttaccg

SEQ ID NO: 196110 - DNA, 785 bp, Homo sapiens
  misc_feature: GYAE6OF01EISMD.4.52.E08.1.454.CMB.1.raw
  modified_base (393)..(393): a, c, t, g, unknown or other
  misc_feature (393)..(393): n is a, c, g, or t
tcagagcactgtagcacgaccggtgctcgatttagtcgagctctcagagaggaaagggggaggaactgctcagttaggacccagagggaaccatggaacgccccagctcagcttctcttcctcctgctactctggcctcccagactaccgacggagtaaattgtgttgacacgtacgtcctccacgcccaccttgttcttttcgtcgtccggaaggggaaacgacgccctaccctcctcctggcgacgggcctagtcgaggtagttagttacgcacgtcttacgttacgccgtacggtaaccaaacgacgtaaaccgtcgaccgacggcctacccgaggtccctcctactactactacgtggtcgaccacgtccgacgcggaccgggtacccncggtacgacctaccgtacccggaacggaccgtaacggtttcgaacgggtcgggaccgttaggggtttccgggtacggttacggggaactaacggttaccttccaccgtttccacctaaccgtctaaccgacggtacaacggtacgtacgggtactaaccggttaggaaacgttttacgtttgaaccgttagggttttacttaccgttacgttacgtcgtaaggtccggttaggtgggttacttaccggtacccttaccgggtacccggtaccggttcgggaaaccggtaaaccggggaccgttaaaaaggggtctaaaaccggtaccgaaaacgggttcgttacggtcggtaccgtaccgacccggtaaccttcgttacgttccgttacccg

SEQ ID NO: 196111 - DNA, 571 bp, Homo sapiens
  misc_feature: GYAE6OF01DZVPE.4.52.E08.1.454.CMB.1.raw
  modified_base (205)..(205): a, c, t, g, unknown or other
  misc_feature (205)..(205): n is a, c, g, or t
  modified_base (235)..(235): a, c, t, g, unknown or other
  misc_feature (235)..(235): n is a, c, g, or t
  modified_base (304)..(304): a, c, t, g, unknown or other
  misc_feature (304)..(304): n is a, c, g, or t
  modified_base (364)..(364): a, c, t, g, unknown or other
  misc_feature (364)..(364): n is a, c, g, or t
  modified_base (377)..(377): a, c, t, g, unknown or other
  misc_feature (377)..(377): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagatacccaccggagaaattgtgttgacacagtctccagccacctgtctttgtctccgaggggaaanacgccaccctctcctgcagggccagtcagngtgttagcagcttacgtagcctggtaaccaacagaacctggaccaggcctccgaggcctcctcatctangatcgctactccgagcgggccagtggccatcccagcctaggttcagtggcaggtcggtcnggacagtacttcncttcaccacactaccaccagcctagacgtccgtaggtagttactttcgcttagtttacttacgtcgtacacgcgtagtcgtaagtcacgtcggtcctcgtcgtctacgtacggtttcgggacgggtacgggtaccgaaggggtgaacgtacgtaaccgaaacggtacgttcggtacggctacgccgtcgttacg

SEQ ID NO: 196112 - DNA, 669 bp, Homo sapiens
  misc_feature: GYAE6OF01DWMNP.4.52.E08.1.454.CMB.1.raw
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccgaggggaaagacgccaccctctcctgcagggccagtcagagtgttagcagctacttagcctaggtaccaacgagaaaccgtggaccaggtcctacccgaggcctcctcagtctatagatcgcactccgagacgggccacgtcggccactcccagaccgtaggtttcgaaggttcgggctagggttcgggtaccgtagggggaactacggtacctttccgaaccttcctacccaacccgtacttacccaacccgtaagtaccctacggacgtaccgtaggtaacggggttattttacggacgttaaggtttttacttaacgttcgtacctaggtccgtaaggtccgttaacggaccgtaaccgtcgggtacccttcgttccggccttacgtacggtttccgggacggggtacgggaaccgtagggtaggacgtataacccgaaaggtaccgtggtacggctacggccaccgtacg

SEQ ID NO: 196113 - DNA, 760 bp, Homo sapiens
  misc_feature: GYAE6OF01EO2NI.4.52.E08.1.454.CMB.1.raw
  modified_base (206)..(206): a, c, t, g, unknown or other
  misc_feature (206)..(206): n is a, c, g, or t
  modified_base (235)..(235): a, c, t, g, unknown or other
  misc_feature (235)..(235): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagcccaccctgtctttgtctccgaggggaaangcccaccctctcctgcagggccagtcagngtgttagcagctacttagcctggtaccaacaacgaaacctggccaggcctcccgaggcctccctcacttcctagtgtacgtcgacctacgtcccggaaccgacgggggtacccaacgttcgggacctaaccgtcccccgaacggcccgttaacggttccgaagggttcgggtacgtaagggttcggggtcgtacggggacctaggtacctttccaaccgttcctacccgaaccctaactacccgaaccctacgggtacccttaacgggtaccgtacccgtttagggaaggtttaacgttttttccgaacgtttaacggtttttactttaacgttcggttacgtaacgtccgtaacgccggttaacggacccgttaaaccgggttccggttcccttaccgtcgtacccgttaccgtaccggtttccggggaccgggtaacggggtaacccgtaaggggtacggtaacggtaacgtaaccgtaaaacggtaccgttcgggacggtaccgttacgcgtacccttacgg

SEQ ID NO: 196114 - DNA, 733 bp, Homo sapiens
  misc_feature: GYAE6OF01BOQAH.4.52.E08.1.454.CMB.1.raw
  modified_base (205)..(205): a, c, t, g, unknown or other
  misc_feature (205)..(205): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccgaggggaaancgcccaccctctcctgcagggccagtcagagtgttagcagctacttacgcctaggtaccaacgagaaacctggaccaggcctcccgaggcctcctcatctatgatgcactaccgacgacgggccaacgtcggaccactcccgagccgtaggttcaggtcggcgtaggtcgggtctagggacaggtaccttcaccgttctaccaacctactaccaccgacgtacctaacgacgtaccgtaggtacggttacgtttttcggacgtttaagttttaactttaccgttacgtaccgtacggtaccgtaacgggtaccgttaacggtaccgtaaccggttccgggttaccccttcgttccggtacccgtttaccggttaacccgggttttaccgggggaaccggggtaaaccggggtaaaccggtaaacgggggttaacggaacggttaaaccgtaaaccgggtaaaaacccggttaacggttaccgggttacgggtaacccggttaccggtaacccgtaaccggttaacccg

SEQ ID NO: 196115 - DNA, 749 bp, Homo sapiens
  misc_feature: GYAE6OF01D6BW6.4.52.E08.1.454.CMB.1.raw
  modified_base (155)..(155): a, c, t, g, unknown or other
  misc_feature (155)..(155): n is a, c, g, or t
  modified_base (263)..(263): a, c, t, g, unknown or other
  misc_feature (263)..(263): n is a, c, g, or t
  modified_base (303)..(303): a, c, t, g, unknown or other
  misc_feature (303)..(303): n is a, c, g, or t
  modified_base (309)..(309): a, c, t, g, unknown or other
  misc_feature (309)..(309): n is a, c, g, or t
  modified_base (330)..(330): a, c, t, g, unknown or other
  misc_feature (330)..(330): n is a, c, g, or t
tcagagcactgtagcacgaccggtgctcgatttagtcgagctctcagagagaaagggggaggactgctcagttaggacccagagggaaccatggaacgccccagctcagtcttctcttcctcctgctactctcgcctcccagactaccgacgganaattgtgttcgacactagtcctccacgccctacccttgttcctttgtcctccggaagggtaacacgcccacccctcgtcctgccgacgggccagtcaaggtgtcgtancgagtcctagttcgccgtacggaaccaacaacgtaaccgngaccgnggcctacccgaggtcctcccntactcgtatcggtatcgaccacggtacccaccgggacggtaccctaggtaccggacctaacgtcccggaccgtccgtacggttaccgagggtcgacgtaggggttcggttaccgaggtaaccgacgtttaacccttccggacttaccctaaccgaacccgtaccgttaccgaacccgtaaccgcccgtaagtcggtacccgtaggttacgtacgttttacgtacgttttaacgtttaccgtaacgtttccgtacgtacgtacccgtggtaccgttacgaccgtacggttccgaccttaccgtcgtccggttaccgtacccggtccggggaacgggtaaccggacgggtaaccgggtacgacggttaacgtaaaccggtaactacgggttacggaccgttacggaccgtcaaccgttccg

SEQ ID NO: 196116 - DNA, 880 bp, Homo sapiens
  misc_feature: GYAE6OF01CVG4Z.4.52.E08.1.454.CMB.1.raw
  modified_base (173)..(173): a, c, t, g, unknown or other
  misc_feature (173)..(173): n is a, c, g, or t
  modified_base (208)..(208): a, c, t, g, unknown or other
  misc_feature (208)..(208): n is a, c, g, or t
  modified_base (246)..(246): a, c, t, g, unknown or other
  misc_feature (246)..(246): n is a, c, g, or t
tcagagcactgtagcacgaccggtgctcgatttagtcgagctctcagagagaaagggggaggaactgctcagttaggacccagagggaaccatggaacgccccagctcagcttctcttcctcctgctactctcggctcccgagactaccaccggaagtaaattgtgttgacanagtctccagccacctgtctttgctccgagggaaanacgtccacctctctagcagggccaagtcagagtgttanctagactacgttgccgtaggtaacccaaactacgaaaccgtcggacctaacggccttcccgaaggtcctacccttacaactttaccgtatagaactcgtacaacgttcccggaacgtacggggaccctaacggtcggaccaaccttacccgaaggccccgttaaggtttaccaagggttccggacgtacgggtgggtaccgttagggggaaccctaggttaccttcccgtaaacttccctaacacctaacttacccaaccccgtaacggacccgttaaaggaaccggtcccgttaagggttaacggttacgttttttaggaaccgttttaaacggtttttaccgttaaccgtttacggtacccgaacgtacccggtaacgggtaaaccggttaaccggtaaccgtaaaccggttcggggtacccctttaccgtttcccggtacgtttaaccccggtttaaccggggttttacccggggaaaccgggggttaaaccgggggtaaacccggttaaaacgggggttaaccggggtaacgttaaaacccggtttaaaacggaaaaccccggggtttaaaccgttaccggggtttaacgggccgtttaaacccggaacccgttacccgttaaacccggg

SEQ ID NO: 196117 - DNA, 704 bp, Homo sapiens
  misc_feature: GYAE6OF01EO9KG.4.52.E08.1.454.CMB.1.raw
  modified_base (204)..(204): a, c, t, g, unknown or other
  misc_feature (204)..(204): n is a, c, g, or t
  modified_base (241)..(241): a, c, t, g, unknown or other
  misc_feature (241)..(241): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagactaccaccggagaaattgtgttgacacagtctccagccaccctgtctttgtcctcgagggaanacgcccaccctctcctgcagggccagtcagatgttancagctactagcctaggtaccaacagaacctggacctaggcctccgaggcctcctcatctatcgatcgactacgtacccggaacgtacgggcccaacgttggaccctacgtaccccgaggccccgtaaggtttccgagggtcggtaccgtagggtcgggtacctaggggaactacggtacttcgactctaccaccactacctaccgacgtaccgtaacgacggtacccgtaggtacggttaacttttcggtaacttagttttaacttacgtgttacaggtccgtacggtcgttaaccgacgtaacccgttcggtacccttccgtacggtacccgttccgtaacggttttacccgggaccggggtaacggtacccggtaacgggttacggtaaccggtaaagttaaacccgaaaacggttaccgttaggggttaacgtaccgtacggtacccgtaccttaaccgg

SEQ ID NO: 196118 - DNA, 718 bp, Homo sapiens
  misc_feature: GYAE6OF01BZOPK.4.52.E08.1.454.CMB.1.raw
  modified_base (206)..(206): a, c, t, g, unknown or other
  misc_feature (206)..(206): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagcccaccctgtctttgtctccgaggggaaangccaccctctcctgcagggccagtcagagtgttagcagctacgttagcctaggtaccaaacgacgaaaccgtggacccaggcctacccgaggtcctcctcatctagtgatcgcacgtccgacgacgggccacgtcggaccacgtcccgagccgtaggttcaaggtcgggacgtagggtcgggtaccgtggggaactacggtacctttccgtaaccgtcctacccgtaacctaacgtcccaaccggtaacgtaccgtaacggtacccgtccggttaacggtaagggtttacttttacggaacgttttaagttttaaacgttcgttacggttaacgacggtacgtaacggtcgttaaccgaccgtaccgttcggtccttaccgtcggtcccttaccggttaccgggtttaccggggacgggtaaaccgggtacggtaacggggttacggaacggttactaaaccggtaaaacgttacggtcggtaccggtactacgaacccgtaaccggttacg

SEQ ID NO: 196119 - DNA, 586 bp, Homo sapiens
  misc_feature: GYAE6OF01A2MUB.4.52.E08.1.454.CMB.1.raw
  modified_base (207)..(207): a, c, t, g, unknown or other
  misc_feature (207)..(207): n is a, c, g, or t
  modified_base (388)..(388): a, c, t, g, unknown or other
  misc_feature (388)..(388): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagatacccaccggagaaattgtgttgacacagtctccagcccaccctgtctttgtctccgaggggaaangccaccctctcctgcagggccagtcagagtgttagcagctacttagcctggtaccaacagaaacctggccaggcctcccaggcctcctcatctatgatgcatccgacacgggcccacgtggcacgtcccagccgaggttcagtggcaggtgggtcgtggggacagtacttcactctcaccntccaccagcctagacgccgtggagtatttcgacttagtttatacgtgtcagcagcgtaagcgtaacgtcggtccttcgtcgtcttaccgtacggtttccgggaccgggtaacgggaacccggtaaggggtaggaacgtacggttaaccgaaaacggtaccggttagggtacggtacccgtacggcccgtaaccgtacg

SEQ ID NO: 196120 - DNA, 598 bp, Homo sapiens
  misc_feature: GYAE6OF01CF8X3.4.52.E08.1.454.CMB.1.raw
  modified_base (213)..(213): a, c, t, g, unknown or other
  misc_feature (213)..(213): n is a, c, g, or t
  modified_base (443)..(443): a, c, t, g, unknown or other
  misc_feature (443)..(443): n is a, c, g, or t
  modified_base (485)..(485): a, c, t, g, unknown or other
  misc_feature (485)..(485): n is a, c, g, or t
tcagagcactgtagcacgaccggtgctcgatttagtcgagctctcagagaggaaagggggaggaactgctcagttaggacccagagggaaccatggaacgccccagctcagcttctcttcctcctgctactctggctcccagactaccaccggagaaattggtgttgacacagtctccagcccaccctgtctttgtctaccggaaggggaaanacgccaccctctccgtgcgacgggcagtcagagttgtagcagctactagcctggtaaccaacgaacgtaaccgtggaccacggcctcccgaggtcctcctatatctatcgatcgactacgtccggaacgacgggccctacgtcggacctaccgtcccgacgtaccgtaggttaccgagggtcggcgttagggtcgggtcgtaggactacgtactcactctcacactcacncgcagtcgcgtagtagtcttgacgttaattactacgtcgtancgtcgacgtcgtacgtacacgtcgtcctcgtcgtcgtacgtcggttcggacgggtaggaaccgtgggtagacgacgtaacgtaacggtacgtgacggtactcgaccgtcgtac

SEQ ID NO: 196121 - DNA, 616 bp, Homo sapiens
  misc_feature: GYAE6OF01BEMIJ.4.52.E08.1.454.CMB.1.raw
  modified_base (234)..(234): a, c, t, g, unknown or other
  misc_feature (234)..(234): n is a, c, g, or t
  modified_base (291)..(291): a, c, t, g, unknown or other
  misc_feature (291)..(291): n is a, c, g, or t
  modified_base (303)..(303): a, c, t, g, unknown or other
  misc_feature (303)..(303): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccacctgtctttgtctccagggaaagacgccaccctctccgtgcgaggccagttcagngtgttagcagctacttagcctggtaccaacagaaacctggccaggctccaggcctcncatctatgatcnctatccgacgacgggccagtcggactactcccgacgccgtaggttcaaggtcggacgtaggtcgggtcacggactacgtacttcgacttcctacaccgtactccaaccgacgacgtacgacgtaccgtaggacggttatttacgacgttagtttacgttaccgtgtacgtacgcgtagcgtaacgcctaacgtcgtacccttcgtcgtccttaccgttacggttccgggacggaaccgggtaacgtacgggtagtaacggtaccgtaacgaaaccgtacgttacggacggtacctcggacctacccgttaacg

SEQ ID NO: 196122 - DNA, 558 bp, Homo sapiens
  misc_feature: GYAE6OF01DJ2KQ.4.52.E08.1.454.CMB.1.raw
  modified_base (205)..(205): a, c, t, g, unknown or other
  misc_feature (205)..(205): n is a, c, g, or t
  modified_base (218)..(218): a, c, t, g, unknown or other
  misc_feature (218)..(218): n is a, c, g, or t
  modified_base (321)..(321): a, c, t, g, unknown or other
  misc_feature (321)..(321): n is a, c, g, or t
  modified_base (367)..(367): a, c, t, g, unknown or other
  misc_feature (367)..(367): n is a, c, g, or t
  modified_base (395)..(395): a, c, t, g, unknown or other
  misc_feature (395)..(395): n is a, c, g, or t
  modified_base (403)..(403): a, c, t, g, unknown or other
  misc_feature (403)..(403): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccgaggggaaangccaccctctccngcagggccagtcagtagtgttagcagctacttagcctaggtaaccaaactacgaaaacctggaccaaggcctaccaggctcctcatctatgatgcatccgagnggccagtggcactcccagcctaggttcagtgcaggtggtctggacngacttcactcacacatcaccagctagcnctagagtntttgcttatttatatgtacagtcgagtacgtacgactaacgtcgtcctctcgtcttacctaccggtttcgggacgggaacgggtacccgtaaagggtggaacgtaacgtaaccgtaaaccggtaacgttggtacggtccttagccctacgtaccg

SEQ ID NO: 196123 - DNA, 863 bp, Homo sapiens
  misc_feature: GYAE6OF01BE5YH.4.52.E08.1.454.CMB.1.raw
tcagagcactgtagcacgaccggtgctcgatttagtcgagctctcagagaggaaagggggaggaactgctcagttaggacccagagggaaccatggaacgccccagctcagcttctcttcctcctgctactctggctcccagataccgacggagaaattgtgttgacacagtcctccacgcccacccttgtccttttgtcgtaccgaagggggaaagacgcccaccctctcctgcgacgggccagtcagtagtgttagcagtctacgttacgcctaggtaaccaacgaacgaaaaccgtcggacccgaacggtcctcccccgaagggtcccttacccgtccaacgttccttaaagtggtaacgtcggacctacgttacccggaaccggtaccggggacccctacgttcgggaccctaccgttccccgaaccgggtacccgtaagggtttaccgaacggggttcgggtacccggtaaggggttttcggggggttcggttaaccggggggtaactaacccgggtaaaccttttacccgtaaacccgttcccttaccctaaaccctacttaccccgaaacccgtaccggtacccgtttaacggaccggtaccccgttaaggggtaacgggttttaacgttttttccgggaccgttttaaacggtttttaaccgttttaaccggttcgtttaaacccgacggtacggtacggttaccggtaacgtaccctaaccggttccggtacccctttccgtacggtcccttacggttccgggttaccgggtacgggaaccgggttaacggtacggggtagaaggtaccgtaacgaaaacggtcgtaggtacggtcgacgtcgtaaccgttacg

SEQ ID NO: 196124 - DNA, 705 bp, Homo sapiens
  misc_feature: GYAE6OF01BS097.4.52.E08.1.454.CMB.1.raw
  modified_base (203)..(203): a, c, t, g, unknown or other
  misc_feature (203)..(203): n is a, c, g, or t
  modified_base (295)..(295): a, c, t, g, unknown or other
  misc_feature (295)..(295): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctcgaggggaangccaccctctctgcagggccagtcagagtgttagcagctacttagcctggtaccaacagaaccctggccaggcctccaggctcctcatctangatgcatccgacagggcccatggccatcccagcaggttcagtggctaggtcgggtctggggaacaggtaccttcgacttactccaacctactccaacccgtacggtacccttacggacgtccgttaggtaacgggttaacgtttttggacctttaaggtttttaacgtttaacgttcgtttacgaacggttcggaacggttaccggttaacggtaccgtaaaccggtttcccgggttaccgttaccgttcggttaccttacccggttaccggtttttacccgggggacgggttaacccgggggtaaccgggttaaacgggggttaagggtaacgggtaacgttaacccgtaaaacgggtaaccggttacgggttaccgggtaccgttacggacccgtaacccggttaacc

SEQ ID NO: 196125 - DNA, 720 bp, Homo sapiens
  misc_feature: GYAE6OF01A8TXW.4.52.E08.1.454.CMB.1.raw
  modified_base (698)..(698): a, c, t, g, unknown or other
  misc_feature (698)..(698): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggcctcccagactaccacggagaaattgtgttgacacagtcctccacgcccacccttgtcttttgtcctccgaaggggaaacgacgccctaccctctcctgccgacgggtccagtcgagtagtgttagcagtctacgttacgccgtacggtaaccaacgaacgaaacctcggaccacggcctacccgaggtccctccgtcacttctagtcgatcgctacgtccgacgacggccacgtgccacgtcccgagccgtagtcaggtcggacgtaggtcgggtacgtacgggaactacggtaccttcgaccttacctaccgaaccgtactacccgaaccgacgtaccgtaaggtacgtaccgttagggtacggttagttttcgtaacgttttagttttaaccgttctcggtacgacggtacgtaacggtaccgtaacgtaccgtacgttccggtaccctttcgtaccgttacccgttacggtaccggtttacgggaccggggttaacgggaaccgggtagggttacggaacgtaacgtaaacccgggtaaacgtacgttcggggaccgttanacccggttaccaccgtttacgg

SEQ ID NO: 196126 - DNA, 596 bp, Homo sapiens
  misc_feature: GYAE6OF01EWY57.4.52.E08.1.454.CMB.1.raw
  modified_base (204)..(204): a, c, t, g, unknown or other
  misc_feature (204)..(204): n is a, c, g, or t
  modified_base (263)..(263): a, c, t, g, unknown or other
  misc_feature (263)..(263): n is a, c, g, or t
  modified_base (363)..(363): a, c, t, g, unknown or other
  misc_feature (363)..(363): n is a, c, g, or t
  modified_base (370)..(370): a, c, t, g, unknown or other
  misc_feature (370)..(370): n is a, c, g, or t
  modified_base (417)..(417): a, c, t, g, unknown or other
  misc_feature (417)..(417): n is a, c, g, or t
tcagagcactgtagcacgaccggtgctcgatttagtcgagctctcagagagaaagggggagaactgctcagttaggacccagagggaaccatggaacgccccagctcagcttctcttcctcctgctactctggctccagataccaccggagaaattgtgttgacacagtctccagccaccctgtctttgtctccgaggggaaancgccaccctctcctgcagggccagtcagagtgtagcagtctacttagcctggaaccaanacgaaacctggaccaggcctcccgaggtcctcctacacttctagtggacttgactaacgtccgacgacgggtccagtcgactactccaggcgtaggttcngtcgganaggtgggtctggaactagcttccgactcacaccgtatacccgaccgngtaccctaggaccgtcgtaggtaacgttatttgactttaagttttactacgtcgttacagccgtaagtccgtacgacctagtcggccttcgtcgctacgttacgttcgggagaaccgggtagtacgggagtacgtacgtaaccgaaacgtcggtcgttacggacttcgaccgtactcgg

SEQ ID NO: 196127 - DNA, 688 bp, Homo sapiens
  misc_feature: GYAE6OF01ELL96.4.52.E08.1.454.CMB.1.raw
  modified_base (344)..(344): a, c, t, g, unknown or other
  misc_feature (344)..(344): n is a, c, g, or t
  modified_base (371)..(371): a, c, t, g, unknown or other
  misc_feature (371)..(371): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccacggagaaattgtgttgacacagtctccagcctacctgtctttgtcgtccgaggggaaagcgcccaccctctccgtgcgagggccagtcagagtgttagcacgctactagtccgtaggtaaccaacagaaacctgaccacggctcccaggcctcctcatctagtcgatcgcacgtccgacgacgggccacgtggctacncccgagccgtaggtaccaggtcgacgnggtttgggcgtacggactacgtacttcacgtctacacactccaaccacgtaccgtaggactacgtggtaaggttattttacgaccgttaaggttttactacgttacgacgtaacgggtctaacgggtcctaacgtacccgtaaagttcccggtacccgtttcgtacggtaccccgttaggttaaccccgggttttacgggggacccgggaaacggggtaaacccgtaaaggggtacgggaaacgtttaaacggaacccgttaaaaaccggacgtttcggggtaaccgttaccggtaacgtccgaaacccgtttaccg

SEQ ID NO: 196128 - DNA, 857 bp, Homo sapiens
  misc_feature: GYAE6OF01CJWP8.4.52.E08.1.454.CMB.1.raw
  modified_base (151)..(151): a, c, t, g, unknown or other
  misc_feature (151)..(151): n is a, c, g, or t
tcagagcactgtagcacgaccggtgctcgatttagtcgagctctcagagagaaagggggaggactgctcagttaggacccagagggaaccatggaacgccccagctcagcttctcttcctctgctactctggctccagactaccaccgganaattgtgttgacacagtctccacgcccaccttgtctttgtctccgaagggtaagcgcccaccctctctgcgacggccagtcgagtagtggttagcgagtaccttacgttacgcctacggtaacctaacgaaccggtaaaccctgggacccgacgggtaccctacccggacggtcccttcccgtactacttaccttagtagtacctacgtaccgaaccgttaccccggaacggaccggggaccctacggtacgggtacccctaaccgttcccccggacggtacccggttagtttaccggacgggttcggtaacggtacgggggttcgggtaccgggttaccgggaacttaaggttaccccgttaccgtacccttacctaacccgtacctaccgtaccctaaccgtaccggtaaccgttacggtaaaccggtccgttaacgggttaacggttttcggttttaaccgtaacggtttttaacgtttttaaccgttaccgtttacgtaacgttacggtaaccgtacgggttaccgtaaccggtaccgtacccgggttcgttaccgtttacctacggtccccgttttacggtaccgggtttaccggggaccggggttaaccggaaacggttacggggtacggtaaacggttaaccggttaaaccgtaaacggttccgggttacgtacggtaccgaccgtacctacgttaccg

SEQ ID NO: 196129 - DNA, 852 bp, Homo sapiens
  misc_feature: GYAE6OF01DQ62E.4.52.E08.1.454.CMB.1.raw
  modified_base (211)..(211): a, c, t, g, unknown or other
  misc_feature (211)..(211): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctcggctcccagactaccgaccggagtaaattgtgttgacacagtcctccacgcccacctgtctttgtctccgaggggaacncgccctacctctcctgcgacgggcctagtcgagtacgttggttacgcagtccttacttacggccgttacgggtaacccaaaacgtaccggaaaccgtcgggacccgtaacgggtcctacccgacggtcccttacctaccgtatttaccgtagttacgacgttcgacccgtaacgtaccccggaaggtacccgggtacccctaagtccgggacccttaaacccccggttcccccgaacgggtcccccggtttaagggttacccgtacggggttacgggtacccgggtaaggggtttcggggtaaccggttcggggaaccttaccgggttacctttaccccggaacctttccctaaccctaacccgtaccgtacccctacccggtaaccggtacccgtacggacccgttccgtaagggttaacgtttcgttttagaccgtttacgtttagttaccgttcgtacgtagtccggtacggtaccgtacggtaccgtaccggttcggtacccttggttaccgtaccgttacccgttaccgggttaccgggacggggttaacggggtaaccggtagggttaggacgttaaccggtaaaccgtaaccggtacggttcggttacggaccttacggccgttaacccgttcg

SEQ ID NO: 196130 - DNA, 622 bp, Homo sapiens
  misc_feature: GYAE6OF01CYZJJ.4.52.E08.1.454.CMB.1.raw
  modified_base (206)..(206): a, c, t, g, unknown or other
  misc_feature (206)..(206): n is a, c, g, or t
  modified_base (331)..(331): a, c, t, g, unknown or other
  misc_feature (331)..(331): n is a, c, g, or t
  modified_base (403)..(403): a, c, t, g, unknown or other
  misc_feature (403)..(403): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccacggagaattgtgttgacacagtctccagcccaccctgtctttgtcctccgagggggaaancgcccacccctctcctgcgacgggccagtcagagtgttagcagctacttacgcctaggtacccaaacgacgaaacctggacccaggcctcccgaggcctcctcattctatgactgcactccgacncgggccagtcggacacctcccgagcctaggttcaggtcggcgtagggtggtcgtagggacagtactcactcncacactacacacgctagacgtcgtagtacgttagtttcgactttagtttactacgtcgtacacgcgaggtacgtacgacgtaacgtcggtccttacgtcgtccttacgttaccggttaccgggaccggggtacgggaaccggtaacggggtagggtaacggtaacgtaaccgtaaaacggtacgttacgggtacggtacgtaccgtacctaccgttacg

SEQ ID NO: 196131 - DNA, 778 bp, Homo sapiens
  misc_feature: GYAE6OF01ATGU8.4.52.E08.1.454.CMB.1.raw
  modified_base (209)..(209): a, c, t, g, unknown or other
  misc_feature (209)..(209): n is a, c, g, or t
  modified_base (728)..(728): a, c, t, g, unknown or other
  misc_feature (728)..(728): n is a, c, g, or t
  modified_base (738)..(738): a, c, t, g, unknown or other
  misc_feature (738)..(738): n is a, c, g, or t
tcagagcactgtagcacgaccggtgctcgatttagtcgagctctcagagagaaagggggagaactgctcagttaggacccagagggaaccatggaagccccagctcagcttctcttcctcctgctactctggcctcccagactaccaccggagtaaattgtgttgacacagtctccagcctaccctgttctttgtcctccgaagggaancgccctacctctcctgcgaggccagtcagtagtgttacgcagtcttacgtacgccgtacggtaaccaacgaacgtaaacccgtggaccctacgggcccttacccgaggtccccttacccgtactaacttcgtttaacgtcggtactaccggtaacctaccggtaccccggtaaaccggaccgggtaccctacggttaccgggacccctaaccgttccccggaacggtcccggttaacggttacccggagggttcgggacccggttaaggggttccggggttaccggtaacgggaacccttaaaccggttacccgtttacccgtaaccgttaccgtaccccaaccggtttacctacccgaacccgtaccggtaaccgtaacggccgttaccggtaaggttaacgttttcgtttacgtaacgttttaaacgttttcctacggtacgttacgaggttacctaggtccgaacgttaccgtacgttcggtacctacggtctaccgtcgttaccggtgggaccgngtaacggtgngaactacgacgtaacggcttcgggacactcgcctagtccg

SEQ ID NO: 196132 - DNA, 723 bp, Homo sapiens
  misc_feature: GYAE6OF01ER797.4.52.E08.1.454.CMB.1.raw
  modified_base (205)..(205): a, c, t, g, unknown or other
  misc_feature (205)..(205): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctgctcccagataccaccggagaaattgtgttgacacagtctccagcccaccctgtctttgtctccgaggggaaancgcccaccctctcctgcagggccagtcagagtgtagcagctacttagcctggtaccaacacgaaacctggccaggcctacccaggcctcctacatctatcgatcgctacgtccgacgacggacctcgtcggacctactcccgacgaccgtacggttccaggtcggcgtagggtcgggtcggtacgggaacctacggtaccttcgacctccttaccaccgtaactcccaacccgtagtaccccgttaaggaccggtacccgtagggtacggtttattttcggaccgttttaagttttaacgtttacgtggttacctaacggtccgtaacggtaccgggtaacgtcccggtaaacgttccgggttaccccttaggtcccgttacccgttaccgggttaaccggtttcccggggaccggggtaaccggggtaaaccggtaagggtacgggaacggtacttaaacccggaaaccggttaccggttaggtaccgggtccttaaccggtccctaacgttaccgg

SEQ ID NO: 196133 - DNA, 802 bp, Homo sapiens
  misc_feature: GYAE6OF01CETLJ.4.52.E08.1.454.CMB.1.raw
  modified_base (669)..(669): a, c, t, g, unknown or other
  misc_feature (669)..(669): n is a, c, g, or t
  modified_base (682)..(682): a, c, t, g, unknown or other
  misc_feature (682)..(682): n is a, c, g, or t
tcagagcactgtagcacgaccggtgctcgatttagtcgagctctcagagaggaaagggggaggaactgctcagttacggacccagagggaaccatggaacgccccagctcagtcttcttccttccctcctgctactcgtcggcctcccagactaccgaaccggaagtaaattgtgttagacactacgtcctaccacgccctaccgttgtttctttcgtccgtaccgggaaaggggaaaacgccgacccctacccttccttccgtacggaccgacgggtccctaaggtccggaaggtaggttcggttaacgacgtacgttaccttaccgttacggacccgttacggtaaacccaaacgtaaacggtaacccgtccggaccgtaccggccctacccggacggttccctaccttcgtaacgttcgttaacgtggtacgtcgtaccgtaccgtacccggaaccggaccgggaccctcgggtacggaccaccggtccccgaggtaccggtacggttcggacgggtaccggtcggtacggggttggtccgggtaacggtccgtacgttaccttacccactaccctaccgaccttccgacctaacccgacgtacgtacgtacgtacgttacggtaatttcgttacgtacttaagtttacgttgacgtacgacgtcncggtaagcgtacnccgtgtctcgtacgcttacggtccggtcggaccggaagggtccggtaagggtacgacggtaaaccgaaccggttaaacgggtaccgttcgggaacttcccggtacgtaccctcgttaccg

SEQ ID NO: 196134 - DNA, 742 bp, Homo sapiens
  misc_feature: GYAE6OF01DWRAO.4.52.E08.1.454.CMB.1.raw
  modified_base (173)..(173): a, c, t, g, unknown or other
  misc_feature (173)..(173): n is a, c, g, or t
  modified_base (337)..(337): a, c, t, g, unknown or other
  misc_feature (337)..(337): n is a, c, g, or t
tcagagcactgtagcacgaccggtgctcgatttagtcgagctctcagagaggaaagggggaggaactgctcagttaggacccaggagggaaccatggaacgccccagctcagcttctcttcctctgctactcgtggcctcccagactaccgacggagtaattgtgttcgacanagtcctcgacgccctaccttgttctttcgctaccggagggaacgcgccctaccctcctcgtgacgacgggccagtcgagtagtgtacgcagtcttacgttcgaccgttacggaaccaacgacgtaaccgtcggaccgtacggccaccggaggtccttacccgtntacttacgtacgtgacgtcgacgaccgtacggacgtaccgggacctagtcggacctaacctcccgagacccgttaggtacgagggtcggacgtcggggttcgggtacgcgggtaaccttacggttaccttcgtaccttaccgacccaaccgttaccgacccaaccggtaccgtacccgtacggtacccggtccggttaggttaaccggttgttttaccgacgttttaacgttttacgtacggtacgtacgacgttacgacggttaccggtacgaccgtaccgttcgtccttcgtactcccggttacggttaccggtacgggggaccggtaaagggtacgtaacggggttacgaacgttaacgaaccggttaagtcggaacggtcgtacctccgcgtacttaccgg

SEQ ID NO: 196135 - DNA, 820 bp, Homo sapiens
  misc_feature: GYAE6OF01EXQ8Z.4.52.E08.1.454.CMB.1.raw
tcagagcactgtagcacgaccggtgctcgatttagtcgagctctcagagaggaaagggggaggaactgctcagttaggacccagagggaaccatggaagccccagctcagcttctcttcctcctgctactctggcctcccagataccaccggataaattgtgttgacacagtctccacgccctaccctgttctttgtctccgaggggaaagacgccaccctctcctgcgagggccagtcagtagttgttagcagcttacgtacgccgttaggtaacccaaacgaagaaacccgtcggacccgtacggccctaccccgaggtccctccttaccgtattccgtagtgtaagttcgacctacgtacccggaacggacgggcccgtacgtcggacctacctaccccgaagtacccgtaacggtttaccgagggtacgggtcgtaaggggttccgggtacggtaggggaaccttacggtaccccgtttacgaccgttaccccgttaccaacccgtacgttaccccaacccgtaacgtacccgttaacgggtaacccgtaccggtttaacggtcgggttttaacgttttcggtaaccggttttaaagtttttaccgtttacgttcggtaacgtacggtcgtaacggttcccgtaaacggtaccgtaaccggttaccgggttacccttagttccggtaccgtttaccgtacgggttttcccgggaacggggtaacccgggtaaccggtaaagggtacgggtaaacaaccgttaaaccggtaaaccgttaccgttggtaccgggacttaaccgtcccgaaaccttccg

SEQ ID NO: 196136 - DNA, 735 bp, Homo sapiens
  misc_feature: GYAE6OF01BAC6W.4.52.E08.1.454.CMB.1.raw
  modified_base (130)..(130): a, c, t, g, unknown or other
  misc_feature (130)..(130): n is a, c, g, or t
  modified_base (201)..(201): a, c, t, g, unknown or other
  misc_feature (201)..(201): n is a, c, g, or t
  modified_base (210)..(210): a, c, t, g, unknown or other
  misc_feature (210)..(210): n is a, c, g, or t
  modified_base (213)..(213): a, c, t, g, unknown or other
  misc_feature (213)..(213): n is a, c, g, or t
  modified_base (236)..(236): a, c, t, g, unknown or other
  misc_feature (236)..(236): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactntggctcccagataccacggagtaaattcgtgttgacacagtctccagccacctgtcttgctccgagggaancgccacctntcngcaggccagtcagacgtgttacnccagtctacttacgccgtaggtaacccaacgacgaacctggaccacggactcccgaaggccttacccgtctaattcttacgagtacttcggacctacggtacccggaaccgacggggtacccctaaccgtcggtaccctaacttaccccggagtaccggtaacggtttcgaacggcggtaaccggtacgggttcgggtacgtagggtaaccacgtttacccgtactacccgtacttaccaaccctacgtacccaaccgtaacgtcctaacgggctaccgttaggtaacgtttacctttaggtacctttaacgtttacttacgacgttacgagacgtcggtacgacgtaccgtaccgtacgttacgtcctacggttaccgtaaccggttaaccgggttccggaacgggtaacgggtaacccgtaaggggtagaacgtaaccgtaaaccggaaaaccgttcggttacggtacggtacctaaccggtaccgtccttaaccgg

SEQ ID NO: 196137 - DNA, 867 bp, Homo sapiens
  misc_feature: GYAE6OF01D5VQE.4.52.E08.1.454.CMB.1.raw
  modified_base (181)..(181): a, c, t, g, unknown or other
  misc_feature (181)..(181): n is a, c, g, or t
tcagagcactgtagcacgaccggtgctcgatttagtcgagctctcagagaggaaagggggagaactgctcagttaggacccagagggaaccatggaagccccagctcagcttctcttcctcctgctactctcggcctcccagactaccgaccggaagtaattgtgttgacacgacgttccncaccgcctaccttgttctttacgccgtacggaagggtaaacgccgaccctaccgttccgtccgcgacggacggactacgtacgtagtagtacgttacgacgtacgtacgttaacgtaccgacggttaaccgaacgaaaccgaacggttaaccgcggtaccgaccggtaccttaccgacgtcccttacacttacgttaacgtacgtacgtaagtaccgtacctaacccggaccggtaacgggacccggacccgtaaggttccggaacccttacccggaacccgtaccggtacggttacggttaccgtagggtacgggtacggtacgggttacgggtaccggtaaggtaaccctacggttacccttaccgtaccgtacctaacccgtaaccgccgtaaaccgtacccggtaacgacccggttaaacgggttaccttaaccgggttaaggtttaacggtttacgtttaacgggttaactttttaacggtttaaccgtacgtaccggtaacgtaggtaccggtaacgtacggtaacgtacccgttaccgtccgggtaccttacgtccgtacccgttacggtaccgggtaccggggaccggtaaacgggtaacccgtagggtaagtaaccgtaaaccgtaaccggaaacgtgggttaccgaacgtcctaacggaaccccgttagttacccg

SEQ ID NO: 196138 - DNA, 638 bp, Homo sapiens
  misc_feature: GYAE6OF01AV66J.4.52.E08.1.454.CMB.1.raw
  modified_base (209)..(209): a, c, t, g, unknown or other
  misc_feature (209)..(209): n is a, c, g, or t
  modified_base (300)..(300): a, c, t, g, unknown or other
  misc_feature (300)..(300): n is a, c, g, or t
  modified_base (540)..(540): a, c, t, g, unknown or other
  misc_feature (540)..(540): n is a, c, g, or t
tcagagcactgtagcacgaccggtgctcgatttagtcgagctctcagagagaaagggggaggaactgctcagttaggacccagagggaaccatggaagccccagctcagcttctcttcctactgctactctggctcccagactaccaccggagaaattgtgttgacacagtcctccagccaccctgtctttgtcctccgaaggggaaancgcccaccctctccgtgcgagggccagtcagagtgtagcagctacttgcctggtaccaacagaaacctggccaggcctccgaggcctcctnactctatgatcgctactcccgaacgcgggacccacgtcggaccactacccgacgccgtaaggttccgacgggtacggactagggttcgggtctacggggactacggtccgtttcaccttacctacacctacgtaccaccacgtaccgtaggacgtcgtaacggagttactttacggtacttatttaagttcgtgttacgaagccgtaaggttcctaacggactaaccggtcgtaccttcncggtcctcgttacccggttacggaccgggtacggaacgtacgggtaggacgtaacgtaaccgtaacgtaacgtcggtcggtactcggacctcgtaccg

SEQ ID NO: 196139 - DNA, 138 bp, Homo sapiens
  misc_feature: GYAE6OF02HW18F.4.52.E08.1.454.CMB.1.raw
  modified_base (127)..(138): a, c, t, g, unknown or other
  misc_feature (127)..(138): n is a, c, g, or t
tcagagcactgtagcacgaccggtgctcgatttagtcgagctctcccgcgggctggcaaggcgcatagctgcctggtcaaggactacttccctacagtgctctgagcgggctggcaaggcgcatagnnnnnnnnnnnn

SEQ ID NO: 196140 - DNA, 532 bp, Homo sapiens
  misc_feature: GYAE6OF02JH9WF.4.52.E08.1.454.CMB.1.raw
  modified_base (204)..(204): a, c, t, g, unknown or other
  misc_feature (204)..(204): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctctcctgcagggccagtcagagtgttagcagctacttagcctggtaccaacagaaacctggccaggctcccaggctcctcatctatgatgcatccgacagggccatggcatcccagccaggttcagtggcagtgggctgggacagacttcactctcaccatcaccagcctagacgcctgaggtattttgctagtttattacgtgtcagcagcgtagcaacgtggccttctgctctacgtttccgggcggaacggggacctaaggggtcggaagtacgttaccgaaaacggtaccgttggtacggctacggaccaccgtacg

SEQ ID NO: 196141 - DNA, 562 bp, Homo sapiens
  misc_feature: GYAE6OF02I8GAE.4.52.E08.1.454.CMB.1.raw
  modified_base (204)..(204): a, c, t, g, unknown or other
  misc_feature (204)..(204): n is a, c, g, or t
  modified_base (362)..(362): a, c, t, g, unknown or other
  misc_feature (362)..(362): n is a, c, g, or t
  modified_base (366)..(366): a, c, t, g, unknown or other
  misc_feature (366)..(366): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctctcctgcagggccagtcagagtgttagcagctacttagcctggtaccaacagaaacctggccaggctcccaggctcctcatctatgatgcatccgacagggccacgtggcatcccagccaggttcagtgcagtgggtctgggacagctcnctcncacactcaccagcctagctcctgaggtatttgctagtttacttactgttcagcagtcgtacgctaacgtcggtccttcgtcgtccttcgtacgtttccgggacgggtaacgggtacccggtaagggtacggaaggtaacgttaaccgaaaacgggtaaccgttgggtacgggaccgtacggtacccgtacctaacg

SEQ ID NO: 196142 - DNA, 500 bp, Homo sapiens
  misc_feature: GYAE6OF02GQEB4.4.52.E08.1.454.CMB.1.raw
tcagagcactgtagcacgaccggtgctcgatttagtcgagctctcagagagaaaggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccgacagggccactggcatcccagccaggttcagtgcagtggtctgggacagacttcactctcaccatcaccagcctagagcctgaggtattttgctagtttattactgtcagcagcgtagcaactggcctctgctctacgtttcggcggagggaccgaaggtggagatacgaaacgactggtaggctgcacctac

SEQ ID NO: 196143 - DNA, 497 bp, Homo sapiens
  misc_feature: GYAE6OF02HD82N.4.52.E08.1.454.CMB.1.raw
  modified_base (204)..(204): a, c, t, g, unknown or other
  misc_feature (204)..(204): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaanagccaccctctcctgcagggccagtcagagtgttagcagctacttagcctggtaccaacagaaacctggccaggctcccaggctcctcatctatgatgcatccgacagggccactggcatcccagccaggttcagtgcagtggtctgggacagacttcactctcaccatcaccagcctagacgcctgaggtatttgctagtttattactgtcagcagcgtagcaactggcctctgctcacgtttcggcggaggaccgaaggtggagatacgaaacgactggtggctgcactac

SEQ ID NO: 196144 - DNA, 515 bp, Homo sapiens
  misc_feature: GYAE6OF02FQX3R.4.52.E08.1.454.CMB.1.raw
  modified_base (204)..(204): a, c, t, g, unknown or other
  misc_feature (204)..(204): n is a, c, g, or t
  modified_base (355)..(355): a, c, t, g, unknown or other
  misc_feature (355)..(355): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaanagccaccctctcctgcagggccagtcagagtgttagcagctacttagcctggtaccaacagaaacctggccaggctcccaggctcctcatctatgatgcatccgacagggccactggcatcccagccaggttcagtgcagtggctgggacngacttcactctcacatcaccagcctagagcctgaggtattttgctagtttacttactgtcagtcagcgtagcaacgtggcctctgctctacgtttcggcggacgggaccgtaagggtggaagacttacgaaacgtacgtggtacggctcggaccactacg

SEQ ID NO: 196145 - DNA, 571 bp, Homo sapiens
  misc_feature: GYAE6OF02H3FOY.4.52.E08.1.454.CMB.1.raw
  modified_base (203)..(203): a, c, t, g, unknown or other
  misc_feature (203)..(203): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccaggggaanagccaccctctcctgcagggccagtcagagtgttagcagctacttagcctggtaccaacagaacctggccaggctcccaggctcctcatctatgatgcatccgacacgggccacgtggcactccccagccaggttcaggtggcaggtgggtcgtgggacagtaccttcactctaccaccatccaccacgcctagacgtcctaggaggtattttgacttagttttattcttgtcagcagcgtagacctacgtcggtccttcgtcgtccttccgtacgtttccgggacgggtaacgggtaccgtaaggggtcggtaataacgtaaccgtaaacggtaacgttcggtacggtccgtacggacctacctacg

SEQ ID NO: 196146 - DNA, 533 bp, Homo sapiens
  misc_feature: GYAE6OF02IS62Z.4.52.E08.1.454.CMB.1.raw
  modified_base (204)..(204): a, c, t, g, unknown or other
  misc_feature (204)..(204): n is a, c, g, or t
  modified_base (471)..(471): a, c, t, g, unknown or other
  misc_feature (471)..(471): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctctcctgcagggccagtcagagtgttagcagctacttagcctggtaccaacacgaaacctggccaggcctcccgaggctcctcatctatgatgcatccgacgacgggccacgtggcactcccgagcccaggttccaggtcggctaggtgggtcgtgggacagtacttcacttctacacctactaccaccacgacctagacgcgtggaggtatttcgacttagtttacttacgtgtactagcagcgtagacacgtcgcctntcgctctcgttcggcggaggaccgaaggtagagatacgaagtacgtgtgcgtgaccactacg

SEQ ID NO: 196147 - DNA, 547 bp, Homo sapiens
  misc_feature: GYAE6OF02HT5QH.4.52.E08.1.454.CMB.1.raw
  modified_base (203)..(203): a, c, t, g, unknown or other
  misc_feature (203)..(203): n is a, c, g, or t
  modified_base (261)..(261): a, c, t, g, unknown or other
  misc_feature (261)..(261): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccaggggaanagccaccctctcctgcagggccagtcagagtgtagcagctacttagcctggtaccaanagaaacctggaccaggctcccgaggctcctcatctatgatgcactccgacagggccacgtggcactcccagccgaggttcagtggctaggtggtctcgggacacgacttcactctcactatcacagcctagacgtcctagagttattttgcttagttttatacttgtctagctagtcgtagctaacgtcgccttcgtgtcctcgtaccgtttcgggaccggtagggtaccgaaagggtcggtagaacgtacgaaacgtacgtaggtcggactacggccaacctacg

SEQ ID NO: 196148 - DNA, 527 bp, Homo sapiens
  misc_feature: GYAE6OF02HLN9G.4.52.E08.1.454.CMB.1.raw
  modified_base (204)..(204): a, c, t, g, unknown or other
  misc_feature (204)..(204): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaanagccacctctcctgcagggccagtcagagtgtagcagctacttagcctggtaccaacagaaacctggccaggcctcccaggctcctcatctatgatgcatccgacacgggccacgtggcactcccgagccaggttcagtggcaggtgggtctgggacagtacttcactctcaccatcaccagcctagacgcctgaggtatttgcttagtttattacgtgtcagcagcgtagcaacgtcggcctcgtcgctcgtacgtttcggacggtacgggaccgaagggtcggaagactacgaaacgacgtaggtggacgtgaccactacg

SEQ ID NO: 196149 - DNA, 545 bp, Homo sapiens
  misc_feature: GYAE6OF02JBZ0P.4.52.E08.1.454.CMB.1.raw
  modified_base (203)..(203): a, c, t, g, unknown or other
  misc_feature (203)..(203): n is a, c, g, or t
  modified_base (411)..(411): a, c, t, g, unknown or other
  misc_feature (411)..(411): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgctccaggggaaangccaccctctcctgcagggccagtcagagtgtagcagctacttagcctggtaccaacagaaacctggccaggctccaggctcctcatcatgatgcatccgacagggcccactggccactccccaggcccaggttccagtcggctaggtgggtctgggacaggaccttcgactcgtccaccagtccaccagcctgcagtctagtaagtntttggtatttatactgtcagctagtaataactacgtgcctactacgtaccgttacggcggaagggtacctagggtacggaagacgtaacgaaacggtaagtcgtaggctacgcctaacctacgtcttaggtacc

SEQ ID NO: 196150 - DNA, 518 bp, Homo sapiens
  misc_feature: GYAE6OF02GEEBG.4.52.E08.1.454.CMB.1.raw
  modified_base (204)..(204): a, c, t, g, unknown or other
  misc_feature (204)..(204): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaanagccaccctctcctgcagggccagtcagagtgttagcagctacttagcctggtaccaacagaaacctggccaggctcccaggctcctcatctatgatgcatccgacagggccactggcatcccagccaggttcagtgcagtgggtctgggacagacttcactctcaccatcaccagcctagacgcctgaggtatttgcttagtttattacttgtcagcagcgtagcaacgtgccttctgctctacgttcggacggacggaccgtaagggtcggagacgtacgaaacggtacgtggtacggctacgaccactacg

SEQ ID NO: 196151 - DNA, 515 bp, Homo sapiens
  misc_feature: GYAE6OF02FY0WH.4.52.E08.1.454.CMB.1.raw
  modified_base (448)..(448): a, c, t, g, unknown or other
  misc_feature (448)..(448): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcagctacttagcctggtaccaacagaaacctggccaggcctcccaggctcctcatctatgatgcatccgacacgggccacgtggcactcccagccaggttcagtggcaggtgggtctgggacagtacttcacttctcaccactcaccagcctagacgtcctagagtatttgctagtttattactgtcagcagcgtagctacgtgcctngctctcgttcggcggtacggaccgaagggtggagactacgaacgacgtggtacggctcgacacgtac

SEQ ID NO: 196152 - DNA, 509 bp, Homo sapiens
  misc_feature: GYAE6OF02HP6O5.4.52.E08.1.454.CMB.1.raw
  modified_base (370)..(370): a, c, t, g, unknown or other
  misc_feature (370)..(370): n is a, c, g, or t
  modified_base (442)..(442): a, c, t, g, unknown or other
  misc_feature (442)..(442): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccgacagggccactggcatcccagccaggttcagtggcaggtgggtctgggacagacttcactcncaccatccaccagcctagagcctgagtattttgcttagtttactacttgtcagcagtcgtagcaactgcctntcgtctctacgttcggcggtaggaccgaaggtggagatacgaaacgtacgtagtgcgtgacactacg

SEQ ID NO: 196153 - DNA, 525 bp, Homo sapiens
  misc_feature: GYAE6OF02JEQXO.4.52.E08.1.454.CMB.1.raw
  modified_base (204)..(204): a, c, t, g, unknown or other
  misc_feature (204)..(204): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctctcctgcagggccagtcagagtgttagcagctacttagcctggtaccaacagaaacctggccaggctcccaggctcctcatctatgatgcatccgacacgggccactggcactcccagccaggtcagtgcagtgggtctgggacagacttcactctcaccatcaccagcctagacgcctgaggtattttgctagtttattactgtcagcagcgtagcaacgtcgcctctgtcctctacgtttccggcggtacgggaccgtaagggtggaggtacgtacgaaaccgaactggtacggctacggtccaccgtacg

SEQ ID NO: 196154 - DNA, 517 bp, Homo sapiens
  misc_feature: GYAE6OF02HCZKL.4.52.E08.1.454.CMB.1.raw
  modified_base (204)..(204): a, c, t, g, unknown or other
  misc_feature (204)..(204): n is a, c, g, or t
  modified_base (262)..(262): a, c, t, g, unknown or other
  misc_feature (262)..(262): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaanagccaccctctcctgcagggccagtcagagtgttagcagctattagcctggtaccaanagaaacctggccaggctcccaggctcctcatctatgatgcatccgacacgggccacgtggccatcccagcccaggttcagtggctaggtgggtctgggacagcttcactctcacatcacagcctagacgctagaggtatttgacttagttttacttactgtcagtcagcgtagcaacgtggtcctctcgctctacgttcgggcggtacggtaccgaaggtggagatacgaacgacgtggtggctcgacacctacg

SEQ ID NO: 196155 - DNA, 553 bp, Homo sapiens
  misc_feature: GYAE6OF02FHHOI.4.52.E08.1.454.CMB.1.raw
  modified_base (205)..(205): a, c, t, g, unknown or other
  misc_feature (205)..(205): n is a, c, g, or t
  modified_base (292)..(292): a, c, t, g, unknown or other
  misc_feature (292)..(292): n is a, c, g, or t
  modified_base (380)..(380): a, c, t, g, unknown or other
  misc_feature (380)..(380): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgctccgaggggaaagngccaccctctcctgcagggccagtcagagtgttagcagctacttagcctggtaccaacagaaacctggccaggctcccaggctcctnatctatgatgcactccgacgacgggccacgtcggcactcccagccaggttcaggtggcaggtcgggtcgtgggacaggcttcgactcncaccatcaccagcctagacgctgaggtatttgacttagtttattactgtacagtcagtcgtagcaacgtcggccttcgtcgcttcgtacgtttccgggacgggtacgggaccgtaagggtggaacgtacgttaacgaaaccgtacgtcggtacggtcgtacggaccaccgtac

SEQ ID NO: 196156 - DNA, 555 bp, Homo sapiens
  misc_feature: GYAE6OF02GCDNN.4.52.E08.1.454.CMB.1.raw
  modified_base (205)..(205): a, c, t, g, unknown or other
  misc_feature (205)..(205): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccgaggggaaanagccaccctctcctgcagggccagtcagagtgttagcagctattagcctggtaccaacagaaacctggccaggctcccaggctcctcatctatgatgcatccgacagggccacgtggcactcccagccctaggttcagtggcaggtgggtctgggacagacttcactctacaccatccaccagcctagacgcctaggaggtattttcgcttaagttttattacttgtacaactagcgtagactacgtcgcctctcgcttcacgtttcgggacggtacgggacctaagggtgggaagtacgtaaccgaaacggtacgttacggacggtaccttaggaccctaccagttccg

SEQ ID NO: 196157 - DNA, 647 bp, Homo sapiens
  misc_feature: GYAE6OF02GSIR9.4.52.E08.1.454.CMB.1.raw
  modified_base (376)..(376): a, c, t, g, unknown or other
  misc_feature (376)..(376): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcagctacttacgcctggtaccaacaagaacctggaccaaggcctacccgaggcctcctacactctatgatcgcagtccgacgacggcccacgtggaccactcccgaggccaggttcaggtcggctaggttgggtcngggacagtaccttcgactcctcaccactccaaccagacccgttagacgtcctaggtaacgtagttttacggacttacggttttacttacgtcgtacaggtcctaggtaccgttacgacctaaaccgttcggtacccgttcgtcgtccgtaccgttaccggtttccgggaccgggtaacgggtaacccggtaaaggggttaccggtaaggtaaccgttaacccgaaaggtaaccggtcggttaccggaccggtacgtaccgtaacccgtacg

SEQ ID NO: 196158 - DNA, 541 bp, Homo sapiens
  misc_feature: GYAE6OF02FGX39.4.52.E08.1.454.CMB.1.raw
  modified_base (203)..(203): a, c, t, g, unknown or other
  misc_feature (203)..(203): n is a, c, g, or t
  modified_base (308)..(308): a, c, t, g, unknown or other
  misc_feature (308)..(308): n is a, c, g, or t
  modified_base (447)..(447): a, c, t, g, unknown or other
  misc_feature (447)..(447): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgctccaggggaaangccaccctctcctgcagggccagtcagagtgttagcagctacttagcctggtaccaacagaaacctggccaggctcccaggctcctcatctatgatgcatccganagggccacgtggcatcccagccaggttcagtggcagtcgggtctgggacagtacttcactctcaccactcaccagcctagacgccgtgacggtatttgctagtttattactgtcagcagcgtagcaacgtggaccttcncgcttcgtacgtttcgggacggacgggaccgtaagggtggaacgacgttaacgaaaacggtacgttacggtacggtcgtacgacctaccgtacg

SEQ ID NO: 196159 - DNA, 594 bp, Homo sapiens
  misc_feature: GYAE6OF02GY552.4.52.E08.1.454.CMB.1.raw
  modified_base (204)..(204): a, c, t, g, unknown or other
  misc_feature (204)..(204): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctctcctgcagggccagtcagagtgttagcagctacttagcctggtaccaacagaaacctggccaggcctcccgaggcctcctcatctatgatgcatccgacacgggccacgtggccactcccagccctaggttcaggtggcgtaggtcgggtcgtggggaacagtacctttcacgttcctcaccctactccaccacgtcctagacgtcgtaggagtatttgcttagtttattactgtacagtcagacgtacgacgtaacgtcggccttacgtcgtcctacgtaccgtttcgggaccgggtacgggtaccggtaaggggtcgggaagtacgttaaccgtaaacggtaacgttacgggtacggacgtacgtacccgaccgtaacg

SEQ ID NO: 196160 - DNA, 589 bp, Homo sapiens
  misc_feature: GYAE6OF02HXYQO.4.52.E08.1.454.CMB.1.raw
  modified_base (294)..(294): a, c, t, g, unknown or other
  misc_feature (294)..(294): n is a, c, g, or t
  modified_base (359)..(359): a, c, t, g, unknown or other
  misc_feature (359)..(359): n is a, c, g, or t
  modified_base (440)..(440): a, c, t, g, unknown or other
  misc_feature (440)..(440): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcagctacttagcctggtaccaacagaaactggccaggctccagctctcatctangatgcatccgacacgggccacgtggcactcccgagtccaggttccaaggtcggcaggtcggtacnggggacagacttcacgtctccgacatccaccagacctagacgtcctaggaggtacttttgaccttagttttacttacgttntacagtacagtcgtaacgtacgtaaccgtcgggtacccttcgtcgtaccgttccgttaccgtttccgggacgggtacgggtaccgaaggggtacggtaacgtaacgtaccgaaacgtaacgtcggtacggtcgtcgtaccgtacgtacg

SEQ ID NO: 196161 - DNA, 595 bp, Homo sapiens
  misc_feature: GYAE6OF02JEJH2.4.52.E08.1.454.CMB.1.raw
  modified_base (205)..(205): a, c, t, g, unknown or other
  misc_feature (205)..(205): n is a, c, g, or t
  modified_base (292)..(292): a, c, t, g, unknown or other
  misc_feature (292)..(292): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccgaggggaaanacgcccaccctctcctgcgagggccagtcagagtgttagcagctacttagcctggtaccaacagaaacctggccaggctccagctcncatctatgatgcatcccgagacgggcccagtcggaccactcccagcccaggttccgaaggtcggctagggtcgggtctaggggacagtaccttcactctcactatccaccagcctagacgtccgtagtaggtcttttcgacttagtttacttacgtgtacagtcaaggtccgtagtaccgtaacgtcggtaccttcgtcgtcctaccgttacggtttccggggacggtacgggtaacccgtaagggtacgaacggtaactaacggaaaccggtacgttggacggtacgtagaccctacgtacg

SEQ ID NO: 196162 - DNA, 496 bp, Homo sapiens
  misc_feature: GYAE6OF02FIB7A.4.52.E08.1.454.CMB.1.raw
  modified_base (204)..(204): a, c, t, g, unknown or other
  misc_feature (204)..(204): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaanagccaccctctcctgcagggccagtcagagtgttagcagctacttagcctggtaccaacagaaacctggccaggctcccaggctcctcatctatgatgcatccgacagggccactggcatcccagccaggttcagtggcagtgggtctgggacagacttcactctcaccatcaccagcctagagcctgaggattttgctagtttattactgtcagcagcgtagcaactggcctctcgctcactttcggcggagggaccaaggtggagatacgaaacgactggtgctgcacca

SEQ ID NO: 196163 - DNA, 553 bp, Homo sapiens
  misc_feature: GYAE6OF02HXW7W.4.52.E08.1.454.CMB.1.raw
  modified_base (386)..(386): a, c, t, g, unknown or other
  misc_feature (386)..(386): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccgaggggaagagccaccctctcctgcagggccagtcagagtgttagcagctactagcctggtaccaacaacgaaacctggccaggcctacccgaggctcctcatctatgatgacactccgacgacgggcccacgtcggcactcccagcctaggttcaggtggcaggtgggtcagggacagtacttcacttcncacctatccacacgcctagacgtcgtaggagttatttgacttaagttttattactgtcagtcgagcgtagctactcggtcctctgtctcgtacgttcggacggtaggaccgaagggtacggaagtacgtaccgaaacgtacgtggtacggacgtacgacctactacg

SEQ ID NO: 196164 - DNA, 550 bp, Homo sapiens
  misc_feature: GYAE6OF02FNDT0.4.52.E08.1.454.CMB.1.raw
  modified_base (204)..(204): a, c, t, g, unknown or other
  misc_feature (204)..(204): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctctcctgcagggccagtcagagtgttagcagctacttagcctggtaccaacagaaacctggccaggcctcccaggctcctcatctatgatgcatccgacacgggccacgtggcatcccaagccaggttcagtggcaggtgggtctgggacagcttcactctcaccatcaccagcctagagcctgaggtatttgacttagtttattactgtacagcagcgtagccaacgtggaccttcgtcgtaccttctacgtttccgggacgggacgggtacccgtaagggtcggaggtaacgtaccgaaaacggtacgttaggtacggcctacggtaccaccgtacg

SEQ ID NO: 196165 - DNA, 605 bp, Homo sapiens
  misc_feature: GYAE6OF02GU6QH.4.52.E08.1.454.CMB.1.raw
  modified_base (204)..(204): a, c, t, g, unknown or other
  misc_feature (204)..(204): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaanagccaccctctcctgcagggccagtcagagtgttagcagctacttagcctggtaaccaacagaaacctggtacaggcctcccgaggcctcctcacttctatgatcgcatccgacacgggccacgtggcactcccgagcctaggttcaggtcggacaggtcgggtctggggacagtacttcgaccgtctaccgacctactacccaaccacgtcctaacggacgtcccgtaggaacggttacttttggacttaaggttttactacgttcgtacagtcgagtacgtacgcgtaaccgttcggtcccttcgtacgtcttaccgttacggtttcgggacgggtacggtaccgaagggtcggaagtactaacgaaacggtactggtacggcctcggacctacctacg

SEQ ID NO: 196166 - DNA, 596 bp, Homo sapiens
  misc_feature: GYAE6OF02IQY9I.4.52.E08.1.454.CMB.1.raw
  modified_base (203)..(203): a, c, t, g, unknown or other
  misc_feature (203)..(203): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccacctgtctttgtctccaggggaaanagcccacctctcctgcagggccagtcagagtgttagcagctactagcctggtaccaacagaaacctggaccaggctcccaggctcctcatctatgatgcatccgacagggccacgtgcatcccagccagttcagtggcgagtggtctgggacagacttcactctcacctactccaaccacgcctagacgtccgtaggtaggtacttttgacttaggtttattacgttgtctagcgagtcgtagacctaacgtcggtacccttcgtcgccgttacctacggttttccggggacgggtaacggggtaccggtaacggggttacgggaacggtaacgttaaccggaaaaccggtaaccgttgggttacgggaccgttacggaccgtaccctaacgg

SEQ ID NO: 196167 - DNA, 540 bp, Homo sapiens
  misc_feature: GYAE6OF02FN7CP.4.52.E08.1.454.CMB.1.raw
  modified_base (369)..(369): a, c, t, g, unknown or other
  misc_feature (369)..(369): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccgacagggccacgtggcactccagccagttcagtggcagtggtctgggacagtacttcactcncaccatcaccagcctaggactccgtggacggtatttcgacttagttttacttactgtcagcagtcgtacggacaacgtcgccttcgtcgcttcgtaccgtttcggccgggaggaccgtaagggtaggacgtaacgtaccgaaaggtactggttaccggctaggcccactac

SEQ ID NO: 196168 - DNA, 596 bp, Homo sapiens
  misc_feature: GYAE6OF02FN5KG.4.52.E08.1.454.CMB.1.raw
  modified_base (204)..(204): a, c, t, g, unknown or other
  misc_feature (204)..(204): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaanagccaccctctcctgcagggccagtcagagtgttagcagctacttagcctggtaccaacagaaacctggccaggctcccgaggcctcctcatctatgatcgcactccgacgacgggcccacgtggaccacgtcccgagccctaggttccaggtggcgtaggtgggtcgtgggacaacggtaccttcgacctcgtaccaccgtactccaaccacgaccctagccgtcctaggacggtagttttcgacgttaagtttacttcgtgtcagtcgagtcgtagacgtaacgtcggacctcgtacgtcctacgtaccgtttcggggacggtacggaccggtaagggtacggaagtaacgaccgaaacgtacgtcggtacgggctacggacctactacg

SEQ ID NO: 196169 - DNA, 550 bp, Homo sapiens
  misc_feature: GYAE6OF02FI0RW.4.52.E08.1.454.CMB.1.raw
  modified_base (204)..(204): a, c, t, g, unknown or other
  misc_feature (204)..(204): n is a, c, g, or t
  modified_base (401)..(401): a, c, t, g, unknown or other
  misc_feature (401)..(401): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaangcccaccctctcctgccagggccagtcagagtgttagcagctacttagcctggtaccaacagaaacctggccaggctcccaggctcctcatctatgatgcatccgacagggccatggcatcccagccaggttcagtggcaggtggtctgggacaggacttcactctcaccatcaccagcctagacgcctggacggtnttttgcttagtttacttacgtgtacagctagtcgtagaccgtaaacttcgggtaccttcgtcgcctccgtaccgtttcgggaccggtacgggaccgtaagggtcggaacgtaactacgaaacgtacgtggtacggctaggaccactacg

SEQ ID NO: 196170 - DNA, 524 bp, Homo sapiens
  misc_feature: GYAE6OF02IG8SG.4.52.E08.1.454.CMB.1.raw
  modified_base (353)..(353): a, c, t, g, unknown or other
  misc_feature (353)..(353): n is a, c, g, or t
  modified_base (380)..(380): a, c, t, g, unknown or other
  misc_feature (380)..(380): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcagctacttagcctggtaccaacagaaacctggccaggcctcccaggctcctcatctatgatgcatccgacagggccactggcatcccagccaggttcagtggcaggtggtcngggacagacttcactctcaccatcacncgctagagcctagagtatttgcttagtttattactgtcagcagcgtagctaacgtcgacctcgtcgctctacgtttcgggacggtacgggaccgaaggtggagtaactaccgaaacggtacgtagtcggacgtacgcacctacg

SEQ ID NO: 196171 - DNA, 566 bp, Homo sapiens
  misc_feature: GYAE6OF02I0F7O.4.52.E08.1.454.CMB.1.raw
  modified_base (203)..(203): a, c, t, g, unknown or other
  misc_feature (203)..(203): n is a, c, g, or t
  modified_base (296)..(296): a, c, t, g, unknown or other
  misc_feature (296)..(296): n is a, c, g, or t
  modified_base (562)..(562): a, c, t, g, unknown or other
  misc_feature (562)..(562): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagactaccaccggagaaattgtgttgacacagtctccagccacctgtctttgctccgaggggaancgccaccctctcctgcgagggccagtcagagtgtagcagctacttagcctaggtaccaacacgaaacctgccgagcctcccgaggtcctcctnatctatgatcgactactccgacgacgggccagtcgcaccgtccagcccgtaggttcaggtcggcagggttcgggtactgggacacgtactacgactctacacactacaccacgctagacgcgtaggtagttacgtttgacgttaagtttattacgtgtcagctacgacgtagactacgtcggtcttcgtgcctacgtcgttcggacgggtacggtaccggaaggtaggagtaactaacgtaaacggacgtggtacgctacgtaccntacg

SEQ ID NO: 196172 - DNA, 621 bp, Homo sapiens
  misc_feature: GYAE6OF02IFU40.4.52.E08.1.454.CMB.1.raw
  modified_base (204)..(204): a, c, t, g, unknown or other
  misc_feature (204)..(204): n is a, c, g, or t
  modified_base (263)..(263): a, c, t, g, unknown or other
  misc_feature (263)..(263): n is a, c, g, or t
  modified_base (271)..(271): a, c, t, g, unknown or other
  misc_feature (271)..(271): n is a, c, g, or t
  modified_base (301)..(301): a, c, t, g, unknown or other
  misc_feature (301)..(301): n is a, c, g, or t
  modified_base (315)..(315): a, c, t, g, unknown or other
  misc_feature (315)..(315): n is a, c, g, or t
  modified_base (324)..(324): a, c, t, g, unknown or other
  misc_feature (324)..(324): n is a, c, g, or t
  modified_base (364)..(364): a, c, t, g, unknown or other
  misc_feature (364)..(364): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaancgccaccctctcctgccagggccagtcagagtgttagcagctacttagctggtaccaanacgtaacnggccaggctccccgaggctcctcatcttangactgcatccgaangggtcccancggtcatcccagctaggtcagtcggatgtgggtcaggganacgtaccttcacttccgtacacctactccaaccacgtacctacggacgtccgttagtacggtattttgaccttaaggttttacttaacgtggttacagtaccgtacggtacgtaccgacgtaacgttcgtaccgttccgttagtaccgttccgttacgtttccgggacgggtaaccgggtaaccgtaagggttcgggaacgtaacgtaccggtaaaacgtacgttacggtacggtcgtacggtacccaacgttaacg

SEQ ID NO: 196173 - DNA, 608 bp, Homo sapiens
  misc_feature: GYAE6OF02HARWV.4.52.E08.1.454.CMB.1.raw
  modified_base (152)..(152): a, c, t, g, unknown or other
  misc_feature (152)..(152): n is a, c, g, or t
  modified_base (276)..(276): a, c, t, g, unknown or other
  misc_feature (276)..(276): n is a, c, g, or t
  modified_base (285)..(285): a, c, t, g, unknown or other
  misc_feature (285)..(285): n is a, c, g, or t
  modified_base (291)..(291): a, c, t, g, unknown or other
  misc_feature (291)..(291): n is a, c, g, or t
  modified_base (304)..(304): a, c, t, g, unknown or other
  misc_feature (304)..(304): n is a, c, g, or t
  modified_base (314)..(314): a, c, t, g, unknown or other
  misc_feature (314)..(314): n is a, c, g, or t
  modified_base (370)..(370): a, c, t, g, unknown or other
  misc_feature (370)..(370): n is a, c, g, or t
  modified_base (391)..(391): a, c, t, g, unknown or other
  misc_feature (391)..(391): n is a, c, g, or t
tcagagcactgtagcacgaccggtgctcgatttagtcgagctctcagagaggaaagggggaggaactgctcagttaggacccagagggaaccatggaagcccagctcagcttctcttcctcctgctactctggctcccagataccaccgganaaattgtgttgacacagtctccagccaccctgttcttgtctccgaggggaaagagccaccctctctgcagggccagtcagagtgttagcagctactagcctggtacaacagaacctggacagcnccagctccnatctangactgcatccganacgggccagnggcactcccagccgagttcaggtcgcaggtggtcgagggacagtacttcgacttcncgaccatcactagcctagacnccgagtagtatttgataacgttttacttacgttcgtacgtacgtacgacgtacggtaacgtaccgtaacgtccgtaccgttacgttccgtactaccgtttacggtttccgggtacgggaacggggttaacccggtaaaggggtacggtaacggtaaccggttaacgaaaaccgggtacgtacgggttacgggtacgttacggtaccctaacgtaccg

SEQ ID NO: 196174 - DNA, 585 bp, Homo sapiens
  misc_feature: GYAE6OF02IX3J4.4.52.E08.1.454.CMB.1.raw
  modified_base (204)..(204): a, c, t, g, unknown or other
  misc_feature (204)..(204): n is a, c, g, or t
  modified_base (241)..(241): a, c, t, g, unknown or other
  misc_feature (241)..(241): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaanagcccaccctctcctgcagggccagtcagagtgttancagctacttagcctggtaccaacagaaacctggccaggcctacccgaggctcctcatctatgatcgacactccggacacggggcccacgtggcactcccgagccctaggttcagtcggctaggtgggtctggggactaggtacttcaactcctacaccactccaccacgcctaagcgcctaggacgttattttgacgttaagttttacttacgttcgtacagctaggacgtaacgacctaacgtcggtacctcgttagcccgttacgtaccgtttcgggacggtacgggaccgtagggtacggataacgtacgaaacgtacgtgtacggtctacggtccactcg

SEQ ID NO: 196175 - DNA, 636 bp, Homo sapiens
  misc_feature: GYAE6OF02I1NXY.4.52.E08.1.454.CMB.1.raw
  modified_base (205)..(205): a, c, t, g, unknown or other
  misc_feature (205)..(205): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgctccgaggggaaagngccaccctctcctgcagggccagtcagagtgttagcagctacttagcctggtaccaacagaaacctggccaggcctccaggctcctcatctatgatcgcactccgacgtacgggccacgtggacactccgagccaggttcaggtggcgaggtggtcgtgggacagcttcactctcacactcaccacgccgtacgacgtccgtaggtacggttattttcgaccgtttaagttttaactttacgttcgttactaggtaccgtacggtacgtacgtaccgtaacgttcggtacccttccgtacggtccttaccgttaccgggtttaccgggaccggggtaacgggtaacccggtaaaggggttcgggaaacggtaccggttaaaccgaaacggtacggttacgggttacggaccgttacgaccgtacccgtacg

SEQ ID NO: 196176 - DNA, 699 bp, Homo sapiens
  misc_feature: GYAE6OF02HH5NO.4.52.E08.1.454.CMB.1.raw
  modified_base (205)..(205): a, c, t, g, unknown or other
  misc_feature (205)..(205): n is a, c, g, or t
  modified_base (265)..(265): a, c, t, g, unknown or other
  misc_feature (265)..(265): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggcctcccagactaccaccggagaaattgtgttgacacagtctccagccaccctgtctttgctccgaggggaanacgccaccctctcctgcgacgggccagtcagagtgtagcagctactagcctaggaccaanacgaacctggaccaggcctccgaggtcctcctacactctatcgatcgacctacgtacccgacgacggggtccctaacgtcggacctaccgtaccccgaaggtcccgtaggttccgaacgggttcggaccggtaaggggtttcggggtccgttacgggggaaacctaacggttacccttttaccgaaccgttccgtaaccgaacccgtaacgttacccaacccgtacgtacccgtaaggaccgtaccgttaggtaacggttacttttcgactttaagttttacgttacgtacgtacgtacgctacggtacgtaacgaccgtaaccgtcggtcccttcgtcgtccttacgttaccggttcgggacggaacggtaaccggaggtaggtaacgtacgtaaccgtaaagtcgttcggtacggtactacggacctactcg

SEQ ID NO: 196177 - DNA, 552 bp, Homo sapiens
  misc_feature: GYAE6OF02GMXPC.4.52.E08.1.454.CMB.1.raw
  modified_base (204)..(204): a, c, t, g, unknown or other
  misc_feature (204)..(204): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctctcctgcagggccagtcagagtgttagcagctacttagcctggtaccaacagaaacctggccaggctcccaggctcctcatctatgatgctagtccgacacggggccacgtggcactcccagccaggttcagtggcagtgggtctgggacagtactcgactctcaccatcaccagcctagacgcctgaggtatttgcttagtttacttacgtgtcagtcagtcgtacgctaacgtcgtccttctcgtcctcgttacgtttcgggacgggtacgggtaccgtaagggtcggaagtaacgtaacgtaaacggtacgtgggtcgacgttacggacctactacg

SEQ ID NO: 196178 - DNA, 568 bp, Homo sapiens
  misc_feature: GYAE6OF02I9LJK.4.52.E08.1.454.CMB.1.raw
  modified_base (204)..(204): a, c, t, g, unknown or other
  misc_feature (204)..(204): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaanagccaccctctcctgcagggccagtcagagtgttagcagctacttagcctggtaccaacagaaacctggccaggcctcccgaggctcctcatctatgatgcatccgacacgggccacgtggcatcccagccgaggttcagtcggctaggtggtctgggacagacttcactctacaccatccaccgacgccgtagctccgtagaggttactttggcttaagttttattaccgttgtactagtccagtacgtacgctaaccgtcggtcccttctcgtccttccgtaccgtttcgggaccggagggtacccgtaagggtcggaacgtactaaccggaaacgtacgttggaggctcggtccaacgtcg

SEQ ID NO: 196179 - DNA, 720 bp, Homo sapiens
  misc_feature: GYAE6OF02HU5TA.4.52.E08.1.454.CMB.1.raw
  modified_base (203)..(203): a, c, t, g, unknown or other
  misc_feature (203)..(203): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgctccaggggaaancgccaccctctcctgcagggccagtcagagtgttagcagctacttagccttggtaaccaacacgaaacctggaccaggcctcccgaggcctcctcatctatgatgcatccgacacgggccagtcggacactcccgagtccgaaggttcaaggtcgggactagggtcgggtccgtacggggactaaggtacctttaccgaccgtcctacccaaccctacgttaccccaacccgtaacggtacccccttaaggaccgtacccgttagggtaacggtttacgtttttacggaccgtttaaaggttttttaaccttaacgtttcgttaccgaaggtacccgtaaggttaccggtaacgtaacccgtaacgttccggtccctttacgttccggaccgtttaccgttacccgggttttccggggaccgggtaaccgggtaacccggaaggggttaccgggaactaacggtaaccgtaaacggtaccgttcgggtaccggtcctacggtacccctacgttaccg

SEQ ID NO: 196180 - DNA, 754 bp, Homo sapiens
  misc_feature: GYAE6OF02F1Y72.4.52.E08.1.454.CMB.1.raw
  modified_base (204)..(204): a, c, t, g, unknown or other
  misc_feature (204)..(204): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaanagccacccctctccgtcgcggacggcctacgtcaggtagttagtacgacagtacttacgtacgccgtacggtaaccaacgaacgtaaccgtcggaccgtacggtccctacccggacggtccctcctacgacttacgtagtacgtactcggactaccgtaccgaacggaccggaccacggtacggacctaccgaccgacgtccggtacggttacgagggtcggacgtaggggttcgggttacggtacgggaactacggttaccttaccgtaccgttccgtacccaacctaccacccgtaaaccgtacggttacccggtaaacggccgtaccggtaagggttaaccggttttcgtttacggacgttttaagtttaaccttcggttacgtacgacgtacggtacggtagttaccgaaccgttaccgtcggtacccttggaccttaccgttaccgtttaccgggtcggggacggtaaacgggaccggttaagggacggtaacgtaacgtaaccgaaacgtcgggttaggaccgtacgtacgtaccctagttacc

SEQ ID NO: 196181 - DNA, 629 bp, Homo sapiens
  misc_feature: GYAE6OF02HBTKP.4.52.E08.1.454.CMB.1.raw
  modified_base (204)..(204): a, c, t, g, unknown or other
  misc_feature (204)..(204): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctctcctgcagggccagtcagagtgttagcagctacttagcctggtaccaacacgaaacctggacccaggcctcccgaggcctcctcatctatgatgcagtccgacgagggcccaacgtggaccactccccgaggcctaggttcaggtggctaggtgggtcgtgggaactagtacttcgacgttctcgaacctactaccaaccacgtccctaaggacgtccgtagtacggtattttcgacgttaagttttacttacgttcgttacgacgcgtaaggtacgtaggaccaacgttcggcccttacgtcgtccttaaccttcggtttaccggcgggtaacgggacccgtaaggggtacggtaaggtaacgtaaccgtaaaacggtaacgttgggtaccggtaccgtcggaccctacgtaccg

SEQ ID NO: 196182 - DNA, 622 bp, Homo sapiens
  misc_feature: GYAE6OF02GHNL8.4.52.E08.1.454.CMB.1.raw
  modified_base (205)..(205): a, c, t, g, unknown or other
  misc_feature (205)..(205): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccgaggggaaangccaccctctcctgcagggccagtcagagtgttagcagctacttagcctggtaccaacagaaacctggaccaggcctcccgaggcctcctcatctatgatgacactccgacgacgggccacgtggccactcccgagcctaggttcaggtggctaggtcgggtctgggactacgtactttcacttcctacaaccgtactcccgaaccgacgtacccgtaaggacgtccgtaggtaaggttacttttcgaccgttaagttttacttacgttgtacagtctacggtacgtacgacctaacgtcggtaccttcgtacgtccttaccgtaccgtttccggggacgggtaacgggaaccgtaaggggtacggtaacgtaacgtaaccgaaacgtacggttcggtacggtctacgacacctacg

SEQ ID NO: 196183 - DNA, 533 bp, Homo sapiens
  misc_feature: GYAE6OF02GD267.4.52.E08.1.454.CMB.1.raw
  modified_base (204)..(204): a, c, t, g, unknown or other
  misc_feature (204)..(204): n is a, c, g, or t
  modified_base (377)..(377): a, c, t, g, unknown or other
  misc_feature (377)..(377): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctctcctgcagggccagtcagagtgttagcagctacttagcctggtaccaacagaaacctggccaggctcccaggctcctcatctatgatgcatccgacacgggccacgtggcactcccagccaggttcagtcggcaggtgggtctgggacagcttcactctcaccntccacacgcctagcgccgtgagtatttgcttagtttacttacgtgtcagtcagtcgtagctaacgtcggtcctcgtgtcctcgtacgtttcggacgggtacggtaccgaagggtaggacgaatacgaaacggtacgtggtacggctcgacactacg

SEQ ID NO: 196184 - DNA, 614 bp, Homo sapiens
  misc_feature: GYAE6OF02H0CPF.4.52.E08.1.454.CMB.1.raw
  modified_base (202)..(202): a, c, t, g, unknown or other
  misc_feature (202)..(202): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtcttgtctccgagggaanagccaccctctcctgcagggccagtcagagtgttagcagctacttagccgtggtaaccaacacgaaacctggaccaggctccccgaggcctcctcattctatgatgcactccgacacgggccacgtgccactcccgagcctacggttcgacggtggcgtaggttgggtcgtaggggactacgtaccttacacgtcctaccgacctactaccaaccgacgtaccgtacggacgaccgtaggacggttacgttttgacgtttaagttttacgttacgttcgtacgagtcgagtacgtacgtacgtaacgtcgtacctgtccgtcgttccgtacgtttccgggacggacgggacggtaagggtcggaagtacgaacgaaaccggtacgttcgggacgtcgtcgtaccgtcctacg

SEQ ID NO: 196185 - DNA, 703 bp, Homo sapiens
  misc_feature: GYAE6OF02GCNAK.4.52.E08.1.454.CMB.1.raw
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccgaggggaaagagccaccctctcctgcagggccagtcagagtgttagcagctacttagcctggtaccaacagaaacctggccaggcctcccgaggcctcctcatctatgatgcactccgacgcggccacgtcgcactcccagcctaggtcaggtcggctaggtcgggtcgtgggactagtaccttcaccttcctaccacctactacccaaccgacgtaccctaaggacccgtccgtagggtacgggttacttttacggacgtttaacgtttttactttaccgttaggtaccgtaaggtaccgtaacggtaccggtaacgtacccgtaaccggttcggtaccctttccgttccggtccctttaccggttaacccggttttccgggggaccgggttaaaccggggtaacccggtaaagggggttcgggaaacgtaaccgtaacccgggtaaaaaccggttacggttacggggttaccgggacccgttacgggtacccctacccgttaacgg

SEQ ID NO: 196186 - DNA, 547 bp, Homo sapiens
  misc_feature: GYAE6OF02GJ7YW.4.52.E08.1.454.CMB.1.raw
  modified_base (205)..(205): a, c, t, g, unknown or other
  misc_feature (205)..(205): n is a, c, g, or t
  modified_base (377)..(377): a, c, t, g, unknown or other
  misc_feature (377)..(377): n is a, c, g, or t
  modified_base (388)..(388): a, c, t, g, unknown or other
  misc_feature (388)..(388): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccgaggggaaangccaccctctcctgcagggccagtcagagtgttagcagctacttagcctggtaccaacagaaacctggccaggctcccaggctcctcatctatgatgcatcccgagacgggcccactggcactcccagcctaggttcagtggcaggtggtcgtgggacagtacttcgactcncaccatccacngcctagacgcctgagtatttcgactatttattactgtcagcagtcgtagtcctaacgttcggccttcgtcgtccttacgtaccgtttcgggacggtacgggtaccgtaagggtggaacgagtaaccgaacggtaactggtacggctacggaccacgtac

SEQ ID NO: 196187 - DNA, 835 bp, Homo sapiens
  misc_feature: GYAE6OF02I72NE.4.52.E08.1.454.CMB.1.raw
tcagagcactgtagcacgaccggtgctcgatttagtcgagctctcagagagaaagggggaggaactgctcagttaggacccagagggaaccatggaagccccagctcagtcttctcttcctctgctactcgtggcctccagactaccgacggaagtaattgtgttagaacactagtcctccacgaccctaccttgttcgtttcgtccgtacggaaggggaaacgtcgaccctacccttcctccgtcgacggtaaccgggcctacgtacgaaggtaggttacggttaacgaccacggttaccttaaccgttacggcccgttacgggtaaacccaaacgaaccggtaaaacccgtcggacccgtaaggtccccttaacccggaggtcccttacccgttactaacttacttacgtacgacgtcgactaccgtaccggaacgtaccggggacctaacggttcggacctaacccgtacccgcggtaccggttacggttaccgaaggtcgggtacgtaacgggggtttccgggttaacgtaggggtaaacccgaacggtttaccctttacccgtaaccgtttacccgtttaacccgaaacccttaacctaccccgaaaccggtacccgttaacccgaaacgggtaccgtaccggtacgggttaacggtttacgtttcgtaacgttttaacgttttacttaccgtcgttacgacgtacgtacgtacggtactaccgtacgtcgtcctcgtctcgttacgttccggttacggacggtacggaccgtagggtacgacgtaacgttaacgaacggtcgtaggtaccgtactaccgtcctattacg

SEQ ID NO: 196188 - DNA, 548 bp, Homo sapiens
  misc_feature: GYAE6OF02GOG0E.4.52.E08.1.454.CMB.1.raw
  modified_base (203)..(203): a, c, t, g, unknown or other
  misc_feature (203)..(203): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccaggggaanagccaccctctcctgcagggccagtcagagtgttagcagctactagcctggtaccaacagaaacctggccaggcctcccaggctcctcatctatgatgcatccgacgagggccacgtggcactccccagccaggttcagtggctaggtgggtctgggacagtcttcactcctacaccatccaccagccctagacgcctggaggtatttgacttagtttacttacgtgtcagcagtcgtagctaactcggccttcgtctcgtctacgttccggcggtacgggaccgtaagggtacggaagtactaccgaaacggtactacggtacggcgttacgacctaccgtacg

SEQ ID NO: 196189 - DNA, 794 bp, Homo sapiens
  misc_feature: GYAE6OF02HWDY5.4.52.E08.1.454.CMB.1.raw
  modified_base (317)..(317): a, c, t, g, unknown or other
  misc_feature (317)..(317): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggcctcccagactaccaccggagaaattgtgttgacacagtctccagcccaccctgttcctttgtctccgaaggggaaacacgcccaccctctcctgcacgggccagtcagagtgttagcagtctacttacgccttggtaaccaacaacgaaacctcggaccacggcctacccgaggtcctacccncattctatgactcgactacgtccgacgtacggggaccctacgtacgggacctacgtcccgaacggtacccgtaggtttaccacgggttcgggacgttacggggttcgggtccggtacggggtaacgtaacggttaccctttaccgtaccgttaccttaaccgaaccctacgtaccccgaacctaccggtacccgttaggaaccggttcccgttaggggttaaaccgggtttcttttttacgggaccttttacgggttttttaacttacttcgggttaccgtaggtccgtaacgggttaccgtaccgaaccgttaaccgggttccggaccctttgttacctacccggttcctttaaccggggtttccggggaccgggtaacggggttaccccggaagggttaacgggtaacgtaaccggttaaaccgaaaccggtttacggcggttaccggaccgttaacgacccgttacccgtacgg

SEQ ID NO: 196190 - DNA, 680 bp, Homo sapiens
  misc_feature: GYAE6OF02IERAR.4.52.E08.1.454.CMB.1.raw
  modified_base (209)..(209): a, c, t, g, unknown or other
  misc_feature (209)..(209): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagactaccaccggagaaattgtgttgacacagtctccagccacccttgttctttgtctccgaaggggaaancgccaccctctcctgcagggccagtcagagttgtagcagtctactagcctggtaccaacagaaacctgaccaggctcccgaggcctctacatctatgatcgactactccgacgacggggccacgtcggcaactcccagccgtaggttcaggtcgggcgtaggttcggggtcgtggggaacctacgtacggttacacttccacctaccataccaggcctaacgccgtcgacacggttacgtaggtaaacgtttaggtttttacggtaaggtttttaaccgtttaacttacgttacgaaggtacctaaagtttaaacttaaactaaacggttccggtccttaaccgttaccgtaaccggttttccggggaacgggtaacgggtaaccgtaaggggttacgggtaagtaaccgtaacggtaaaaccgggtaacgttgggacggttacgtagaaccctaacgtattccgttaccg

SEQ ID NO: 196191 - DNA, 802 bp, Homo sapiens
  misc_feature: GYAE6OF02G7M68.4.52.E08.1.454.CMB.1.raw
  modified_base (203)..(203): a, c, t, g, unknown or other
  misc_feature (203)..(203): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccacctgtctttgtctccgaggggaangccaccctctcctgcgagggccagtcagagttgtagcagcttacttagcctggtaaccaacacgaaacctggaccaggcctcccgaggctcctcatctatgatcgcacgtccgacgacgggccacgtcggcctactcccgagccgtaggttcgaggttcgggactagggttcggggtacgtacggggaactacggtacccttcgaaaccctttcccgtaacccgaaccctacgttacccgaaccccgtacggtaccccgttaacggaaccgttcccggttacgggtaacggtttacgttttttcggaccgtttaaacggttttttacctttaaccggtttcggtaaccgtacggtaccgtaacgggttaccggttaacggtacccgttaaaccgttccggggttaccctttcggttaccgtcccggtttaccgtttaccgggtttcccgggggaccggggttaaaccgggggtaaacccggggttaaacggggggttacgggtaaacgggttaaaccgttaacccggtaaaaacggggttaccggtttacggggttaccggttacccggttaccggtacccgtacccggtttaaaccgg

SEQ ID NO: 196192 - DNA, 651 bp, Homo sapiens
  misc_feature: GYAE6OF02GL2HR.4.52.E08.1.454.CMB.1.raw
  modified_base (201)..(201): a, c, t, g, unknown or other
  misc_feature (201)..(201): n is a, c, g, or t
  modified_base (313)..(313): a, c, t, g, unknown or other
  misc_feature (313)..(313): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccacctgtctttgctcgagggaaangccacctctcctgcacgggccagtcagagtgttagcagctacttagcctggtaccacacgaaacctggaccaggcctcccgaggcctcctcatctatgatgcactccgacgnggccacgtcggcactcccacgcctaggttcgaggtcggactagggttcgggtacgtcgggactagtaccttactacctcctacacctactcccaccgtacgccgtaggaccgtccgtaggtacggttacgtttttcggacgtttaacgtttttaacgttacgttacgtacgacggtaccgtaagggttaccctacgaccgtaccgttccgggtacccttcgtcgttaccgttaccgttaccggttaccggggtacgggtaaccggtaacggtaaggggtacgaacggtaacttaaccggaaacggtacgtcggtacggtctacggtacccacgttacg

SEQ ID NO: 196193 - DNA, 598 bp, Homo sapiens
  misc_feature: GYAE6OF02FSSU3.4.52.E08.1.454.CMB.1.raw
  modified_base (152)..(152): a, c, t, g, unknown or other
  misc_feature (152)..(152): n is a, c, g, or t
  modified_base (202)..(202): a, c, t, g, unknown or other
  misc_feature (202)..(202): n is a, c, g, or t
  modified_base (307)..(307): a, c, t, g, unknown or other
  misc_feature (307)..(307): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccgganaaattgtgttgacacagtctccagccaccctgtctttgctccaggggaangccaccctctcctgcagggccagtcagagtgttagcagctacttagcctggtaccaacagaacctggccaggcctcccaggctcctcatctatgatgcatccganacgggccactggctactcccagcccaggttcaggtcggcctaggttcgggtctagggaactagaccttcactctcaccatccaccagcctagactccgtagtaggtactttcggcttaagttttacgtacttgtacagtacagtacgtacgccgtaacgtcggtacctcgtcgtccgttacgtaccgtttccgggacgggtaccgggtaaccgtaaggggtacggtacggtaaccgttaaccgaaaaccggtacgttcgggtaccggtaccttacggaccgtaccgttacg

SEQ ID NO: 196194 - DNA, 658 bp, Homo sapiens
  misc_feature: GYAE6OF02GSEGP.4.52.E08.1.454.CMB.1.raw
  modified_base (260)..(260): a, c, t, g, unknown or other
  misc_feature (260)..(260): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctcagccaccctgtctttgctccgagggaagagccaccctctcctgcagggccagtcagagtgttagcagctactagcctaggtaccaanagaacctggccaggctcccaggctcctcatctatgatgactactacccgacgacggggcccacgttggacctactaccccgaggcccgtaaggtttcaacggttggcgtaagggttggggtctaggggacagtacttcaccgtcctacgacctactccaacctacgacctaggacgtccgtaggacggttattttcgcgttaagttttacttacgttagtactaggacctaggacccggttaagaccgtaacgttccgggacccttcgtcctccttcgttaaccggtttccgggacggggtaacgggaccggtaacggggttacggaacggtaacgtaaccggtaaaacccggtaacggttacggtacgggaccgttaccgtaccgaccgttaaccgg

SEQ ID NO: 196195 - DNA, 676 bp, Homo sapiens
  misc_feature: GYAE6OF02GJMDM.4.52.E08.1.454.CMB.1.raw
  modified_base (152)..(152): a, c, t, g, unknown or other
  misc_feature (152)..(152): n is a, c, g, or t
  modified_base (205)..(205): a, c, t, g, unknown or other
  misc_feature (205)..(205): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccgganaaattgtgttgacacagtctccagccaccctgtctttgtctccgaggggaaancgccacctctcctgcgagggccagtcagagtgttagcagctacttacgcctaggtaccaacgagaaacctggacccaggcctcccgaggcctcctcatctatgatgcatccgagcgggccacgtgcactcccagcctaggttcaggtcggcgtaggtcgggtactaggggactacgtaccttcgacttcctaccgaacctacgtaccaacccgtacgtaccgtacggaccggtccgttagggtacggttaacgttttacggtaccgtttaacgtttttaacgtttaccgttacggttaccgtacggtacgtaacgggtccgttaacggtaccgtaaccgttccgggtcccttcgttcgtccttaccgttaccgttttcgggaccgggtacgggtaaccggtaagggtacggaacgtaacgtaaccgtaaaccggtacgtacggtaccggtacggtacgaccgtaccgtacg

SEQ ID NO: 196196 - DNA, 545 bp, Homo sapiens
  misc_feature: GYAE6OF02GJJCX.4.52.E08.1.454.CMB.1.raw
  modified_base (204)..(204): a, c, t, g, unknown or other
  misc_feature (204)..(204): n is a, c, g, or t
  modified_base (384)..(384): a, c, t, g, unknown or other
  misc_feature (384)..(384): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctctcctgcagggccagtcagagtgttagcagctacttagcctggtaccaacagaaacctggccaggctcccaggctcctcatctatgatgcatccgacacgggccacgtggcatcccagccaggttcagtcggctaggtgggtctgggacagtactcactctcacatcacacnctagacgctgagtatttgcttagtttattctgtcagcagtcgtagctaacgtcgtcctctcgtcctctacgtttcgggacggtagggacccgtaagggtcggaacggtaacgtaaccgaaacggtaccgttaggtacggtaccgtcggacctaccgttacg

SEQ ID NO: 196197 - DNA, 746 bp, Homo sapiens
  misc_feature: GYAE6OF02G6RW2.4.52.E08.1.454.CMB.1.raw
  modified_base (151)..(151): a, c, t, g, unknown or other
  misc_feature (151)..(151): n is a, c, g, or t
  modified_base (203)..(203): a, c, t, g, unknown or other
  misc_feature (203)..(203): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccacgganaaattgtgttgacacagtctccagccaccctgtctttgctccgaggggaaangccacctctcctgcagggccagtcagagtgtagcagctactagcctaggtaccaacacgaaacctggaccaggcctacccgaggcctcctcattcgtaatgaactcgactacgtccggaacgtacggggacccctacggttacgggcctaaccgtaccccgacgtacccgtaaggtttccgaaggttcggacgtaacgggtttcgggtcgttacggggaactaacggtacctttaccgaccgttaccttaccaacccgtaacgttacccgaaacccgtaaccggtaacccgttaacgggaaccggttacccggttaacggtaaacgggtttacctttttacggtacgttaacgggttttttaacttaccgttacggttactacggtacggacggttacgtaacgtaccgtaacgttccgggtacccttacgttccgtaccttaccgttaccgttttaccgggaccgggtaacgggtaccggtaagggtacggaagtaccgtaacgtaaacgtacggtcggttacgcgttacgtacaccgtacg

SEQ ID NO: 196198 - DNA, 555 bp, Homo sapiens
  misc_feature: GYAE6OF02FF3N0.4.52.E08.1.454.CMB.1.raw
  modified_base (202)..(202): a, c, t, g, unknown or other
  misc_feature (202)..(202): n is a, c, g, or t
  modified_base (211)..(211): a, c, t, g, unknown or other
  misc_feature (211)..(211): n is a, c, g, or t
  modified_base (369)..(369): a, c, t, g, unknown or other
  misc_feature (369)..(369): n is a, c, g, or t
  modified_base (396)..(396): a, c, t, g, unknown or other
  misc_feature (396)..(396): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgctccaggggaangccaccctntcctgcagggccagtcagagtgttagcagctacttagcctggtaccaacagaaacctggccaggcctcccaggctcctcatctatgatgcatccgacagggccacgtggcactcccagccaggttcagtggcagtgggtctgggacagtcttcactcncaccatcacagcctagacgcctgagtntttgcttagtttattacgtgtcagcagtcgtagcctaactttcgccttcgtcgtccttccgtaccgttttccgggaccgggtaacgggaccgtaaaggggtcggaacgtaacgttaccgaaaaccggtacgttcgggtacggctacggacctacctacg

SEQ ID NO: 196199 - DNA, 672 bp, Homo sapiens
  misc_feature: GYAE6OF02JF6J6.4.52.E08.1.454.CMB.1.raw
  modified_base (205)..(205): a, c, t, g, unknown or other
  misc_feature (205)..(205): n is a, c, g, or t
  modified_base (300)..(300): a, c, t, g, unknown or other
  misc_feature (300)..(300): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccgaggggaaancgcccaccctctcctgcagggccagtcagagtgtagcagctacttagcctaggtaccaacagaacctggccaggcctcccaggctcctcatctangatgcatccgacgacgggccacgtcggccacgtcccgagcccgtaaggttccgaaggttcggacgtaacggggttcggggttaccgtacggggaactaacgtaccgttaccaaccgttcctaccgaacctaccttacccgaaaccctacgtaccccgtaacggacgtacccgtaggttaacggttacgtttttacgacgtttaacgtttttacgttacgttacgtacgtacgaccgtacggtacgttacgaccgtaacgtccggtaccttctcgtccgttcgtacgtttccgggacggtacgggaaccggtaagggtaggaacgacgtaacgtaaaccgtacgtacgggtacgtccgtacgtacgacctacg

SEQ ID NO: 196200 - DNA, 684 bp, Homo sapiens
  misc_feature: GYAE6OF02G27S4.4.52.E08.1.454.CMB.1.raw
  modified_base (204)..(204): a, c, t, g, unknown or other
  misc_feature (204)..(204): n is a, c, g, or t
tcagagcactgtagcacgaccggtgctcgatttagtcgagctctcagagagaaagggggaggaattgctcagttaggacccagagggaaccatggaagccccagctcagcttctcttcctcctgctactctggctcccagataccaccggagaaattgtgttgacacagtctccagccaccctgtctttgtctccgaggggaangccaccctctcctgcagggccagtcagagtgttagcagctacttagctaggtaccaacacgaacctggaccaggcctcccgaggcctcctacactctatgatcgacactccgacgacgggcctacgtggaccacgtcccgagtcccgtaggttcgagtcgggacgtagggttcgggtcggtgggggactaacggttaccttacgtaccttccgtacccaacctactacccgaacccgtacggtacccgtaacgggaccgtacccgttagggtaacgggttttacgttttacggtacgttttaacggtttttaactttaccgttcggttaaccgacgtaccgacgggttacgtaacgtaccgtaaccgttcggtcccttcgtcgtccgttccgtaccggttcgggacgggtacgggtaccggtaagggttacggtaacgtaacgtaacggtagtggtcgaccgtacgacctacgtgttccg

SEQ ID NO: 196201 - DNA, 656 bp, Homo sapiens
  misc_feature: GYAE6OF02F63II.4.52.E08.1.454.CMB.1.raw
  modified_base (139)..(139): a, c, t, g, unknown or other
  misc_feature (139)..(139): n is a, c, g, or t
  modified_base (144)..(144): a, c, t, g, unknown or other
  misc_feature (144)..(144): n is a, c, g, or t
  modified_base (150)..(150): a, c, t, g, unknown or other
  misc_feature (150)..(150): n is a, c, g, or t
  modified_base (198)..(198): a, c, t, g, unknown or other
  misc_feature (198)..(198): n is a, c, g, or t
  modified_base (232)..(232): a, c, t, g, unknown or other
  misc_feature (232)..(232): n is a, c, g, or t
  modified_base (253)..(253): a, c, t, g, unknown or other
  misc_feature (253)..(253): n is a, c, g, or t
  modified_base (287)..(287): a, c, t, g, unknown or other
  misc_feature (287)..(287): n is a, c, g, or t
  modified_base (564)..(564): a, c, t, g, unknown or other
  misc_feature (564)..(564): n is a, c, g, or t
  modified_base (571)..(571): a, c, t, g, unknown or other
  misc_feature (571)..(571): n is a, c, g, or t
tcagagcactgtagcacgaccggtgctcgatttagtcgagctctcagagagaagggggaggaactgctcagttaggacccagagggacatggaagcccagctcagcttctcttctcctgctactctgctccagataccncgganaattgngttgacactagtctccagcccacctgttactttgctcgaagggaaacngccacctgtcctgcgaggccagtcagacgtgtancgagctactagctcgtacaanagaacctgaccagtccgtaccgacgtctcccgtnacgttacttacgcgtacttcgacgtacgtacccgtacgaacgggtccctaggtacggacctacgtacccgtacggaccccgttaggttaccgaacggttgggtacccggtagtttaacgggtccgtagggggtacaacggtttaccttacccgtattcccgactaaccggtacctaccgtaaccagttacccgacgtacgcccgttaggaacggtagtttcgaaggttacgtttacttacggttacgtcgacgtaccgtagtccgtacacgttaccnggttccncgtagtcttaccgtgttccgacgggtcggaacgtaggtactacggaacgtacgaacccgtgtaccggtagtcgagccctatccgg

SEQ ID NO: 196202 - DNA, 809 bp, Homo sapiens
  misc_feature: GYAE6OF02F0AYK.4.52.E08.1.454.CMB.1.raw
  modified_base (204)..(204): a, c, t, g, unknown or other
  misc_feature (204)..(204): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccgagggaaanagccaccctctcctgcagggccagtcagagtgttacgcagccttaacttacgcccgttaggtaacccaaaccgaacgtaaaaccccgttgggacccctaacgggtaccccttacccccgaaggggtccccttaccccgttacgaactttacccgttagttggaacgtttcggaccctaacggtaccccggtaaaccggtaacgggggtacccctaaccggttcgggaaccctaaccgttcccccgaacggtaccccgtagggttttacccgaggggttcgggacgtaagggggtttcgggttaccggtacggggaactaaccgggtacctttacccggtaaccttccctaccgaacccgtacttaccccgaaaccgtaccgaacccgtttaacggaccgtacccgttagggtaacggtttaacgtttttcgacgtttaagttttactttacgttcgttacacgtcgtaggtaccgttaagaccgtaacgtccgggtccttacgtcggtactttcccgtacggtttccgggacggtaacggtaaccggtagggttacggaacgtacgtaaccgaaaggtacgtcggtacgacgtacacctactacg

SEQ ID NO: 196203 - DNA, 552 bp, Homo sapiens
  misc_feature: GYAE6OF02G2X0J.4.52.E08.1.454.CMB.1.raw
  modified_base (204)..(204): a, c, t, g, unknown or other
  misc_feature (204)..(204): n is a, c, g, or t
  modified_base (300)..(300): a, c, t, g, unknown or other
  misc_feature (300)..(300): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaanagccaccctctcctgcagggccagtcagagtgttagcagctacttagcctggtaccaacagaaacctggccaggctcccaggctcctcatctatgntgcatccgacgacgggccacgtggcactcccgagtccgaggttcaggtggcgtagggtcgggtctggggacagtacttcactctaccaccatccaccagtcctaggacgtccgtggtacggttatttcgacttagtttacttacgtgtacagtcagtcgtacgctaacgtggtcctgtcgctctacgttcgggcggacgggtacgagggtagagtacgtacgaacgtacgtggtacggctcgacctactacg

SEQ ID NO: 196204 - DNA, 728 bp, Homo sapiens
  misc_feature: GYAE6OF02JITL2.4.52.E08.1.454.CMB.1.raw
  modified_base (205)..(205): a, c, t, g, unknown or other
  misc_feature (205)..(205): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccgaggggaaangcccaccctctcctgcagggccagtcagagtgtagcagctacttagcctgtaccaacagaacctggccaggctcccaggctcctcatctatgatgcctatccgacgagggccagtcggctactcccgagtccgtaggttacacggtggcctagggttcgggtacgtaggggaaccacgggttacccttccgaacccgttccctaacctacccgaacttacccgaaacccgtaacggtacccccggtaaggtaccctccgggttacgggtaagggtttaacctttttcggaaccgttttaacggtttttaaaccgtttacgttcgttacgtacgggtaccctaagggtccgttaaacgacccgtaaaccgttcgggtccccttcggttaacgccctttccgttaaccggttttccccgggggagggtaaccggggtaaccgtaaacgggggttcgtaacgtaaccgttaaacccgtaaacccggtattcggggtcggtaccctacggtaccctaaccgttacgg

SEQ ID NO: 196205 - DNA, 675 bp, Homo sapiens
  misc_feature: GYAE6OF02IT6M5.4.52.E08.1.454.CMB.1.raw
  modified_base (154)..(154): a, c, t, g, unknown or other
  misc_feature (154)..(154): n is a, c, g, or t
  modified_base (203)..(203): a, c, t, g, unknown or other
  misc_feature (203)..(203): n is a, c, g, or t
  modified_base (413)..(413): a, c, t, g, unknown or other
  misc_feature (413)..(413): n is a, c, g, or t
  modified_base (632)..(632): a, c, t, g, unknown or other
  misc_feature (632)..(632): n is a, c, g, or t
tcagagcactgtagcacgaccggtgctcgatttagtcgagctctcagagaggaaagggggagggaactgctcagttaggacccaggagggaaccatggaagcccagctcagcttctcttcctcctgctactctggcctccagactaccacgganaattgtgtgacacagtctccagccaccctgtctttgctccgagggaaancgcccacctctcctgcgacgggcctacgtacgaggtacggttggttacgacgagtcttacgttcgccgtacggtaaccaacgaacgaaccgtcggaccgtggccctacccgaggtccttccgtctactcgtaatcgtagtccgacacgtaccgacggacgggcctacgtcgggacctcgtacccgacggtccgacggttcgaggtccggngtacgggtcggttcgacgggacacggttacctccgtacgtactaccgaccctaactcccgtaacgtacccgtcggtaacgtaccgtcgtaggttacggtacgttttcgtaagttacgttttacgttacgtacgtcgtagtcgtaagtccgttaacgccgtaacgttcggtcctcgtactccgtacgtccggttcggacgggtacggtacgtcggggtanggtaactaacggacggttagtcggacgacggtcaccgtctacg

SEQ ID NO: 196206 - DNA, 709 bp, Homo sapiens
  misc_feature: GYAE6OF02IV1E2.4.52.E08.1.454.CMB.1.raw
  modified_base (202)..(202): a, c, t, g, unknown or other
  misc_feature (202)..(202): n is a, c, g, or t
  modified_base (259)..(259): a, c, t, g, unknown or other
  misc_feature (259)..(259): n is a, c, g, or t
  modified_base (284)..(284): a, c, t, g, unknown or other
  misc_feature (284)..(284): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgctccgagggaanacgccacctctcctgcagggccagtcagagtgttagcagctactagctaggtacaanacgaactggacagctccgaggctcncatctatgactcgactacgtacccgacgacgggaccacgtcggaccaacgtcccgacgtccgtaggttccagggtcggacgtagggttcgggtcgtacggggacctaagtacctttaccgaccgttaccctacccgtaaccctaacgtcccaaacccgtaggtaccctaacgggtacctacccggttagggttaacgggtttatttttccggaatttaaacggtttttacttaccgttagtacaacgtaccgtagtaacgtaccgtactaccgtcggtcccctattccggtaccttaccgttacgggtttcccggggacggaaaccggggtaccgttaaagggggttcgtaaacggtaaccgtttaaaccgaaaccggttacggttccgggacggttaacctaccggtacccttacgtaacccgg

SEQ ID NO: 196207 - DNA, 741 bp, Homo sapiens
  misc_feature: GYAE6OF02GSYSS.4.52.E08.1.454.CMB.1.raw
  modified_base (206)..(206): a, c, t, g, unknown or other
  misc_feature (206)..(206): n is a, c, g, or t
  modified_base (242)..(242): a, c, t, g, unknown or other
  misc_feature (242)..(242): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagactaccaccggagaaattgtgttgacactagtctccagccaccctgtcttgtcctccgagggaaancgccaccctctcctgcagggccagtcagagtgttancagctacttagccttaggtaaccaacagaaacctggaccaggcctaccgaggtcctcctactactctagtgaactcgacacgtacccggaacgtacgggaccacgttcgggacctaactccccgaagccctaaggttcaagggtcggacctaggtcgggtacgtacggggaactaacggtacctttacgacttaccgtccaaccgactaccaaccgacgtacctaagacgtaccgtaggtaacggttattttcgaccgttaagttttaacttaaccgtcgggttacaacggtaccgtaaggtacccggttaacgacccgtaaaccggttccgggtaacccttgtaccgtacgttaaccccggttaacgtttaccggggaccggggtaaccggggtaaaccgtaaacggggttaagggtaaacggtaaccgttaaaccggtaaaaaccggtaaccgttacgggtaccggttaacgtaccggttaccgaacccttaaccgg

SEQ ID NO: 196208 - DNA, 746 bp, Homo sapiens
  misc_feature: GYAE6OF02HOUAI.4.52.E08.1.454.CMB.1.raw
  modified_base (734)..(734): a, c, t, g, unknown or other
  misc_feature (734)..(734): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagactaccaccggagaaattgtgttgacacagtctccagccaccctgtcttgtctccgagggaagacgccaccctctcctgcgagggccagtcagacgttgtagcagctacttacgccgttaggtaacccaacgaacgtaaaaccgtcggaacccaacggtccctacccgaacggccttaccccgtactacttaccttatgtaactcgtacctactacccggaacgacggggacccctacggtccggaccaaccgtacccaacggtccgtaacggttccgacgggtcggaccggtagggttcgggtacggtacgggaacgtacggtaccgttacgacccgttaccgtacctaacccgtaacttccccgaaaccctaacggtcccgtaaacggtcgtacccttaggtaaccggtttactttttacggacgttttaacgttttacgtttacgttacgtacgtaacggtacgacgttacggtacgtacgtaaccgtcggtacccttgtacccgttcgtaccgttacggtttcggggacggtaacgggtaaccgtaagggacggtaacaacggttaaccgaaacggtcgttggaccggtntcaccgtacgtg

SEQ ID NO: 196209 - DNA, 637 bp, Homo sapiens
  misc_feature: GYAE6OF02GS7I2.4.52.E08.1.454.CMB.1.raw
  modified_base (204)..(204): a, c, t, g, unknown or other
  misc_feature (204)..(204): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaangccaccctctcctgcagggccagtcagagtgttagcagtctacttagcctggtaccaacagaaacctggccaggcctccccgaggcctcctacactctatgatgcactccgacgagggcccagtcgggaccactccccgaggccctagggtttccaggttcgggcctagggttcggggtcgtggggaacacggtaccttccgacttcctaccaccactccaaccgacgacccgtaggaccgtccgtaggtacggttacgttttacggacgttacgttttactttacgttgttacagccgagtcgtacgacgtaacgttcgtaccttcgtcgtccgttacgtaccgtttccgggacgggtacgggtaccgtaaggggtcggtaacggtacgtaaccgtaaacggacgttggtacggtctacggtccaccgtacg

SEQ ID NO: 196210 - DNA, 958 bp, Homo sapiens
  misc_feature: GYAE6OF02JG1JD.4.52.E08.1.454.CMB.1.raw
  modified_base (203)..(203): a, c, t, g, unknown or other
  misc_feature (203)..(203): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccacctgtctttgtctccaggggaaanagccaccctctcctgcacgggccagtcagagtgttagcagtctacgttagcctggtaaccaaacgagaaaccctgggaccctacggcctaccccgaggccttacccgtctaacttcctaattcggaactcggtctaacgtacccggaacgacgggggacccctaacggttcgggacctaaccttccccggaacggtacccttaagggtttacccgtaacgggttcgggggaccgttaagggggtttccgggggttaccgttacgggggggtaaacctaaaccggggtttaacccttttcccggaaaccctttttcccgtaaccccgtaaacccgtaaccttaccccgtaaaccccgtaaacccggttaccccgttaaacgggtaaccggttaccccggtttaaacgggtaaccgggggtttaacgtttttttaacgggtaccgtttttaacggtttttttaaaccgttttaacccggtttaaccggtttaccggtaaaccggttacccgggttaaacgggttaccgggttaaaccggtaacccgttaaaccggttacccggggttcccgtttacccgttaccgtttacccgtttacccggttaaccgggtttttacccgggggaccgggtaaacgggggtaacccgggtaaacgggggtttacgggtaaacggttaaaccggtaaaccgggaaaaccggtttaacggttaacgggttaccggtaccggttacggtacccgtaaccgttaacccgg

SEQ ID NO: 196211 - DNA, 550 bp, Homo sapiens
  misc_feature: GYAE6OF02G61U5.4.52.E08.1.454.CMB.1.raw
  modified_base (206)..(206): a, c, t, g, unknown or other
  misc_feature (206)..(206): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccgaggggaaagngccaccctctcctgcagggccagtcagagtgtagcagctacttagcctggtaccaacagaaacctggccaggctcccaggctcctcatctatgatgcagtccgacacgggccacgtggcactcccagccaggttcagtgcagtgggtctgggacagtacttcactctcaccactccacagcctagacgcgtgagtatttgacttagtttacttactgtcagtcagcgtacgactaacgtcggccttctgtccttcgtaccgttcgggacgggacgggtaaccgtaagggtggaacgtacgtaacgaaacggtacgtcggttacggcgtacggaccgacctaacg

SEQ ID NO: 196212 - DNA, 720 bp, Homo sapiens
  misc_feature: GYAE6OF02JZSBZ.4.52.E08.1.454.CMB.1.raw
  modified_base (327)..(327): a, c, t, g, unknown or other
  misc_feature (327)..(327): n is a, c, g, or t
  modified_base (339)..(339): a, c, t, g, unknown or other
  misc_feature (339)..(339): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctcggcctaccagactaccaccggagaaattcgtgttgacactacgtctccacgcccaccctgtcttgctaccggaggggaacacgcctacctcctacctgccgacgggaccagtcaaggagttcgtagccacgtacttacgttacggcctacggtaaccaaacgacgaaacctggccaacggcctccgagtcctacncactcattgacngactacgccggtacggacggtccgacgtcggacctactacccgaacggtacccgtaggttacgacggggttcggaacgtacgggttcgggtacggacggtaaccgagttaaccctttaccgccgttacctaacgaacccgtacgttaacccgaacccgtaccgtaaccgtaacggtaccgtccgtaagggttaaccgtttaagtttcgacggtttactttaacgttacgacgtacgaacgttcgaaggtcctaaacggtctaaccgttcgaccttacggtcctacttaacgggtcgttacggggtacgccggtaaggtaacggtcgtaacaaccggtaactaaacggtcttcgggaaccgtctaaccgacgttacggtacc

SEQ ID NO: 196213 - DNA, 668 bp, Homo sapiens
  misc_feature: GYAE6OF02H0Q8B.4.52.E08.1.454.CMB.1.raw
  modified_base (209)..(209): a, c, t, g, unknown or other
  misc_feature (209)..(209): n is a, c, g, or t
tcagagcactgtagcacgaccggtgctcgatttagtcgagctctcagagagaaagggggaggaactgctcagttaggacccagagggaaccatggaagccccagctcagcttctcttcctcctgcctactctggctcccagactacccaccggagtaaatttgtgttgaccacagtctccagcccaccctgtctttgctcgagggaacncgcccacctctcctgccacgggccagtcagtagtgttagcagtcttacgtagcctaggtaaccaagacgtaaccgtggaccaacggtccctacccgaggtccctccctatactctatgactcggcctaacggcccgacggaccggaccgtacgtcgacctacccgtacccgacgtaccggttagtccgaggtacggtacgtaggggttcgggtacggacggtaacctacgtaccttccgtaccgtccaccgtaactcgtaacccgacgtccgtaccgtaaggtccctaggtacgttaagtttcttacggtacgttttaattttccgtagtaccgtagacgtacgacgtaccgtacgtactaccggtctccgttcgaccgtacttccggtaaggtccggacgggtacgacggtggacgtaatacaacggtaacgtgtggtaccggctaaccgtctactcg

SEQ ID NO: 196214 - DNA, 700 bp, Homo sapiens
  misc_feature: GYAE6OF02GCIHM.4.52.E08.1.454.CMB.1.raw
  modified_base (203)..(203): a, c, t, g, unknown or other
  misc_feature (203)..(203): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagcccaccctgtctttgtctccagggaanagccaccctctcctgcagggccagtcagagtgttagcagctacttagcctggtaccaacacgaaacctggaccaggcctcccgaggcctcctcatctagtgatgcatccgacgacgggccacgtcggccacgtcccacgcccgtaggttccaagggttcggcgtagggttcgggttacgtacgggggaactaacggtacctttaccgtaccttacccgtaccaaccctactacccgaacccgtaacggtaccctaacggaccggtcccgttagggtaacgggtttaactttttcggaccgtttaaagttttactttaacgttcgtaacgtacgtaccgaaggtccgtacgtaccgtaacgttccgggttacccttcgttacgtcccgttaccgttaccggtttaccggggacggtaacgggtaaccggtaaggggtacggtaacgtaacgtaaccgtaaacggtacgttcgggtacggcgtacgaccctacgtaccg

SEQ ID NO: 196215 - DNA, 695 bp, Homo sapiens
  misc_feature: GYAE6OF02H5NF7.4.52.E08.1.454.CMB.1.raw
tcagagcactgtagcacgaccggtgctcgatttagtcgagctctcagagagaaaggggggaggaactgctcagttaggacccagagggaaccatgggagccccagctcagcttctcttcctcctgctactctggctcccagataccaccggagaaattgtgttgacacagtctccagccaccctgtctttgtctccgaggggaagcgccaccctctcctgcaggccagtcagtagtgtagcagtctacgtagcctaggtaaccaacgaacgtaaacccgtggaccaggacccctacccgacggtccttccctcgtaactccttaatggtaactcggacctacgtacccggaccggtacggggaccctacggtcgggtaccaccgttcccgacgtccgtacggttaccgagggttcggacgtaggggttcgggtacggtagggaacctagttaccgttcaacctccgtacccaacgtaacctccgaacccgcgtaaccgtacggacgtccgtacggtaggtttactttcggtacttaagttttactacgttgtacgacgtacgtaggtaccgtaacgtacgtacgtccgtccttccggttacgctttccgtacgttacggaccgggtacggtaaccggtagggtacgaacgtaccttaacgaaccgttcggcggtaggtaccacggtaccattacg

SEQ ID NO: 196216 - DNA, 892 bp, Homo sapiens
  misc_feature: GYAE6OF02F7J8E.4.52.E08.1.454.CMB.1.raw
  modified_base (154)..(154): a, c, t, g, unknown or other
  misc_feature (154)..(154): n is a, c, g, or t
  modified_base (200)..(200): a, c, t, g, unknown or other
  misc_feature (200)..(200): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagactaccgaccgganaaattgtgttgacacagtctcagccacctgtcttgctcgagggaancgccacctctctgacagggccagtcagacgtgtagcagtctacgtacgccgtacggaaccaacgtacgaaacctggaccaggcctacccgaggtcctccgtacgtattactagtcgtatcgactacgtccggaacgtcgggacctacgtcggaacctacgtacccgaacgccggttaacgttacgaggttacggacgtagggttacgggtcggtacggggaactaacggtaccgtttaccgtaaccgttccgtaacccaaacccgtacgttaccccgaaacccgtacgggtacccgtttaaaacgggacccggtaccggtttaacgggtaaacggggtttttaccctttttacggggttaaactttttaaccgggttttttaaaacgttaccggtttaccggttaacgtaaacgggttcccggtaaacgggtttaacccggttaaccgggtaaaccgtaaccccggttttaccgggtacccctttaacgtttacccggttacccgttttaccggtttaaccgggggtttaacccgggaccggggtaaacccggggttaaacccgggttaaaacgggggttaccgggtaaaaaccggtacccggttaaaaaccgggttaaaccgttaacccgggttacggggtaaacccggggtcttaaacccggggtttaacccctaacccgggtttaaccg

SEQ ID NO: 196217 - DNA, 779 bp, Homo sapiens
  misc_feature: GYAE6OF02F5ACE.4.52.E08.1.454.CMB.1.raw
  modified_base (312)..(312): a, c, t, g, unknown or other
  misc_feature (312)..(312): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagactaccaccggagaaattgtgttgacacagtctccagcccaccctgttctttgtctccgaaggggaagacgcccaccctctcctgccgagggccagtcaggagtgtagctagctactacgcctggtaaccaacgacgaaaccgtgaccaggcctcccgaggtcctacccgtnacttactagtgaatcgacctacgtcccggaacgtaccgggccctacggtcggactaccgtaccccgaggtacccttagggtttaccagggtttacgggccgtaggggttcggtaccggttaggggaacctacggttaaccttccgaccgttccgtacccgaacccgtacttacccgaaaccctacggtacccctaagggtaccgtcccgttaagggtaacggtttacttttacggtaccgttttaaggtttttaacgttaccgtacggttaacctacggtaccggtaaggttccggttaacgtacccgtaaccgggttcgaccctttccgtcggttcccgttaacccggtttacgggtttacccggggaccggggtaaccgggttacccggtaaagggttcggtaaacgttaacggtaaacccgaaacggttaccgtacgggtacgtcgtaccgtacctacgttacg

SEQ ID NO: 196218 - DNA, 664 bp, Homo sapiens
  misc_feature: GYAE6OF02H5LSB.4.52.E08.1.454.CMB.1.raw
  modified_base (169)..(169): a, c, t, g, unknown or other
  misc_feature (169)..(169): n is a, c, g, or t
  modified_base (352)..(352): a, c, t, g, unknown or other
  misc_feature (352)..(352): n is a, c, g, or t
tcagagcactgtagcacgaccggtgctcgatttagtcgagctctcagagaggaaagggggaggaactgctcagttaggaccaggagggaaccatggagccccagctcagcttctcttcctcctgctactctggctcccagataccgaccggagtaaattgtgttgacanagttcctccagcccacccgtgttcctttgctccgaggggaaacgcgccaccctctcctgcacgggccagtcagagtgtagcagtcttacgttagccttggtaaccagaacgaacctggccaggcctccgaggcctcctcaatcctaagtcagtcgacacgtccgagaccgggccaggtcgacnctccgacgccgtacgtcgacggttgactgggtcggtcagggaccgaatacggtcctactccgacccaactacgtcgacctaaccgtctaacggacgtacgtacggtacgttagtttacgtcgttaagttttacgttacgttacgttacgacggttaccacggtacctaacggtacgtacgttccgtaccgtttccgtcgtacgtacccttacgggtttccgggacgggtaacccgggtcggtaacgggtaggaaccgtacgttaaaccggaacgttacggtggtaccgtaccggtactaccggacgttaccg

SEQ ID NO: 196219 - DNA, 761 bp, Homo sapiens
  misc_feature: GYAE6OF02H6WXF.4.52.E08.1.454.CMB.1.raw
  modified_base (196)..(196): a, c, t, g, unknown or other
  misc_feature (196)..(196): n is a, c, g, or t
tcagagcactgtagcacgaccggtgctcgatttagtcgagctctcagagaggaaagggggaggaactgctcagttaggaccagagggaaccatggaacgccccagctcagcttctcttcctcctgctactcgtcggcctacccagactacccgaccggaagtaaacttggttgttagaccacgtacgttcctaccncgcccctacccttgttcctttgtcctaccggaaggggtaaacgcgccctaccctcgtcctgacgacgggccagtcaggtagttcgtacgctacggtcttaccgttacgccgttacggtaaccaacgtaacgtaaccgtcggaccaccggtcctacccgcggtaccttccgtactactcgtagtcgacgttccgactacgtacccgaggtaccggtccacgttccgacctaccgtccgaacggtaccgttacggtcgtacggtcggacgtcgggtttcggacggtcggactaccgttaccgtcgttaacccgtcttaacccgacttaccgcctaaccggtactaccggtacgacggttaccgtacgggtttaacggttccgtttacgtaagtttacgtttaccgtttacgtcgtaccgtagtccgtagtacccgttagtacccggttacgtccggtaccttctacggcctttacgggtcgttaccggggacggtaacccggttaggaacggtacggtacgaaccgtaaaccggacgtaggtcgtacggtccactaccgtcgttacg

SEQ ID NO: 196220 - DNA, 998 bp, Homo sapiens
  misc_feature: GYAE6OF02GTHM2.4.52.E08.1.454.CMB.1.raw
  modified_base (219)..(219): a, c, t, g, unknown or other
  misc_feature (219)..(219): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactcgtggcctcccagactaccgaccggagtaaattgtgttgacacgagtcctccacgccctaccctgttctttgcctccggaaggggaaacncgcccacctctcctgcgacgggccagtcagtgtgtagcagtactacgttacgccgtacggtaaccaacgacgtaaaccgtcggaccgtacggtcctacccgacggtacttcccgtacacttacgtatcgatcgacctacgtaccgagacgggacctacggtgacctacgtccgacgccgtagtacgacggttgggactacggttcgggtacgtacggggtaactaacggttaccttaccgtacgtacccgtttaacccgaaccgttaaccgtaaccccgaaacccggtacggttaacccccgtaacgggtaacccggttacccggttaagggggttaaccggtttttaaaccggtttttaccggaaaaccgttttttaaaccgggtttttaaaccgtttaacccggtttacgggttaaacccgtaaacccggtttaccgggtaaaaccgggttcccgggttaaaaaccggtttacccccggtaaaccggggtttaccccgggttttacccccgtacgggtttttccccggtaaaccggtttaccccggttttaaacccggggggttttaacccccggggggaccgggggttaaacccccgggtaaaacgggttaaaccgggggggtttaccgggttaaaaccgggtttaaaacccccgggttaaaaacgggggttaaaaaccccccggtttaaggggtttcccccgggttttaaacggggggtaaccccccggtttaaacgggttaacccccccgggttaaaccccttttaaccggggg

SEQ ID NO: 196221 - DNA, 608 bp, Homo sapiens
  misc_feature: GYAE6OF02F9DEA.4.52.E08.1.454.CMB.1.raw
  modified_base (207)..(207): a, c, t, g, unknown or other
  misc_feature (207)..(207): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagcccaccctgtctttgtctccgaggggaaagngccaccctctcctgcagggccagtcagagtgttagcagctacttagcctggtaaccaacagaaacctggaccaggcctcccgaggctcctcatctatgatgcatccgacacgggccacgtggctactcccagccaggttcaggtgacgtaggtcgggtctgggacagtactcactctcactatcaaccagcctagacgtccgtaggtaggttattttcgagttaacgttttattacgtgttacgagtacgtaacgtcggtaacgtctaaacgtcggtaccttcgtcgtacccgttacgtaccgggtttacgggaccggggtaacgggaccggttaagggacggtaaggaacttaacggaaaccgtacggttcgggtaccgactacggtacctacctaaccg

SEQ ID NO: 196222 - DNA, 615 bp, Homo sapiens
  misc_feature: GYAE6OF02F7431.4.52.E08.1.454.CMB.1.raw
  modified_base (203)..(203): a, c, t, g, unknown or other
  misc_feature (203)..(203): n is a, c, g, or t
  modified_base (211)..(211): a, c, t, g, unknown or other
  misc_feature (211)..(211): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccaggggaangccacctntcctgcagggccagtcagagtgttagcagctacttagcctggtaccaacacgaaacctggaccacggcctacccgagtcctcctacacttctatcgatcacacgtaccgacgcggacctacgtgacctacctcccgacgccgtacggttcaaggtcggacgtaggtcggggttacgtgggaaccgtaagtcccttaccgacttcctacccacctactaccaaccctacgcctagcgtaccgtaggtacgttagtttgtacgtttaagtttacttacgtgtacgtgtacaggtacgtagtaccgtacgttcgtcccttcgtcgtccttacgtaccgttcgggacggtacgggtaacgagggtacgacgtagtaaccaagtacgtggcggtacctcgaccacgtcg

SEQ ID NO: 196223 - DNA, 605 bp, Homo sapiens
  misc_feature: GYAE6OF02HKZKP.4.52.E08.1.454.CMB.1.raw
  modified_base (265)..(265): a, c, t, g, unknown or other
  misc_feature (265)..(265): n is a, c, g, or t
  modified_base (295)..(295): a, c, t, g, unknown or other
  misc_feature (295)..(295): n is a, c, g, or t
  modified_base (372)..(372): a, c, t, g, unknown or other
  misc_feature (372)..(372): n is a, c, g, or t
  modified_base (381)..(381): a, c, t, g, unknown or other
  misc_feature (381)..(381): n is a, c, g, or t
tcagagcactgtagcacgaccggtgctcgatttagtcgagctctcagagagaaagggggaggaactgctcagttaggacccaggagggaaccatggaagccccagctcagcttctcttcctcctgctactctggctcccagactaccgaccggagaaattgtgttgacacagtctccagcccaccctgtctttgcctccgagggaaagcgccaccctctcctgcgaggccagtcagagtgtagcagctacttgcctggtaccaanagaacctcggccaggcctccgaggcctctnatctaatgatcgcagtcccgagacgggccagtcggacactcccgaggtccaggttcagtcgcaggtggtcgaggacngtaccttcnctcgtcacactcaacctgaccctagaccgtcgtaggtacgttattcggtacttaagttttctacgttgactagctcgtacgtacgcctaaaggtccgcctttcgcgtaaccgttcgaccggtttccggggacgtaacggggtaaccctaagggggtcggtaaacgtacttaaccggaaacgtcgggttacgggtccgtaccgtaggtacccgtaccttaacggg

SEQ ID NO: 196224 - DNA, 1011 bp, Homo sapiens
  misc_feature: GYAE6OF02GLTCP.4.52.E08.1.454.CMB.1.raw
  modified_base (736)..(736): a, c, t, g, unknown or other
  misc_feature (736)..(736): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagactaccaccggagaaattgtgttagacacagtctccagccacccttgttctttcgtcctaccgaagggaagacgccctaccctctcctgcgagggccagtcagtagtgttacgcagtcttacgttacgcccgttacggtaaccctaaacgaaccggtaaaaccctcgggacccctacggcccttaccccgagggtcccttccctactacttacgttaacttacggtaactcggaccgtaaccggtacccggaaaccggaccggggtaccctaaccggttcgggaccctaaccgtacccccgacggtacccggttacgggtttaccgtacggggtacggggtccgtaacgggggttttcggggtaaccgggttacgggggtaacccgttaacggtttaccccgtttacccggttaaccctttaccccgttaacccgaaacccgttacccgtaaaccccgaaacccccggtaccgggtttaaaccccggttaaacgggaaaccccggtttcccgggttaaaggggtttaaacgggttttaaaccgtttttttccgggaaccgggtttttttaaaactttttacccgggtttttaaacnccgggttaaacggtaaccggttaacggtaccgggttaacccgggtaacgtaaccccgttaggttttacccggtccccgttttaaacggtcccgttaccccggttttaaccgttaacccgggggtttttaccgggggggaaccccgggttaaacggggtaacccgggttaacggggtttaaggaaccccggtttaaaaccgtaaacccggtaaacgggggttcccttacggggggttccctaacgggtttacccacccggtttaacccgttaccgg

SEQ ID NO: 196225 - DNA, 743 bp, Homo sapiens
  misc_feature: GYAE6OF02HRKS5.4.52.E08.1.454.CMB.1.raw
  modified_base (204)..(204): a, c, t, g, unknown or other
  misc_feature (204)..(204): n is a, c, g, or t
  modified_base (263)..(263): a, c, t, g, unknown or other
  misc_feature (263)..(263): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccgaggggaancgccaccctctcctgcagggccagtcagagtgtagcagctacttagcctggtaaccaanagaaacctggaccaggcctccgaggtcctcctactactctagtgtatcgcctacgtccgacgacgggcccaacgttcggacctaccgtaccccgagtacccgtaaggttccgaaggttcgggacgtacggggttcgggttccggtaggggaacctaacgttacctttccgaccttccctaacccgaacccgtacgtacccaccgtaacgtacccctaaggaccgtaccggttacggtacggttacgtttttacggaaccgttttaacgtttttaactttaacgtttacgttacgtaacgtaccggtaacggttaccggttaacgacccgtaaccggttccggtacccttccgttcgtaccgttaaccgttaccgggtttccgggacgggtaaccgggtaaccgggtaacgggtacggttaacggaacgtaaccgaaaccggtacgtacgggtaccggtacgtacggtaccgtacctaccg

SEQ ID NO: 196226 - DNA, 710 bp, Homo sapiens
  misc_feature: GYAE6OF02H94CV.4.52.E08.1.454.CMB.1.raw
  modified_base (520)..(520): a, c, t, g, unknown or other
  misc_feature (520)..(520): n is a, c, g, or t
  modified_base (554)..(554): a, c, t, g, unknown or other
  misc_feature (554)..(554): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccacggagtaaattgtgttcgacacagtctccagcccaccctgttctttgtcctccgaaggggaaagacgcccaccctctccgtgcgacgggccacgtcgagtagttgttagctacgcttactacgcctcggtaaccaaacgtaacgaaaccgtcggaccacggtcctcccgaggtccttcctactactactagtgtacgtcgccacgtccgaaccgacgggccctacgtcggacctacctacccgacgtccgtacggttaccgaggtcgggtacgtagggttcgggtacggtacgggtaactacgtaccttccgtacctccgtacctacctactcccgaaccgtacgtccgtacggacgtccgtaggtacggtttntttacgtatttaacgttttactcgtgtacgacgngtacggtacgtaacgtacgtaccggtcgtcctacgttccgactttacccggttagggttccgggaccgggtacggtaacgtgggtaacggtagtaacccggtaaacgtaaccggtggttaccgggtacggtaccacggttaccccgtagttaccgg

SEQ ID NO: 196227 - DNA, 751 bp, Homo sapiens
  misc_feature: GYAE6OF02F8CNC.4.52.E08.1.454.CMB.1.raw
  modified_base (204)..(204): a, c, t, g, unknown or other
  misc_feature (204)..(204): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagactaccaccggagaaattgtgttagacacagtctccagccacctgtctttgctccgagggaaangccaccctctcctgcacgggccagtacgagacgtgttagcagcttaactacgcctaggtaaccaacgagtaaacctggaccaaggccctacccgaggtcctacccgtactattaccgttagtcgaacgttcgacctacgtcccggaacggaacgggcctaccggtacgggccttaaccgtccccgacgtacccggttaaggtttaccgaaggtcggtaccggtaagggtttcggggtaccgtacggggtaacctacggtacctttacccgacttacccgtaccgaacctaacgtacccacgaccgacccgtaaggaccgtccgtaggtaacggttattttcggactttaacggttttacttaccgtagtacgtacgacgtacgtcggtaacacgtaacgtcggttccctcgttacgaccgttaccgttaaccggtttcgggaccggggtaaccgggtacccggtaaaggggtcggaaaccgtaacgtaaacccggtaaacggttaacgtcgggtaaccggttccaaccggtaccgtaaccgttacgg

SEQ ID NO: 196228 - DNA, 815 bp, Homo sapiens
  misc_feature: GYAE6OF02IH38I.4.52.E08.1.454.CMB.1.raw
  modified_base (207)..(207): a, c, t, g, unknown or other
  misc_feature (207)..(207): n is a, c, g, or t
tcagagcactgtagcacgaccggtgctcgatttagtcgagctctcagagagaaagggggaggaactgctcagttaggaccagagggaaccatggaagccccagctcagcttctcttcctcctgctactctggctcccagactaccaccggagaaattgtgttgacacagtctccagccaccctgttctttgtctccgaggggaaaancgcccaccctctcctgcagggccagtcagagtgttagcagctacttgcctggaaccaacacgaaacctcggaccacggctcccagctcctcatcctatgatgactacgtaccgacgacgggaccacgtcggacctacgtcccgacgtcctacggttcgaggtcggtccgagggttcgggtacgtcgggtacgtaacgtaccgtttcctaacccgttccctaacccgtaacctaccttacccgaaacccgtaccgtaacccgttaacggaccggtaccgttacgggtaacggttttacgtttttacggaccgttttaaacggttttttaaccgtttaccggtttacgttacccggtaacggtacccgtaacgggttacccgggttaaacggttaccccgttaaaccgggtttcccgggttaccccttaccgggtttaccgttaccccgtttaccggtttacccgggtttttacccggggggacccgggggtaaccgggtaacccggggttaaacggggtacgggtaaccggttaaacggtaacccgtaaaaacggtaccgggttacggttccgggttaacccggtacgtaccccgtaacctttaccggg

SEQ ID NO: 196229 - DNA, 787 bp, Homo sapiens
  misc_feature: GYAE6OF02H5CGK.4.52.E08.1.454.CMB.1.raw
  modified_base (141)..(141): a, c, t, g, unknown or other
  misc_feature (141)..(141): n is a, c, g, or t
  modified_base (216)..(216): a, c, t, g, unknown or other
  misc_feature (216)..(216): n is a, c, g, or t
tcagagcactgtagcacgaccggtgctcgatttagtcgagctctcagagagaaagggggaggaactgctcagttaggaccaggagggaaccatggaacgccccagctcagcttctcttcctcctgctactctggctcccanatacccaccggaagaaattgtgttgacacagtcctccagccctaccctgttctttgtcctccgaaggggaaacgngcccaccctctccgtgcgagggccaggtcagtagtcgttagcacgtcttaaccgttacgtcccgttacgggtaaacccaaaacgtaacggtaaaacccgtgggacccctacgggacccttaccccggaacggtcccttccctaaccgtaacttacccttaagtcggtagtcgaccgtaccgttaccccggaaggtaccggggccctaacggtcggtaacctaaccgtaccccgaggtacccggttaaggttcccgaaggggtcggtacgtggggttacgggtacggtagggtaccctagtacccgttcctaaccctccgtaaccaacctaccgtaccgtaaccccgtaccgtaaccgaaggtacccgtcgttaggttaaacggtttagttttcaaccgttttagtttttacttacgttcgtacgtacggacgtacgtaccggtacaccgtacgtccgtcttaccgtctcgtaccgttccggtacgggacgggtacggtaaccggtggtaacggaacgtaacgtaaaccgaacgttaccgtagggtccgtacgtaccgaccctacgttaccg

SEQ ID NO: 196230 - DNA, 809 bp, Homo sapiens
  misc_feature: GYAE6OF02IV3XZ.4.52.E08.1.454.CMB.1.raw
  modified_base (120)..(120): a, c, t, g, unknown or other
  misc_feature (120)..(120): n is a, c, g, or t
tcagagcactgtagcacgaccggtgctcgatttagtcgagctctcagagagaaagggggaggaactgctcagttaggacccagagggaaccatggaacgccccagctcagcttctcttcncctgctactctggctcccagactaaccgaccggagtaaattgtcgttagacactagtcctccacgtcccacccgtgttccttttgaccgttccgaaaggggaaacgtccgaccccgtaccttccgtaccgtcggccggaacgggtcccgtaacgccgtaaaggtacggttcggttaacgaccgacgttaccgttaacgttaccggtaccggttacggttaacctaaaccgtaaccgtaaaccgttcgggacccggtaacgtccgttacccgaacgggtccttaacccgtacttaacgtcttaacgtacgttacgtgtacccaccgtttacccggacgacgggtacctaacggtcgggaccgtacctaccggacgtaacccgtacggttacgaacgggttacggcggtacgggttacgggtaccggacggctaaaacggttccctacgaccttaccgttaccaacctactaccacgtacgaccgtacgtaccgtcgtacggtacgttattcgttagttacgtttacgtctagtactacgacgtacgacgttaacgcgtaaccggtccggtacctacgtttcccgtacttaccgtccgtttaacggacccgggttaggtaaccggtaaggtaccggtagtaaccgtaacgtacgtacggtacgggtattaccggccttacgccgttaacgg

SEQ ID NO: 196231 - DNA, 745 bp, Homo sapiens
  misc_feature: GYAE6OF02GYIL9.4.52.E08.1.454.CMB.1.raw
  modified_base (201)..(201): a, c, t, g, unknown or other
  misc_feature (201)..(201): n is a, c, g, or t
  modified_base (203)..(203): a, c, t, g, unknown or other
  misc_feature (203)..(203): n is a, c, g, or t
  modified_base (211)..(211): a, c, t, g, unknown or other
  misc_feature (211)..(211): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccacctgtctttgtctacagggaancnccacctcncctgcagggccagtcaaggagtagttagcagtacttaacgttagcccttaggtaaccgaaacaacggaaaaacccttcgggacccaagggtacccttaccccgaagggtacccttcccgttacctaacgttacttaacgtcggtaattcggaacctaaccgtaccccggaacgacggggaccccaacggttggaccgtaaccgtaccccgacgaacccggttaggtttaccgaacggttacggccgtaaggggttcgggtacgtaggggaactacgttaccttacgacctcttaccaacctactaccgaacgacgtcctaaggacgtccgtagtaggttattttagaccgttaagttttaacttaacgtgtacgtacgacgtaacgttcgaacgtactaaccgtcgtaccctcgttacgtcgtaccgtaccgtttcggggacgggtaaccggtaccggaaagggttacgaaacggacgtaaaccgtaaacccggtaagttccggaaacggttctaacggacccttaacgtaccg

SEQ ID NO: 196232 - DNA, 735 bp, Homo sapiens
  misc_feature: GYAE6OF02FLSL2.4.52.E08.1.454.CMB.1.raw
  modified_base (207)..(207): a, c, t, g, unknown or other
  misc_feature (207)..(207): n is a, c, g, or t
  modified_base (311)..(311): a, c, t, g, unknown or other
  misc_feature (311)..(311): n is a, c, g, or t
tcagagcactgtagcacgaccggtgctcgatttagtcgagctctcagagagaaaggggggaggaactgctcagttaggacccagagggaaccatggaagccccagctcagcttctcttcctcctgctactctggctcccagactaccaccggagaaattgtgttgacacagtctccagcccaccctgtctttgctccgaggggaaanagcccaccctctcctgcagggccagtcaggagtgtagcagctaacgtacgcctaggtaccaaacgagaaacctggaccaggcctcccgaggcctcctcatctangatcgctacgtccggaacgacgggccagtggacctacgtacccgagtaccgtacggttacgaggggttcggacgtacggggttgggtacgtgggaaacctacgtacctttaccaccttcgtaacccaacctactaccaaccggtacgtacccgtaaggtacgccgttaggtaacggtttacttttacggtacctttaaggttttaactttaccgtggtaaccgaggtaccgtaacgggttccgttaacgaacccgtaaaccgttcgggtccctttacggtacggtacctttaacgttaaccgggtttcccggggaacggggtaaccggggtaccggtaaaacggggttcggtaaacggttaacgttaaacccggaaaacgggttacgttagggttaccggtacgttacggaccttaaccgtacg

SEQ ID NO: 196233 - DNA, 681 bp, Homo sapiens
  misc_feature: GYAE6OF02IOB2W.4.52.E08.1.454.CMB.1.raw
  modified_base (266)..(266): a, c, t, g, unknown or other
  misc_feature (266)..(266): n is a, c, g, or t
  modified_base (299)..(299): a, c, t, g, unknown or other
  misc_feature (299)..(299): n is a, c, g, or t
tcagagcactgtagcacgaccggtgctcgatttagtcgagctctcagagaggaaagggggaggaactgctcagttaggacccagagggaaccatggaagccccagctcagcttctcttcctcctgctactctggctcccagataccacggagaaattgtgttgacacagtctccagccaccctgtctttgtctccgaggggaagacgcccaccctctcctgcagggccagtcagagtgttagcagtctacttgcctggtaaccaanacgaaacctggaccaggcctcccgaggctcccngatctatgatgactacgtccggaacgcgggaccacgtggaccactcccagcctaggttcgaggtcggctacgggtgggtcgagggacctaggtaccttcgaccttacgtacccgaacctactaccgaacccgacggtaccgtaacggaccgttacccggtagggtacggtttaacgttttcggtactttaacggtttttaacttcgttacgttaccgagtaccgtaggtaccggtacgaccgtaccggtcgtcccttacgtcgtccgttaacgttccgggtttaacgggccggtaacggggtaccgtaaaggggtccggtaaagtaacgtaacccgtaaaacggacgttacgggtacgtccgtacggtacccgaacttaccg

SEQ ID NO: 196234 - DNA, 753 bp, Homo sapiens
  misc_feature: GYAE6OF02JHV14.4.52.E08.1.454.CMB.1.raw
  modified_base (98)..(98): a, c, t, g, unknown or other
  misc_feature (98)..(98): n is a, c, g, or t
  modified_base (222)..(222): a, c, t, g, unknown or other
  misc_feature (222)..(222): n is a, c, g, or t
tcagagcactgtagcacgaccggtgctcgatttagtcgagctctcagagagaaagggggaggaactgctcagttaggacccagagggaaccatggaanccccagctcagcttctcttcctcctgctactctcggcctcccagactacccaccggagaaattgtgttagacacagtcctccacgccctaccttgttcctttgtccgtaccggaaggggtaaanccgaccctaccctctcccgtgccgacggccagtcaaggtacgttagtacgcacgtaccttacgttacgtccgtaccggtaaccaaaccgtaaccgtaaacccgtcgggaccgtacggccccttaccccggaaggtccctccttacgtaccttaccgttaagtacgtacgtacgacctaccgtccccggaaacggtcgggaccctacgtacggaccgtaccctccggaccgtccgtaggttaccgaggtacggcgtgggtcggtacggtacgtaacgtacgtaccttaccctactccgtacaacccgttcacccgaaaccgtcggtaaccctaacgacccgtaccgtaggttaacgggtttacttcggtaccttttacggtttaactaccggttctaaccgtacgtgacgtacgtacgtaccgtaacgtccggtacctgtccgtcgtacgtacggtcgggacgaacggtacggtacggtagacgtaacttacggaacgttacggtggaccgtccggtaacctcggtctaccg

SEQ ID NO: 196235 - DNA, 533 bp, Homo sapiens
  misc_feature: GYAE6OF02FQ8DH.4.52.E08.1.454.CMB.1.raw
  modified_base (204)..(204): a, c, t, g, unknown or other
  misc_feature (204)..(204): n is a, c, g, or t
  modified_base (234)..(234): a, c, t, g, unknown or other
  misc_feature (234)..(234): n is a, c, g, or t
  modified_base (241)..(241): a, c, t, g, unknown or other
  misc_feature (241)..(241): n is a, c, g, or t
  modified_base (256)..(256): a, c, t, g, unknown or other
  misc_feature (256)..(256): n is a, c, g, or t
  modified_base (269)..(269): a, c, t, g, unknown or other
  misc_feature (269)..(269): n is a, c, g, or t
  modified_base (277)..(277): a, c, t, g, unknown or other
  misc_feature (277)..(277): n is a, c, g, or t
  modified_base (283)..(283): a, c, t, g, unknown or other
  misc_feature (283)..(283): n is a, c, g, or t
  modified_base (370)..(370): a, c, t, g, unknown or other
  misc_feature (370)..(370): n is a, c, g, or t
  modified_base (378)..(378): a, c, t, g, unknown or other
  misc_feature (378)..(378): n is a, c, g, or t
  modified_base (387)..(387): a, c, t, g, unknown or other
  misc_feature (387)..(387): n is a, c, g, or t
  modified_base (416)..(416): a, c, t, g, unknown or other
  misc_feature (416)..(416): n is a, c, g, or t
  modified_base (460)..(460): a, c, t, g, unknown or other
  misc_feature (460)..(460): n is a, c, g, or t
  modified_base (521)..(521): a, c, t, g, unknown or other
  misc_feature (521)..(521): n is a, c, g, or t
tcagagcactgtagcacgaccggtgctcgatttagtcgagctctcgagagagaaagggggaggaactgctcagttaggacccagagggaaccatggaagccccagctcagcttctcttcctcctgctactctggctcccagataccaccggagaaattgtgttgacacagtcctccagccaccctgtcttgctccaggggaaangccacctctcctgcagggccagtcagagtnttagcanctatgcctgtaccanagaacctgcagcnccagctcncatctngatgctacgtccgacgacggaccagtgccactccagccaggttacaggtcgactgggttgggactgggaacagtactcactcacacnctaccacncgccaagcnccgtagagttacttgacttaagttcttangttacagtcgaagttcgtaacgcctaagccggtacttgcgtacncgttacgtcggacgcggaacgtagggacgagtactaaccgaacgtacgtggtaccggtacncggactacgtac

SEQ ID NO: 196236 - DNA, 804 bp, Homo sapiens
  misc_feature: GYAE6OF02JJYG3.4.52.E08.1.454.CMB.1.raw
  modified_base (218)..(218): a, c, t, g, unknown or other
  misc_feature (218)..(218): n is a, c, g, or t
tcagagcactgtagcacgaccggtgctcgatttagtcgagctctcagagagaaagggggaggaactgctcagttaggacccagagggaaccatggaagcccagctcagcttctcttcctcctgctactctggcctcccagactaccaccggagtaaattgtgttgacacagttctaccgagcccaccctgttctttcgtctaccggtaaggggaaaancgccctaccctctcctcgacgacggccacgtccaggtacgttacggtacgacagtccttacgttacgtcctacggtaccaaaccgtaacgaaacccgtgggaccctacggcccttaccccggaggtaccccttcctaccacgtttaaccgtacgtagtacgtccgaccgttaccgtaccccggaacggtaacccggggtcccttaaacggccgggtaccacccgtacccgtaacggtacccgttacggttacgtaacgggtcgacggtacgggtttcgggtcggtacgggactaaccggtcttcgacttcctccgaccactccgtacctaagtaccggtacacggttccgtagtacggttaacgtttccgagttaacgttttacttacgttcggtaaccgtcggaaccggttacggtacggttaaccgtaccgttaaccggttcgtcccgttcgttcgttaaccggttaccgtttacggggtttaccggaccggggtaacggtacgggtaacggttaccggataaacccggttaacggaaccggttacggttccgggacgttacgtacgtaccgtatttaccccgg

SEQ ID NO: 196237 - DNA, 779 bp, Homo sapiens
  misc_feature: GYAE6OF02JYI26.4.52.E08.1.454.CMB.1.raw
  modified_base (130)..(130): a, c, t, g, unknown or other
  misc_feature (130)..(130): n is a, c, g, or t
  modified_base (176)..(176): a, c, t, g, unknown or other
  misc_feature (176)..(176): n is a, c, g, or t
  modified_base (222)..(222): a, c, t, g, unknown or other
  misc_feature (222)..(222): n is a, c, g, or t
  modified_base (242)..(242): a, c, t, g, unknown or other
  misc_feature (242)..(242): n is a, c, g, or t
tcagagcactgtagcacgaccggtgctcgatttagtcgagctctcagagagaaaggggaggaactgctcagttaggacccagagggaaccagtggaacgcccagctcgagcttctcttccgtctgctacnctggctccagataccgaccggaagtaacttggtgttacgacctaanacgtctccgacgccctaccgtgttctttgtcctaccgaagggtaanacgtccctaccctcgtccgngccgaacgggtcctacgtcgaaggtagttacggttacgctacgacttaccgtacggtaccgtacggtaaccgaaccgtaacgtaaccgtacggacccgtacggtaccctaacccggacggtacccgttccgtacctacgttaccggttaacgtccgtacgttacgaccgttaccgaacccggtacggacggtaccgtacgaacgggtccaaccgtccgacgtaccgtacggtacgaggtcgtacgtaggtcccgggtagttcggaacgtacgtaccctacgacttaccgaccctactacgtaccgaccggtactaccgacgtacgtaccgtagtaaggttaccgtttcggaactttacgttacgttacgtacgtacgtcgaaccgtagtacgtaaccgccgttacgtacccgtcttaaggcccgttcgtaacgggtttccgtaccgggtaccggcgtttaaccgggaacggttcgtaacgttaaccgtacgtaaccggtaacgtcgggttaccgtacgtaccgaccgttagtaccgg

SEQ ID NO: 196238 - DNA, 775 bp, Homo sapiens
  misc_feature: GYAE6OF02FOUW3.4.52.E08.1.454.CMB.1.raw
  modified_base (205)..(205): a, c, t, g, unknown or other
  misc_feature (205)..(205): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggctcccagactaccaccggagaaattgtgttgacacagtcctcagccaccctgtcttgtctaccgagggaaancgcctacctctcctgcagggccagtcagagtgttagcagtcctacgttacgccttaggtaccaacacgaaacccgttggacctaaggcctcccgaggtcctccgtcaacgtccttaagtcgtactcggacctaacgtccccggaacgacgggggtaccctaacgttccgggaccttaccgttaccccgaacgggtcccctaagggtttaccgtaacggttcgggaccgtaaggggtttccgggtacgtacgggggtaacctacggtaacccgtttccgaaccgttccgtaacccgtaccctacgttacccgaacccgtacggtaccccgttaaggacccggtaccgttaggtaaccggtacgtttttacggaacgtttaacgtttacgttaccgtacggttacgtaccgtaccgtacggtaccgttagacccgaacgttccgggtacccttacgtccgtacccgtaacgttaccggtttaccggacgggtaacggtaaccgtagggtaccgtaggttaaacccacgtaaaccggtcgttacggcgtacccggtagtacccgaccgttacg

SEQ ID NO: 196239 - DNA, 672 bp, Homo sapiens
  misc_feature: GYAE6OF02FQ21X.4.52.E08.1.454.CMB.1.raw
  modified_base (153)..(153): a, c, t, g, unknown or other
  misc_feature (153)..(153): n is a, c, g, or t
  modified_base (205)..(205): a, c, t, g, unknown or other
  misc_feature (205)..(205): n is a, c, g, or t
  modified_base (665)..(665): a, c, t, g, unknown or other
  misc_feature (665)..(665): n is a, c, g, or t
tcagagcactgtagcacgaccggtgctcgatttagtcgagctctcagagagaaagggggaggaactgctcagttaggacccagagggaaccatggaagccccagctcagcttctcttcctcctgctactctggcctccagactaccaccgganaaattgtgttgacacagtctccagccacctgtctttgtctccgaggggaaanacgcccaccctctcctgccgagggcccagtcagagttgtagcgagctactacgccgtaggtaaccaaacgacgaaacccgtggacccaggcctaccccgaggtcctacctcacgttattagtagatcgactacgtaccgacgacggtccacgtgaccgtacctacccgacgccgtagttccgaggtcggacgtaagggtcggtaccgtgggaactacgtactaccgtacgtaccctacgacctaccgtacaacccgacgtacccgtaagacgtaccgtacgggtaggttactttcgaaccgttttagtttaacttcgtacgtacgtaacgccgtaggtacgtaactaccggtacttccgccttagtccggtacctgttaccgggttccggggtaacgggcgtacggggtaacgacgtaacgaaccggaacgtcgttacggcggttacgccgacctaccgngtttccg

SEQ ID NO: 196240 - DNA, 759 bp, Homo sapiens
  misc_feature: GYAE6OF02JT9BY.4.52.E08.1.454.CMB.1.raw
  modified_base (201)..(201): a, c, t, g, unknown or other
  misc_feature (201)..(201): n is a, c, g, or t
tcagagcactgtagcacgaccggtgctcgatttagtcgagctctcagagagaaagggggaggaactgctcagttaggaccagagggaaccatggaagcccagctcagcttctcttcctcctagctactctggctcccagactaccaccgggagaaattgtgttgacacagtctccagccacctgttcttgctcgagggaangccctacctcgtctgacgacgggaccagtacacggtaagttcggtttaagaccacggtaccttaacgtttacggcccgttacggtaaacccaaacgtaacggtaaaacccgtcggacccgtaaggtccctaccccgaaggtcctcctacctacgttacctagttacggattacggacctacgtacccggaccgacggggacccctaacgttacggccgtaaccgtccccgaaggtacccgtacgggttacgacgggtacggacgtacggggttggtcggtaacgggtacacgttaccgttacaccgtcaccacacgtacccgactacgtaccgtacggtactacgtagggtaacgttagtttaccgtaacgttagttttaactacgtcgttacgccggtaacgtacggtaccgttacgaacccgtcgtacggtccgttaccgctaccgttacggttaaccgttcggggaacgggtacggtaaccggtgggggtaacaacggtaaccgtaaccggtaaaggtccgtttacgggacggccgttaccgaccgttacgtacg

SEQ ID NO: 196241 - DNA, 775 bp, Homo sapiens
  misc_feature: GYAE6OF01EQTAG.16.70.G04.1.454.CMB.1.raw
  modified_base (215)..(215): a, c, t, g, unknown or other
  misc_feature (215)..(215): n is a, c, g, or t
  modified_base (747)..(747): a, c, t, g, unknown or other
  misc_feature (747)..(747): n is a, c, g, or t
  modified_base (757)..(757): a, c, t, g, unknown or other
  misc_feature (757)..(757): n is a, c, g, or t
tcagtgtactactccacgaccggtgctcgatttagtgtagtgtgaagggaaagggggaactgctcagttaggacccagacggaaccatggaagccccagcgcagcttctcttcctcctgctactctggcctcccagactaccactggagaaatagtgatgacgcacgtcctccacgccctaccttgtcctggtcgtccgtaccggaagggaaacnccgccctaccctctccgcgccgacggcctactcaagtacgtactaccgagacctaacgttcgccgtacgaccagaccaacgaaccgtcggaccgaccggtccctacccgtacgtccttaccttacgttacgtttacggtcggtacacccgtaccgtaccccggaaccggaccgggtaccctaacggttaccggtacccgttacccggaacggttaccggttacgggttacggtaacggggttcgggtaccgggttaggggtttaccgggtacgggtaacggggaacccgttaacggttaccgttaccctaccgttacctaaccaaccgtacgtaccgacggaccgtacgtaccgttaggccgtttaagttacgtaatttacggttttcgtttactacgtttaacgtttacgtacgtacgtaactaagttaacttacgttacgtaccgtccgtacggttccgaaccgttccggtacgttacggacgggtacgggacgtaacgtacggagtacgactacgtacgacgtgtcgcnctcgacttcncttacgtcttcgctaccg

SEQ ID NO: 196242 - DNA, 563 bp, Homo sapiens
  misc_feature: GYAE6OF01DG1RH.16.70.G04.1.454.CMB.1.raw
  modified_base (201)..(201): a, c, t, g, unknown or other
  misc_feature (201)..(201): n is a, c, g, or t
  modified_base (298)..(298): a, c, t, g, unknown or other
  misc_feature (298)..(298): n is a, c, g, or t
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtctccagccaccctgtctgtgtctccgaggggaaangcccaccctctcctgcagggccactcagagtattaccagcaacttagcctggtaccagcagaaacctggccaggctccagctcctcatttatggtcnctatcccaccgaggccacgtggtactcccagccaggttcaggtggcaggtcgggtctggggacaggtacgttcactctcaccatcagcacgcctgcagtctagtaagtattttgacttagttttattactgtctagtactaattataatgacgtcgcctccgcttactacgttcggacggtacggaccgtaaggtcgacgtaagtaaccgaaacgtaacgtggtcggtccgtaggacctactacttcgttacgttccttctaccg

SEQ ID NO: 196243 - DNA, 506 bp, Homo sapiens
  misc_feature: GYAE6OF01DEW01.16.70.G04.1.454.CMB.1.raw
tcagtgtactactccacgaccggtgctcgatttagtgtagtgtgaagggaaagggggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccactcagagtattaccagcaacttagcctggtaccagcagaaacctggccaggctcccaggctcctcatttatggtgcatccaccagggccactggtatcccagccaggttcagtggcagtggtctgggacagagttcactctcaccatcagcagcctgcagtctgaagtattttgctagtttattactgtcagcaatatatgactggcctccgctcactttcggcggagggaccaaggtggagatacgaaacgaactggtggctgacctaccatctgttctctac

SEQ ID NO: 196244 - DNA, 526 bp, Homo sapiens
  misc_feature: GYAE6OF01CZKUJ.16.70.G04.1.454.CMB.1.raw
  modified_base (295)..(295): a, c, t, g, unknown or other
  misc_feature (295)..(295): n is a, c, g, or t
  modified_base (502)..(502): a, c, t, g, unknown or other
  misc_feature (502)..(502): n is a, c, g, or t
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccactcagagtattaccagcaacttagcctggtaccagcagaaacctggccaggcctcccaggctcctcatttanggtgcatccaccagggccacgtggtactcccagcccaggttcagtggcaggtggtctgggacagagttcactctcaccatcagcagcctgcagtctgaagtattttgactagtttatactgtacagactaatataatgactggccttccgcttccgtacgtttcggacggacggaccgtaagggtgagtatacgaaacgaagttggnggctgctactatctgttcttctac

SEQ ID NO: 196245 - DNA, 547 bp, Homo sapiens
  misc_feature: GYAE6OF01EAQLF.16.70.G04.1.454.CMB.1.raw
  modified_base (200)..(200): a, c, t, g, unknown or other
  misc_feature (200)..(200): n is a, c, g, or t
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccactcagagtattaccagcaacttagcctggtaccagcagaaacctggccaggctcccaggctcctcatttatggtgcatccaccagggccactggtactcccagccaggttcagtggcaggtggctggggacagagttcactctcaccatcagcagcctgcagtctgaagtatttgctagtttattactgtcagctaatataatgactcgcctccgctctacgtttcggcgggtacgggaccgtaagggtggaagtaacgtaccgaaaacggtaacgtggtcgggcctaggaccctaaccgtattccgttgttccttcgtacccg

SEQ ID NO: 196246 - DNA, 535 bp, Homo sapiens
  misc_feature: GYAE6OF01BPJN7.16.70.G04.1.454.CMB.1.raw
  modified_base (199)..(199): a, c, t, g, unknown or other
  misc_feature (199)..(199): n is a, c, g, or t
  modified_base (393)..(393): a, c, t, g, unknown or other
  misc_feature (393)..(393): n is a, c, g, or t
  modified_base (518)..(518): a, c, t, g, unknown or other
  misc_feature (518)..(518): n is a, c, g, or t
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtctccagccaccctgtctgtgtctccaggggaanagccaccctctcctgcagggccactcagagtattaccagcaacttagcctggtaccagcagaacctggccaggcctcccaggctcctcatttatggtgcatccaccagggccactggtactcccagccaggttcagtggcaggtggtctgggacagagttcactctcaccatcagcagcctgcagtctgaagtntttgctagttttattactgtcagtactaattaataatgactcggcccttccgctccgtacgtttcgggcgggacgggtaccgaagggtggagtagtaccgaaacgtacgtggtcggctgactacnttactcgttcttctacc

SEQ ID NO: 196247 - DNA, 585 bp, Homo sapiens
  misc_feature: GYAE6OF01DIORD.16.70.G04.1.454.CMB.1.raw
  modified_base (304)..(304): a, c, t, g, unknown or other
  misc_feature (304)..(304): n is a, c, g, or t
  modified_base (308)..(308): a, c, t, g, unknown or other
  misc_feature (308)..(308): n is a, c, g, or t
  modified_base (319)..(319): a, c, t, g, unknown or other
  misc_feature (319)..(319): n is a, c, g, or t
  modified_base (332)..(332): a, c, t, g, unknown or other
  misc_feature (332)..(332): n is a, c, g, or t
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtctccagccaccctgtctgtgtctccgaggggaaagacgccaccctctcctgccagggccactcagagtattaccagctaacttagcctggtaccagcaacgaacctggccaggcctcccgaggcctcctctatttagnggtncactccaccgnggccacgtgtacncccagcctaggttcagtggctaggtggtcgtgggacagtagttcactctacaccatcagcagcctgctagtcgtagtaagttagttttgacttagtttacttacgtgtacagtactaattataatgtacgtcgcctccgtactcgtaccgttcggacggacggtaccgtaaggtaggagtacgtaaccgaaaaccggtacgtggtcggccgttagacccgtacctacgttccgtttacgtccgtttctacccg

SEQ ID NO: 196248 - DNA, 526 bp, Homo sapiens
  misc_feature: GYAE6OF01EU2PA.16.70.G04.1.454.CMB.1.raw
  modified_base (521)..(521): a, c, t, g, unknown or other
  misc_feature (521)..(521): n is a, c, g, or t
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccactcagagtattaccagcaacttagcctggtaccagcaagaaacctggccaggcctcccaggctcctcatttatggtgcatcccaccgagggccacgtggtactcccagccaggttcaggtggcaggtggtctggggacaggagttcactctcaccatcagcagcctgctagtctagaagtattttgacttagtttattactgtacagtacaatataatgactcggcctccgctctacgtttcggcggacggaccgaagggtgagatacgaacgtatggtcgctgactaccatactctntctac

SEQ ID NO: 196249 - DNA, 534 bp, Homo sapiens
  misc_feature: GYAE6OF01DOTDP.16.70.G04.1.454.CMB.1.raw
  modified_base (393)..(393): a, c, t, g, unknown or other
  misc_feature (393)..(393): n is a, c, g, or t
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtctccagccaccctgtctgtgtctccaggggaaagagccacctctcctgcagggccactcagagtattaccagcaacttagcctggtaccagacaagaacctggccaggcctcccaggcctcctcatttagtggtgcatccacgaggccacgtggtactccagccaggttcagtgcaggtggctgggacagtagtcactctcacatcagcagctgcagtctgtaagtntttgactagtttattactgtcagactaatatatagactcgcctccgtcttacgtacgttcgggacgggacgggaaccgtaagggtgagtactacggaaaacgtagtggtcggctagaccgtactagtctcgttctcgtacc

SEQ ID NO: 196250 - DNA, 433 bp, Homo sapiens
  misc_feature: GYAE6OF01ELR1A.16.70.G04.1.454.CMB.1.raw
  modified_base (425)..(433): a, c, t, g, unknown or other
  misc_feature (425)..(433): n is a, c, g, or t
tcagtgtactactccacgaccggtgctcgatttagtgtagtgtgaagggaaaggggctggagtggatcgggaatatctattatagtgggagcacctactacaacccgtccctcaagagtcgagtcgccatatccgtagacacgtccaagaaccacttctccctgaaactgagctctgtgaccgccgcagacacggctgtctattactgtgcgagacagagttacgacggtggttactccggtctctttgacaacgtggggccagggaaccctggtcaccgtctcctcagcctccaccaagggcccatcggtcttccccctggcaccctcctccaacgagcacctcgtggggcacagcggccctgggctgcctggtcaaggactacttccgagtagtacactgagcgggctggcaaggcgcatagnnnnnnnnn

SEQ ID NO: 196251 - DNA, 533 bp, Homo sapiens
  misc_feature: GYAE6OF01C62ZA.16.70.G04.1.454.CMB.1.raw
  modified_base (359)..(359): a, c, t, g, unknown or other
  misc_feature (359)..(359): n is a, c, g, or t
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccactcagagtattaccagcaacttagcctggtaccagcagaaacctggccaggcctcccaggctcctcatttatggtgcactccaccaggggcccactggtactcccagccaggttcagtggcaggtggtctgggacngagttcactctcaccatcagcagcctgcagtctgaagtatttttgacttagtttattactgtacagactaatataatgactggcctccgctctacgtttcggacggacgggaccaagggtggagtagtacgaaacgtacgtggtcggctgaccactacttctcgttcttcgtac

SEQ ID NO: 196252 - DNA, 695 bp, Homo sapiens
  misc_feature: GYAE6OF01EKIDW.16.70.G04.1.454.CMB.1.raw
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcgagtctccagccaccctgtctgtgtctccgaggggaaagcgccaccctctcctgcagggccactcagagtacttaccagcaacttagcctggtaccagcaagaaacctggccaggcctcccaggctcctcatttagtggtgcactccaccgacgggccacgtcggtactcccagccgtaggttcaggtggacgtaggtgggtcgtggggactaggtacgttccacttcacacccatcgagccgacgtccgtagcgtacgtcgtagtaaagttactttagtacttaggttttaacttaccgtacgttactacgtactaaagttacttaaacgttacgtaaccgttcgggtaccccttcccggtaccttaccgttacccggttttaccggggaaccggggtaacggggtaacccggtaaggggtacgggaaacgtaacgttaaaccggaaaaccggttaacggttaggggtcggtaccgttacggaacccgttaccctacgtttaccgtttacggtttccgttaccgttacccg

SEQ ID NO: 196253 - DNA, 742 bp, Homo sapiens
  misc_feature: GYAE6OF01D5XR5.16.70.G04.1.454.CMB.1.raw
  modified_base (198)..(198): a, c, t, g, unknown or other
  misc_feature (198)..(198): n is a, c, g, or t
tcagtgtactactccacgaccggtgctcgatttagtgtagtgtgaagggaaagggggaactgctcagttaggacccagacggaaccatggaagccccagcgcagcttctcttcctcctgctactctggctcccagataccactggagaaatagtgatgacgcagtctccagccaccctgtctgtgtctccgagggaancgcccacctctcctgcgagggccactcgagtagttaacttaccagacctaacttacgccgtacggtaccagacaaacgtaaacccgtcggacccaggccctacccgaggtcctccgtactaattttacgtgggttcgacctaccgtacccgaacccggtacggggtcccacgttacggtaaccctccccgaagtcccgtaagggtttccaggttcggacgtagggttcgggtcgtggggaactaggtacgtttcaacttcgaccacctagtaccacggtcaccggtccgtagaccgtacgttacgtaggtaaacgttacgttttcgacgtttaagttttaccttacgttacgtacgtaacgtactaaagttaatttaacgtacggtacgttccgggtaccccttcccggtaccttaccgttaccggtttccggggacgggtaacggtaaccgtaagggtacggacgtaactaacggtaaaaccgtaggttcggtcggtaccgtcgaacccgtacttacgttcgtttacgttccgttacgtcccg

SEQ ID NO: 196254 - DNA, 538 bp, Homo sapiens
  misc_feature: GYAE6OF01DYSUD.16.70.G04.1.454.CMB.1.raw
  modified_base (200)..(200): a, c, t, g, unknown or other
  misc_feature (200)..(200): n is a, c, g, or t
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccactcagagtattaccagcaacttagcctggtaccagcagaaacctggccaggctcccaggctcctcatttatggtgcatcccaccaggggcccacgtggtactccccagccaggttcagtggcaggtgggtctgggacagtagttcactctacaccatcagcagcctgcagtctgtaagtattttgctagtttacttacgtgtacagactaatataatgacgtcgacctcgcttctacgtttcggacggtacggaccgtaagggtcggagtacgtacgaaacgtatggtcgcgtgactaccatctcgttctcgtacc

SEQ ID NO: 196255 - DNA, 535 bp, Homo sapiens
  misc_feature: GYAE6OF01C70VY.16.70.G04.1.454.CMB.1.raw
  modified_base (286)..(286): a, c, t, g, unknown or other
  misc_feature (286)..(286): n is a, c, g, or t
  modified_base (291)..(291): a, c, t, g, unknown or other
  misc_feature (291)..(291): n is a, c, g, or t
  modified_base (368)..(368): a, c, t, g, unknown or other
  misc_feature (368)..(368): n is a, c, g, or t
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtctccagccaccctgtctgtgtctccgaggggaaagagccaccctctcctgcagggccactcagagtattaccagcaacttagcctggtaccagcaagaacctggccaggctccagctctnattanggtgcatccaccgaggccacgtggtactccagccaggttcagtgcaggtggtctgggacagagttcactctcaccancagcagctgcagtctagaagttattttgcttaagtttattactgtcagtactaatataatgtactcgcctcgtctctacgtttcggacggtacggaccgtaagggtgaacgtactaacgaaacgtacgtggtcggactggacctaccgtattcttcgtcttctaccg

SEQ ID NO: 196256 - DNA, 543 bp, Homo sapiens
  misc_feature: GYAE6OF01DZ8TU.16.70.G04.1.454.CMB.1.raw
  modified_base (201)..(201): a, c, t, g, unknown or other
  misc_feature (201)..(201): n is a, c, g, or t
  modified_base (303)..(303): a, c, t, g, unknown or other
  misc_feature (303)..(303): n is a, c, g, or t
  modified_base (385)..(385): a, c, t, g, unknown or other
  misc_feature (385)..(385): n is a, c, g, or t
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtctccagccaccctgtctgtgtctccgaggggaaanagcccaccctctcctgcagggccactcagagttacttaccagacaacttagcctggtaccagccaagaaacctggccaggcctcccaggctcctctatttanggtgcatcccacgcgggccactggtactcccagcctaggttcaggtggcaggtcggtctgggacagtagttcactctcaccntcagcagcctgcgagtctgaagtagttttgacttagtttattactgtctagactaatataatagtctcgtcctccgtctctacgtttcggacgggtacgggacgtaagggtgagactacgaaacggtacgtggtgctgaccactatctgttctcgtac

SEQ ID NO: 196257 - DNA, 667 bp, Homo sapiens
  misc_feature: GYAE6OF01BKMAX.16.70.G04.1.454.CMB.1.raw
  modified_base (213)..(213): a, c, t, g, unknown or other
  misc_feature (213)..(213): n is a, c, g, or t
  modified_base (340)..(340): a, c, t, g, unknown or other
  misc_feature (340)..(340): n is a, c, g, or t
  modified_base (649)..(649): a, c, t, g, unknown or other
  misc_feature (649)..(649): n is a, c, g, or t
tcagtgtactactccacgaccggtgctcgatttagtgtagtgtgaagggaaggggggaactggctcgagttaggaccctagacggaaccataggaagccccaggcgcagcttctcttcctccgtgctactctggctcccagactaccactggagaaatggtgagtgacgcagtctccagccacctggtctggtcgtacctccgagggggaaancgtcccacccttctccctgcacgggtccaactcaagtacgttacttaccgagcctaacttaggccctagggtacccagacaaggaaccctgggaccaggcctcccgaggtcctacctctatttacgnggtcacactcccacgacgggccacgtggtactcccgagcccgtaggttcagggtcgacgtagggttcggtcgtaggggactaggtacgtttccaacgttcctaccaacctagtccgaacggccaaggtccctaggtaccctaggttccgtaggtaaagttgttttacgacttaaggttttacttacgtcgtacagtactaatactagtcgtactcggccttaccgcgttacgtaccgtttcgggacggtacggtaaccgtagggtacgacgtactaaccgtaacggtacgtggtcgactcgactacgtnttacgtcgtcctgtaccc

SEQ ID NO: 196258 - DNA, 556 bp, Homo sapiens
  misc_feature: GYAE6OF01DUE26.16.70.G04.1.454.CMB.1.raw
  modified_base (201)..(201): a, c, t, g, unknown or other
  misc_feature (201)..(201): n is a, c, g, or t
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtctccagccaccctgtctgtgtctccgaggggaaanagcccaccctctcctgcagggccactcagagtattaccagcaacttagcctggtaccagcagaacctggccaggctcccaggctcctcatttatggtgcactcccacccgaggggcccacgtggtactccccgagccctaggttcaggtggcaggtggtctgggacagacgttcactctcaccatcagcagccctgcagtctagtaagtattttgcttaagtttattacgtgtacagtactaattataatgactcgtcctccgtctcctacgtttcgggacggtacgggaccgtaagggtgagtagtacgtaaacgacgtggtcggctcgacacctattctcgttcttcgtaccg

SEQ ID NO: 196259 - DNA, 623 bp, Homo sapiens
  misc_feature: GYAE6OF01C6SJS.16.70.G04.1.454.CMB.1.raw
  modified_base (307)..(307): a, c, t, g, unknown or other
  misc_feature (307)..(307): n is a, c, g, or t
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtctccagccaccctgtctgtgtctccgaaggggaaagacgcccacccctctcctgcagggccactcagagtacttaccagctaacttagcctggtaccagacaagaacctggccaggcctcccgaggcctcctctatttagnggtcgacactccaccgagggccacgtggtactcccgagcctaggttcgaggtcggacagggttcgggtcgtaggggaactaggtacgtttaccacttcctaccacctagtcagccacgcctgcgtagtctaggtaagttagttttgactttagttttattacttgtacctaagactaattaataagtgtacgtcggtccttccgtcgttaccgtacggttcggacgggacgggtaccgtaggtaggacgtaacgtaaccgaaacgtacgttggtcggtaccgtcgacctaccgttatcgttacgtccttcgtaccc

SEQ ID NO: 196260 - DNA, 509 bp, Homo sapiens
  misc_feature: GYAE6OF01E4L9J.16.70.G04.1.454.CMB.1.raw
  modified_base (465)..(465): a, c, t, g, unknown or other
  misc_feature (465)..(465): n is a, c, g, or t
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccactcagagtattaccagcaacttagcctggtaccagcagaaacctggccaggctcccaggctcctcattatggtgcatccaccagggccactggtactcccagccaggttcagtggcagtggtctgggacagagttcactctcaccatcagcagcctgcagtctagagtattttgctagtttattactgtcagacaatataatgactggcctccgctctacgtttcggcggagggaccgaggngagatacgaaacgatggtggctgaccaccatcttcgtcttctac

SEQ ID NO: 196261 - DNA, 556 bp, Homo sapiens
  misc_feature: GYAE6OF01B09FB.16.70.G04.1.454.CMB.1.raw
  modified_base (201)..(201): a, c, t, g, unknown or other
  misc_feature (201)..(201): n is a, c, g, or t
  modified_base (401)..(401): a, c, t, g, unknown or other
  misc_feature (401)..(401): n is a, c, g, or t
tcagtgtactactccacgaccggtgctcgatttagtgtagtgtgaaggggaaaggggggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccactcagagtattaccagcaacttagcctggtaccagcagaaacctggccaggcctcccaggctcctcatttatggtgcactcccaccgagggccacgtggtactcccagccaggttcagtggcaggtggtctgggacagtagttcactctcaccatcagcagcctgctagtctagaatntttgcttagtttatacgtgtcagtactaatataatgactggccctccgtctccgtacgtttcgggacggacggaaccgaagggtaggagtacgtacgaaacgtagttcggtcggccttaggacctacccgtaattccgttgttccttcgttaccg

SEQ ID NO: 196262 - DNA, 585 bp, Homo sapiens
  misc_feature: GYAE6OF01AHL5B.16.70.G04.1.454.CMB.1.raw
  modified_base (416)..(416): a, c, t, g, unknown or other
  misc_feature (416)..(416): n is a, c, g, or t
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtctccagccaccctgtctgtgtctccgaggggaaagagccaccctctcctgcagggccactcagagtattaccagcaacttagcctggtaccagcagaacctggccaggcctcccgaggcctcctctattttagtggtgcctatcccaccgagggcccacgtggtactcccgagcctaggttcaggtggcaggttgggtctgggacaggtagttcactctcaccatcagcagcctgctagtctagtaagtntttgacttagtttactactgtacagtactaaatagtatacgtacgttcggaccctccgtacttccgtaccgtttccgggacggtacgggtaccgtaagggtcggaacgtaacgtacgaaacgtaggtcggtcggctacgacctaccgtattactcgttccttcgtaccc

SEQ ID NO: 196263 - DNA, 584 bp, Homo sapiens
  misc_feature: GYAE6OF01CZYRT.16.70.G04.1.454.CMB.1.raw
  modified_base (573)..(573): a, c, t, g, unknown or other
  misc_feature (573)..(573): n is a, c, g, or t
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccactcagagtattaccagcaacttagcctggtaccagcaagaaaccctggccaggcctcccgaggcctcctctatttagtggtgcactcccgaaccgagggcccacgtggtactccccgagcccgaggtttcaggttcgggctaggtgggtctggggacaggtagtttcactctcaccatcagcagcctgctagtctagaagtattttgacttagtttattactgttacgaagtactaaattataatcgtacgtacgccctccgtctccgttacgttcgggcgggtacggaccgtaaggtcgggaagacgtacgaaacgtacgtggtcggcgtacgactacctattccgttntccttgtaccc

SEQ ID NO: 196264 - DNA, 597 bp, Homo sapiens
  misc_feature: GYAE6OF01ARU8Z.16.70.G04.1.454.CMB.1.raw
  modified_base (199)..(199): a, c, t, g, unknown or other
  misc_feature (199)..(199): n is a, c, g, or t
  modified_base (390)..(390): a, c, t, g, unknown or other
  misc_feature (390)..(390): n is a, c, g, or t
  modified_base (417)..(417): a, c, t, g, unknown or other
  misc_feature (417)..(417): n is a, c, g, or t
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtctccagccaccctgtctgtgtctcaggggaaangcccacctctcctgcagggccactcagagtacttaccagccaacttagcctggtaccagcaagaaacctggccaggctccaggcctcctctatttagtggtcgcactcccaaccgcgggcccacgtcggtactcccgagtccctaggttccaggtcggcaggtgggtcaggggacagagttcactctcacntcagcagcctgctagtctaggaagttnttttacgcttaagttttagtactgtacgtagactaagttattaagtcgtacgtcgtacccttcggccttagttaccgttccgggaaggacgggtaccgtagggtgacgacgtaaccgtaaacggtagttaggtcggtactacggaccctacgtacttaccgtggttccctttcgtacccg

SEQ ID NO: 196265 - DNA, 528 bp, Homo sapiens
  misc_feature: GYAE6OF01ETTHQ.16.70.G04.1.454.CMB.1.raw
  modified_base (523)..(523): a, c, t, g, unknown or other
  misc_feature (523)..(523): n is a, c, g, or t
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccactcagagtattaccagcaactagcctggtaccagcagaaacctggccaggctcccaggctcctcatttatggttgcatcccaccgaggggcccacgtggtactccccagcccaggttcaggtggcaggtggtctggggacagagttcacgtctacaccatcagcagcctgcagtctagaagtattttagctagtttattactgtcagacaataataatgacgtcggcctcgcttcacgtttcggcgggaggaccgagggtgagatacgaaacgataggcgactgaccacatcgtgttctntaccg

SEQ ID NO: 196266 - DNA, 609 bp, Homo sapiens
  misc_feature: GYAE6OF01BZI06.16.70.G04.1.454.CMB.1.raw
  modified_base (453)..(453): a, c, t, g, unknown or other
  misc_feature (453)..(453): n is a, c, g, or t
  modified_base (591)..(591): a, c, t, g, unknown or other
  misc_feature (591)..(591): n is a, c, g, or t
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtctccagccaccctgtctgtgtctccgaggggaaagagcccaccctctcctgccagggccactcagagtattaccagcaacttagcctggtaccagcaagaaaccctggaccaggcctcccgaggcctcctctatttagtggtgcatcccgaaccgagggccctacgtacggtactacccgacgtcctagggttccagtcggcgtaggttgggtacgtggggacaggtacgttcaaccgttctaccacccagtccagacacggccttaggctacgttctaggaagttnttttacgattagttttaatcgtgttacagtactaattaataagtcgtacgtcggccttccgcttcgtacgttcgggacggtacggaccgaagggttgacgtaagttaacgaaacgtatgggtacgctacgacctaccnttactcgttctcgtaccg

SEQ ID NO: 196267 - DNA, 544 bp, Homo sapiens
  misc_feature: GYAE6OF01DFH9V.16.70.G04.1.454.CMB.1.raw
  modified_base (297)..(297): a, c, t, g, unknown or other
  misc_feature (297)..(297): n is a, c, g, or t
  modified_base (361)..(361): a, c, t, g, unknown or other
  misc_feature (361)..(361): n is a, c, g, or t
  modified_base (403)..(403): a, c, t, g, unknown or other
  misc_feature (403)..(403): n is a, c, g, or t
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaatagtgatgacgcagtctccagccaccctgtctgtgtctccgaggggaaagagcccaccctctcctgccagggccactcagagtattaccagcaacttagcctggtaccagcaagaaacctggccaggcctcccaggctcctcatttnggtgcatccaccgagggcccacgtggtactcccgagtccaggttcagtgcagtggtctgggacngtagttcactctcactatcagcacgcctgcagtctgaagttntttgacttagtttattactgtctagtctaattataatgtacgtcggcctccgctactacgtttcggacggtaggaccgtaaggtgacgtagtacgaaacggtactggtcgcgtgacgtacgtacttctcgtcttcgtaccg

SEQ ID NO: 196268 - DNA, 642 bp, Homo sapiens
  misc_feature: GYAE6OF01CVKUG.16.70.G04.1.454.CMB.1.raw
  modified_base (201)..(201): a, c, t, g, unknown or other
  misc_feature (201)..(201): n is a, c, g, or t
  modified_base (298)..(298): a, c, t, g, unknown or other
  misc_feature (298)..(298): n is a, c, g, or t
  modified_base (302)..(302): a, c, t, g, unknown or other
  misc_feature (302)..(302): n is a, c, g, or t
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtctccagccaccctgtctgtgtctccgaggggaaancgcccaccctctcctgcagggccactcagagtataccagcaacttagcctggaccagcaagaacctggccaggcctcccgaggcctcctctatttgnggtncactccaccgagggccagtggtactcccgagcctaggttcaggtggctaggtggtctggggacagtgttcactctcacatcgagcacgctgcagtcgtagtaagttattttcgacgttagtttacttacgtagtacgtaagtactaattaataagtacgtacgttcggacccttccggtaccgttaccgttaaccggtttcggggaccgggtacggggtaaccgtaaggggttcggaaacggtaacgtaaccgtaaaaccggtaacggttacgggtcggtaccgttaccggacccgttaacccgttaacgttccgtttaccgttccgtttaccgttaccg

SEQ ID NO: 196269 - DNA, 912 bp, Homo sapiens
  misc_feature: GYAE6OF01D9Q9F.16.70.G04.1.454.CMB.1.raw
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtctccagccaccctgtctgtgtctccgaggggaaagcgcccaccctctcctgcgacggccactcagtagtacttaccagactaacttacgccttacgggtaaccaggaccgaacgaaacccgtcggacccgacgggtccctaccccgaacgggtcccttacccgttaccgttaagtttttacgtacggggttcgtaccgtaaccgttaccccgaaacccgggaaccggggtacccctaaccggtttacgggttaaccctaccccgaacggtacccgttaagggtttaccgaagggttcgggtaccggttaacggggttcggggttaccggttaacggggggtaaacctaacggggttaaccgttttcccgtaaacccgttcctaacccgtaacccgtaacgttacccgaacggcccgtaaccggtcccgttacggtaccgttaacgggttaccgttaagggttaaacgtttacggttttagtaaccgttttaacgtttttaacgttacggtttaccgtaacgtaaaggttaaccttaaagtttaacgtttaacgttaccggtaaccgttccgggtaccccttacccggtaccgtttacccggttaacccgggttttcgggaacccgggggtaacgggtaaccggtaaaggggtacggtaaacgtaaccgtaaccggtaaaacggttacgtcgggtacggtccgtacggaccctacgttacttcgtttacgttccgttacgtaccccg

SEQ ID NO: 196270 - DNA, 579 bp, Homo sapiens
  misc_feature: GYAE6OF01D4LF6.16.70.G04.1.454.CMB.1.raw
  modified_base (201)..(201): a, c, t, g, unknown or other
  misc_feature (201)..(201): n is a, c, g, or t
  modified_base (295)..(295): a, c, t, g, unknown or other
  misc_feature (295)..(295): n is a, c, g, or t
  modified_base (371)..(371): a, c, t, g, unknown or other
  misc_feature (371)..(371): n is a, c, g, or t
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtctccagccaccctgtctgtgtctccgaggggaaanagccaccctctcctgcgagggccactcagagtataccagcaacttagcctggtaccagcagaacctggccaggcctccaggctcctctatttanggtgcactccaccgagggccacgtggtactcccagccaggttcaggtggcaggtcggtctgggacagagtcactcncacatcagcagcctgcagtctagaagtagttttgacttagtttattactagtcagtctaatataagtcgtacgtcgaccctcccgtctaccgttacgttccgggacgggtacgggaccgtaaaggggtcggaacggaattaccggaaaaccggtaaggtcggtcggtcgtcgaccgtaaccctagttacctttcgtccttcgtacccg

SEQ ID NO: 196271 - DNA, 576 bp, Homo sapiens
  misc_feature: GYAE6OF01CJS7X.16.70.G04.1.454.CMB.1.raw
tcagtgtactactccacgaccggtgctcgatttagtgtagtgtgaagggaaggggggaactgctcagttaggacccagacggaaccatggaagccccagcgcagcttctcttcctcctgctactctggctcccagataccactggagaatagtgatgacgcagtctccagccaccctgtctgtgtctccaggggaaagagccaccctctcctgcagggccactcagagtattaccagcaacttagcctggtaccagcaagaacctggccaggcctcccgaggcctcctctatttagtggtcgcatcccaccgacgggccacgtcggtactcccgagccgtaggttcaggtggacgaggtcggtcgtgggacaggtacgttcactctacaccatcgagcacgcctgcagtcgtagtaagtattttgacttagtttattacgtgtactagactaattataatacgtacgtcggcctccgtctcgtaccgtttcgggacggtacggaacgagggtacggagtacgtacgaaacgtagtggtcgacgtacgacgtaccacgttcgtcgttcgttctaccg

SEQ ID NO: 196272 - DNA, 789 bp, Homo sapiens
  misc_feature: GYAE6OF01DACD6.16.70.G04.1.454.CMB.1.raw
  modified_base (200)..(200): a, c, t, g, unknown or other
  misc_feature (200)..(200): n is a, c, g, or t
tcagtgtactactccacgaccggtgctcgatttagtgtagtgtgaagggaaagggggaactgctcagttaggacccagacggaaccatggaagccccagcgcagcttctcttcctcctgctactctggctcccagataccactggagaaatagtgatgacgcagtctccagccaccctgtctgtgtctccgaggggaaancgcccacctctcctgcgacggccactcaggtagtactaccagacctaacttacgcctacggtaccagaccaaacgaaacccgtcggcccgaagggccctacccgaggtcccttccctattaagtttacgtgggttacacctaacttcccggaacccgaggggtcccctaacggttccggtaacctcccccgaagggtaccccgtaacgggtttccgtaagggtcgggtaccgtaaggggttccgggggttcgtaacggggtaaaccgtagggttaccgtttacccaaccctttcgaccccaccgtaactccgaacggtcctacgtcccgtacgaccttacgtaccgtagtaaaggtttcgttttcgaacgttttagtttaccttacgtaggtactacggtactaaacgttaatacgttacgtacgtccggttaccctaccggtcccttaccggttacggttcccggggaacggtccggggtaaaaccgtagggtacggtaacgtaaaccgaaacggtaaaaccgtcggttaggtacgtaccgacgaaccctaaccggtttccgtcggttactttccgtaccgttacccg

SEQ ID NO: 196273 - DNA, 763 bp, Homo sapiens
  misc_feature: GYAE6OF01ECKCU.16.70.G04.1.454.CMB.1.raw
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtctccagcccacctgtctgtgtctccgaaggggaaacgacgcccaccctctccgtgccgacgggccactcgagagtacttaaccagaccaacttagccgtcggtaccagacaacgaaacccgtggacccacggccctacccgaacggtccttcctacgttaagtttacgtcggtcgcctatccccgaaccggaccgggtaccgtacgttcggtaccttaccccgacggtacccgtagggttccgaaggtcggcggtaggtcgggtacgaggggacgtaacgtcgttccgaccttccgtaacgacctataccgagccgtacgccgtagcctagtccgtaagttaacgttacgtttagacgtttaagtttactcgttacgtcgtaacgtattaaacttattaacgttacgtaccgttacccggttccctaccgtccgttaacccgttacggggttaccggacggggaaccgggttaaccggtaaggggtacggtaaccgtaaaccgtaaaccgggtaaaccgttagggtaggttcgggtacccgtaccgtaacccgtaactacggtttacccggtttcgttaccctttacgtacccccgg

SEQ ID NO: 196274 - DNA, 769 bp, Homo sapiens
  misc_feature: GYAE6OF01C0AG9.16.70.G04.1.454.CMB.1.raw
  modified_base (209)..(209): a, c, t, g, unknown or other
  misc_feature (209)..(209): n is a, c, g, or t
  modified_base (336)..(336): a, c, t, g, unknown or other
  misc_feature (336)..(336): n is a, c, g, or t
  modified_base (419)..(419): a, c, t, g, unknown or other
  misc_feature (419)..(419): n is a, c, g, or t
  modified_base (457)..(457): a, c, t, g, unknown or other
  misc_feature (457)..(457): n is a, c, g, or t
tcagtgtactactccacgaccggtgctcgatttagtgtagtgtgaagggaaaggggggaactgctcagttaggacccagacggaaccatggaagcccagcgcagcttctcttcctcctgctactctggcctcccagactaccactgggaagaaatagtgatgacgcagtcctccacgccctaccctgtctgtcgtcaccgaaggggaancgcccaccctctccgtggcgacggccactacagtagttactaccgagctaacgttgccgtagtaccagacaaacgaaccgtcggccaacggtcctacccgaggtaccttccttactaagttttacgnggtacgacctaccgtaccccgaccggacgggaccctaaccggtttggtacctacccgaacgtccgtaggtttccgaggttcgnggtagggtcggttagacgggaacgaggttaccgtaccnccgttcgtaaccaccgtacgtaaccgacgaccgtacggcgtacgtacgtacgttacgttaacgtaagtttacgttttcgtaacgtttaacgtttttaacgtacgttacgtaactaaacgttactaaaacgtttaagtaacgttcggtaacccgttcccggtaacccttcccggttccggttaaccgttacccgggttacgggaaccgggtagggtaaaccgttaggggacgtaataaccgtaaacgtaaccggtaggttcgaccggtctacggaccttacgttaacttccgtaccgtttcttaccgtacccg

SEQ ID NO: 196275 - DNA, 921 bp, Homo sapiens
  misc_feature: GYAE6OF01EHGTE.16.70.G04.1.454.CMB.1.raw
  modified_base (212)..(212): a, c, t, g, unknown or other
  misc_feature (212)..(212): n is a, c, g, or t
  modified_base (452)..(452): a, c, t, g, unknown or other
  misc_feature (452)..(452): n is a, c, g, or t
tcagtgtactactccacgaccggtgctcgatttagtgtagtgtgaaggggaaaggggggaactgctcagttaggacccagacggaaccatggaacgccccagcgcagcttctcttcctcctgctactctggcctccagactaccacgtaggaagaaataggtgatgacgcagtcctaccagcccacctgtctgtcgtacacggaagggaaanacgcccaccctcctcgtggacgacggaccactacgaacggtaattaacttaaccgacgtaccgtaaaccgtttaacggcccgtaacgggtaaaccaggaacccgaaaggtaaaccccgtagggaccccgtacgggtaccctacccggaacggtccttaccgttaccgttaagttttacggcgggttaccgacctaaccgtacccggaaccggtacgggtaccctacggttacggtaaccnccgtaacgacggtacggttacgagggtacggcggtacggtcgggtacggtagggaacgtaacggttacttcccgtaccgtactaaccctacgtaactacgtaacgacgtacgtaccgtacgtacggtaattccggtaaggtaacgttttctttaacggttaaccgttttaggtttaaacctttggtaccgtaaccgttaagtaaaacttaaagttaacgttaacgcggtttaacccgtcccgggtaccctttaacccggtctttaaacccgggtaccgggggtttaacgggaacccggggggtaaacggtaaaccgggtaaggggtttacggtaaaaaccgtaaaccggtttaaaccccgggaaaaacgggttttagaaccgggggtttacccgagtaaccccgtaaacccttaaacccgggtttacttacccgttttaccggttaacccgttcggtttaaaccccccg

SEQ ID NO: 196276 - DNA, 762 bp, Homo sapiens
  misc_feature: GYAE6OF01CG90B.16.70.G04.1.454.CMB.1.raw
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtctccagccaccctgtctgtcgtctccgaaggggaaagcgcccaccctctcctgcgacgggccactcagtagtaacttaccacgacctaaacgttacgcccgtaggtaccaagaccaacgaaacccgtcgggacccaggtcctcccgaggtccctcccttacgtaagtttacgttcgggtcgtccacttacccgaccgtacgggccctacgtcggtactcccgacgtcccgtaggttcgaggtcggacgtagggttcgggtacgtagggtaaccgaggtacgtttacctaccgttctaccaccgtaataccgagccgacgtcgtcgaccgtacggtaccttaaggtaagtttacttttggtactttaaaggttttactttacgttacgttacaacgtaaccttaaagttaacgtaagtaccgttaacgttccggtaccccgttcccgtacgttaccgtttaaccggtttccggggaacggggtaccggtaaccggaagggttcggaacgtaaccgtaaccggtaaaaccggtggttaccgggcggttaacgtcgtacccgtacgttaccgttagttcgtttcccgttaccttacccg

SEQ ID NO: 196277 - DNA, 692 bp, Homo sapiens
  misc_feature: GYAE6OF01BCR0V.16.70.G04.1.454.CMB.1.raw
  modified_base (201)..(201): a, c, t, g, unknown or other
  misc_feature (201)..(201): n is a, c, g, or t
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtctccagccaccctgtctgtgtctccgaaggggaancgccaccctctcctgcagggccactcagagtacttaccagcctaacttacgcctggtaccagcaagaaaccgtggaccaggcctcccgaggccttcctctaattttagcggtagcactccgacccgacgggccctacgttcggtacctcccgacgtcccgtagggttccagggttcgggaccgtagggtcgggtcgtacggggactacggtacgttccaccgttcctaccacctagtccgaagcacgtccgtgacctacgttcgaaggtaactttagttttcgaacgtttaaggttttactttacgtgtaactagtacttaacttaataacgtcgtacgtccgtcccttccgacgtttaccgttaccggtttccgggaacgggacgggtaacccggtaaggggtcgtaaacgtacgttaaaccggaaacggttacacgggtcggacctacggaccctacccgttattacccgtcgttacgttcccgtaccg

SEQ ID NO: 196278 - DNA, 638 bp, Homo sapiens
  misc_feature: GYAE6OF01BEGGR.16.70.G04.1.454.CMB.1.raw
  modified_base (303)..(303): a, c, t, g, unknown or other
  misc_feature (303)..(303): n is a, c, g, or t
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtctccagccaccctgtctgtgtctccgaggggaaagagcccaccctctcctgcagggccactcagagtattaccagcaacttagcctggtaccagcaagaacctggccaggcctcccgaggcctcctactattttagnggtcgcactcccaccgacgggacccacgttggtactccccgagccccgtagggtttccaaggtcgggactagggttcgggtcgtggggaactaggtacgttccacgttctaccacactcgagcacgcctgctagtcgtagtaagttatttgacttagtttacttactgtactagtactaatattaatcgtactcggcccttccgtcttaccgtacggtttaccgggacgggtacgggaaccgtaagggtacggtaacgtaacgttaaccgaaaccggtacggttggtacggtaccgtggaaccctacgacttcgttaccgttccgttcttacccg

SEQ ID NO: 196279 - DNA, 729 bp, Homo sapiens
  misc_feature: GYAE6OF01CKVG0.16.70.G04.1.454.CMB.1.raw
  modified_base (315)..(315): a, c, t, g, unknown or other
  misc_feature (315)..(315): n is a, c, g, or t
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtctccagccaccctgtctgtgtctccgaaggggaaagacgcccaccctctcctgcagggcccactcagagtattaccagctaacttagccgtggtaccacggacaacgaaaccctggaccaggcctcccgaggcctcctactatttacgnggtgccatcccaccgacgggccacgttcggtactcccgagtcccgtaggttccaggttcggactaggtcgggtctaggggactaaggtacgtttccacttcctaccgacctactcgacgtccacggtcctacggactagttccgtagtaagttacttttacggacttaaggttttacttacgtacgtacgtacgtaactaagttaagttaacgtacggtaacgttccggtacccgtacccgtaccttacccgttaccgggtttaccgggtaccggggtaacgggtaacccggttaaaggggtacggtaaacggtaaccgttaaaccggaaaaccggttaacggttacgggtaccggtcgtaacggaccctaacccgttacgttacccgtttcgttaccctttacgttaccccgg

SEQ ID NO: 196280 - DNA, 746 bp, Homo sapiens
  misc_feature: GYAE6OF01CAN62.16.70.G04.1.454.CMB.1.raw
  modified_base (199)..(199): a, c, t, g, unknown or other
  misc_feature (199)..(199): n is a, c, g, or t
tcagtgtactactccacgaccggtgctcgatttagtgtagtgtgaaggggaaaggggggaactgctcagttaggacccagacggaaccatggaagccccagcgcagcttctcttcctcctgctactctggctcccagataccactggagaaatagtgatgacgcagtctccagccacctgtctgtgtctcgaggggaancgccaccctctcctgcgacggccactcagtagtactacagactaacgttacgccgtaggtaccaaggactaaacggaaacccgtcgggaccgacggtccctacccgacggtccttacccgtactaattttaggtcgggtcgacctaccgtacccgaaccgacggggtacccctacggtacgggttaacctccccggaagtcccgtaggtttaccgagggtcggtccgtaggggttcgggtacgtagggaaccgtaggtacgtttaccaccgttcttaacccgaacctacggtaccgtacggccgtacgtacctggtacctaggttacgtaaggtaacgtttgttttacgacgtttaagttttactacgttggtaaccgaataacgttaaattacgtaactacggtacgtccgcccgttaccgtcgttaccgttaccggttacgggacgggaacggtcgtaacgggtagaacgtacgtaacgaaacggttggtcggtagtacccgtagacccttaaccgtacgttagttcccgttgttccctacccgg

SEQ ID NO: 196281 - DNA, 588 bp, Homo sapiens
  misc_feature: GYAE6OF01B90HU.16.70.G04.1.454.CMB.1.raw
  modified_base (188)..(188): a, c, t, g, unknown or other
  misc_feature (188)..(188): n is a, c, g, or t
  modified_base (201)..(201): a, c, t, g, unknown or other
  misc_feature (201)..(201): n is a, c, g, or t
  modified_base (212)..(212): a, c, t, g, unknown or other
  misc_feature (212)..(212): n is a, c, g, or t
  modified_base (318)..(318): a, c, t, g, unknown or other
  misc_feature (318)..(318): n is a, c, g, or t
  modified_base (322)..(322): a, c, t, g, unknown or other
  misc_feature (322)..(322): n is a, c, g, or t
  modified_base (421)..(421): a, c, t, g, unknown or other
  misc_feature (421)..(421): n is a, c, g, or t
  modified_base (425)..(425): a, c, t, g, unknown or other
  misc_feature (425)..(425): n is a, c, g, or t
  modified_base (443)..(443): a, c, t, g, unknown or other
  misc_feature (443)..(443): n is a, c, g, or t
  modified_base (451)..(451): a, c, t, g, unknown or other
  misc_feature (451)..(451): n is a, c, g, or t
  modified_base (561)..(561): a, c, t, g, unknown or other
  misc_feature (561)..(561): n is a, c, g, or t
  modified_base (568)..(568): a, c, t, g, unknown or other
  misc_feature (568)..(568): n is a, c, g, or t
  modified_base (580)..(580): a, c, t, g, unknown or other
  misc_feature (580)..(580): n is a, c, g, or t
  modified_base (585)..(585): a, c, t, g, unknown or other
  misc_feature (585)..(585): n is a, c, g, or t
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatgtgatgacgcagtctccagcccacctgtctgtgtcnccgaaggggaaancgcccacctcncctgcgaggccactcgagagttacttaccaggacaacgtttacgccgttaggaccagaccaagaaaacctcggaccaggcctaccgaggtcttacctactatttanggtnacatcccaccgagggtcccagttcggtaccacccgtagtcccgtaggttacaggttggactaggtacgggtcgtagggacagtacgtttcactctcacncgtnacgcacgctagctacgtntacgaatntttacgactagtttaacttgtcggtaacagtacaataacgtaagtcacgtcgacctcgtactcgttaccgttggacgggacgaccgtaaggtagataacgacgaacgagngtcgacngacacgtatcgntcgtntcc

SEQ ID NO: 196282 - DNA, 900 bp, Homo sapiens
  misc_feature: GYAE6OF01EJOBB.16.70.G04.1.454.CMB.1.raw
  modified_base (213)..(213): a, c, t, g, unknown or other
  misc_feature (213)..(213): n is a, c, g, or t
  modified_base (628)..(628): a, c, t, g, unknown or other
  misc_feature (628)..(628): n is a, c, g, or t
  modified_base (863)..(863): a, c, t, g, unknown or other
  misc_feature (863)..(863): n is a, c, g, or t
  modified_base (887)..(887): a, c, t, g, unknown or other
  misc_feature (887)..(887): n is a, c, g, or t
tcagtgtactactccacgaccggtgctcgatttagtgtagtgtgaagggaaaggggggaactgctcagttaggacccagacggaaccatggaagccccagcgcagcttctcttcctcctgctactctggctcccagactaccactggaagaaatagtgatgacgcagtcctccacgccacccttgtctgtcgtccgtaccggaaggggaaacncgccctaccccttctccgtcggccgacggaccctactcgaagtaacgttaacttaaccgagtaacctaaccgtttaccggaccgttacgggtacccaacggaccgtaaacggtaaacccgtcgggacccgaccgggtacccttacccggaaccgggttcccttacccgtttacgttaacgtttttaacgggtacggttccgtaacctaccggttacccccgaaccgggtacccggggtaccctaacccggtttacgggttacccctaccccggtacggtaacccggttaagggttaccgtaacgggttcgggtccggtaggggttcgggtaccggtaacgggaccgttaacggttaccgttcctaaccttccgtaacctaccggacttaccggacgtaccgtacgtcccgttaanacgtttacggtaccgttaaggttaaacgtttcgtttaacggtaactttttaacggttaacctttagttacgtacgtaagtaacctttaaagttaacggttacgttacgtaccgttccggtaccgtttacccggtactttaccggttaaccggggttaccgggaacgggttaaaccggaacggtaagggtaactacggtaacgtaaacggtaacggttaccgtggacgttaccgtnaacccgtacttcgttacgtccttnttaccggtacccc

SEQ ID NO: 196283 - DNA, 730 bp, Homo sapiens
  misc_feature: GYAE6OF01ATMA4.16.70.G04.1.454.CMB.1.raw
  modified_base (203)..(203): a, c, t, g, unknown or other
  misc_feature (203)..(203): n is a, c, g, or t
tcagtgtactactccacgaccggtgctcgatttagtgtagtgtgaagggaaagggggaactgctcagttaggacccagacggaaccatggaagccccagcgcagcttctcttcctcctgctactctggctcccagataccactggagaaatagtgatgacgctagtctccagccaccctgtcctgtgtctccgaaggggaaancgcccaccctctcctgaccgacggccactcgagacgtacttaccagacctaacttacgcctacggtaccagaccgaagaaaccgtggccaggcctcccaggtcctcctcatttacgtggtcgctaactcccgaaccgaccgggtcccacgttcgggtacctcccggaagtcccgtaagggtttccgaagttcgggaccgtagggttcgggtccgtaggggtacaaggtagtttccaaccttctacccgtaccgatcccaaagcccgagcccgtacgcgtacgtcgtacgtaacgtttacgttttacgtacgtttaacgttttacgttacgttacgtacgttaacgttaacgtaaacgttaattaacgttaccgttacgtccgggttaccttacccggtcccttaccgttaacgttttaccgggaaccgggtaacgggaacgtaacggggtaggtacgtaagtaaccgtaaacggtacgtaggtacgtcgtacgaccgtacgtactttcggtcttcgtacgttacccg

SEQ ID NO: 196284 - DNA, 816 bp, Homo sapiens
  misc_feature: GYAE6OF01CVXD0.16.70.G04.1.454.CMB.1.raw
  modified_base (203)..(203): a, c, t, g, unknown or other
  misc_feature (203)..(203): n is a, c, g, or t
  modified_base (218)..(218): a, c, t, g, unknown or other
  misc_feature (218)..(218): n is a, c, g, or t
tcagtgtactactccacgaccggtgctcgatttagtgtagtgtgaaggggaaaggggggaactgctcagttaggacccagacggaaccatggaagccccagcgcagcttctcttcctcctgctactctggctcccagataccactggagaaatagtgatgacgcagtctccagcccacctgtctgtgtcctacgaaggggaancgcccacctctccgngcagggccactcagtagttacttaccagacctaactttacgccgtaggtaccaggaccaacggtaaaccctgggaccgacggtccctaccccgaggtacccttccgtacttaagttttcgtcggtacgacctacttacccgaaccgacggggtacccctaacggttcggtaaccctcccccggaaggtaccccgttaagggtttccaaggggttcggaccggttaggggttcgggttacgacggggtaacctaggtaccgtttaccctacttaccctacccaacgtaagttcccgaagcccgtaacggtcccgtacggtacgtacggttacgttaaggtaaacgttttagttttacggtaacgttttaaagttttactttacgtacgttaacgtaagtaacttaagttaactaagtaccgtaaccgttccggtacccgttaccgttaccgttaccggttaacggtttaccggggtaacgggacgggtaaccgtaaaggggttacggaaacgtaccgtaaaccggaaaaccggttgtcggttacgggccttacgtacccgtaaccttacgttcccgttacggttcccttcgttaacccg

SEQ ID NO: 196285 - DNA, 613 bp, Homo sapiens
  misc_feature: GYAE6OF01BS1S5.16.70.G04.1.454.CMB.1.raw
  modified_base (198)..(198): a, c, t, g, unknown or other
  misc_feature (198)..(198): n is a, c, g, or t
  modified_base (444)..(444): a, c, t, g, unknown or other
  misc_feature (444)..(444): n is a, c, g, or t
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtctcagccaccctgtctgtgtctccaggggaanagccaccctctcctgcagggccactcagagtattaccagcaacttagcctaggtaccagcagaaacctggccaggcctcccaggcctcctctattttagtggtcgctactcccaaccgacggggccctacgtggtactccccgagcccgaggttccaaggtcggcgtaggtgggttcgtacggggacagtacgttaccgactctaccgaccatctaacgcacgccgtgcgtagtcctagaagtttntttcgtcttagttttattactgtactagtactaattaatatacgtacgtcgtccttccgctaccgtacggtttacggcggtacgggaccgttagggcggtaacgtacgtacgaaacggtacgttagggcggtacgtcgacctacgtacgttcgtcgttcctcttacccg

SEQ ID NO: 196286 - DNA, 620 bp, Homo sapiens
  misc_feature: GYAE6OF01B094G.16.70.G04.1.454.CMB.1.raw
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtctccagccaccctgtctgtgtctccgaggggaaagacgccaccctctcctgccagggccactcagagtacttaccagactaacttagcctggtaccagccagaaacctggaccaggcctcccgaggcctcctctatttatggtcgcactcccgaccgacgggccacgtcggtactcccgacgccgtaggttcagtcggctaggtggtcgtgggacagtagttcacgtctcacactcagcacgctgctagtcagtagttatttcgacttagttttaacttacttgtacacgtaactaagttactaagtcgaacgttcccggtcccttaccggtccttacgttaccggtttccggggaccgggtaacggtaacccgtaggggtacgaacggtagtaaccgtaaacggtacgtggtacgtcgtacgacctacactttcgtacgttcttacgtacccg

SEQ ID NO: 196287 - DNA, 891 bp, Homo sapiens
  misc_feature: GYAE6OF01DZXM8.16.70.G04.1.454.CMB.1.raw
  modified_base (136)..(136): a, c, t, g, unknown or other
  misc_feature (136)..(136): n is a, c, g, or t
  modified_base (218)..(218): a, c, t, g, unknown or other
  misc_feature (218)..(218): n is a, c, g, or t
tcagtgtactactccacgaccggtgctcgatttagtgtagtgtgaagggaaggggggaactgctcagttaggacccagacggaaccatggaagccccagcgcagcttctcttcctcctgctactctggcctccagntaccactaggaagaaatagtgatcgacgctagtcctaccacgccctacccgttgtctgttcgtcctaccggaaggggaaacnccgtaccccctaccccgttccgtaccgtcggaccgacgggacccctacgttacgaaggtaacgtttactaacccgacgtaacccgttaacgtttccgacccgttacggtaacccaagaccgtaaacggtaaccccggtcggaccgacccggtacccttaccccggacggtccctttacccttatttagttttaccggtccgggttacaccttaacccgtcccgaccggtaccggtccctaaggttaccgtaccctcccgaacggtccgttaacggtccgagggttccggaggtttcgggtacgggttcggtaaaacgggcttacgggttaacttcccgtaacgtacctaaccctaccctagtacgtacgtcccggtaagtcccgttcgtaacgtccgttaacgttacggtttaacgtttacgttttacgttaacgttttagtttaccttaggttactacctaaggttactaagtttaacgtacgttcgaaccgtttccggtaccctaccgttaccgttacccggttaacgggttcccgggaagggttacccggaaacggttacggggtaacgtacggttaaacgtaaccgggaaacctttgggaccgttccggtaaccgtccaaccgttaacccgttggtttaccctttcggttacccttccccggtttaccg

SEQ ID NO: 196288 - DNA, 772 bp, Homo sapiens
  misc_feature: GYAE6OF01BSXTQ.16.70.G04.1.454.CMB.1.raw
  modified_base (162)..(162): a, c, t, g, unknown or other
  misc_feature (162)..(162): n is a, c, g, or t
  modified_base (186)..(186): a, c, t, g, unknown or other
  misc_feature (186)..(186): n is a, c, g, or t
  modified_base (200)..(200): a, c, t, g, unknown or other
  misc_feature (200)..(200): n is a, c, g, or t
  modified_base (432)..(432): a, c, t, g, unknown or other
  misc_feature (432)..(432): n is a, c, g, or t
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacncagtctccagccaccctgtctgtntctccgaggggaangccaccctctcctgcagggccactcagagtacttaccagactaacttagcctggtaccagacacgaaaccgtggccagggtcctacccgaggtcctccgtactattttagcggttcgactacgtaccccgacgtacgggaccctacgtcggtactcccaggcctacggttcgaggttcggactagggtgggtaccgtgggacgtaggtacttccaacgttccaaccgtaccncgttacggaacgtccgacgtaccttcgacgtacgtacgttaggtaaacgttcttttacggaactttaacggttttaaccttacgttagtttacccgaaggttaactaaagtttacgttaacgtaccggtaacccgtttccgggtaccccgttacccggtacccgttacggtttaaccccgggtttaccggggacgggttaaaccgggggaacccgttaaagggggttacgggtaacgtaaaaccggttacccggtaaaaccgttaacgggttcgggtaccggtaccgtacccggtaacaacccgttagttacccgtacggtttcctttaccgtacccccg

SEQ ID NO: 196289 - DNA, 915 bp, Homo sapiens
  misc_feature: GYAE6OF01BDV6M.16.70.G04.1.454.CMB.1.raw
  modified_base (382)..(382): a, c, t, g, unknown or other
  misc_feature (382)..(382): n is a, c, g, or t
  modified_base (424)..(424): a, c, t, g, unknown or other
  misc_feature (424)..(424): n is a, c, g, or t
tcagtgtactactccacgaccggtgctcgatttagtgtagtgtgaagggaaaggggggaactgctcagttaggacccagacggaaccagtggaagccccagcgcagcttctcttcctcctgctactctggcctcccagactaccacgtggaagtaaattaggtgatgacgctagtcctccacgcccacccttgtcttgtcgttccgtaccggaaggggaaactcgccccgtacccttcgtccgtgaccgacgggacctacgtcgaaggtacgttaacttacccagtacctaacgtttacgaccgttacggtaccagacgaacgaaacccgttcggaccgtacggccctacccggacggttcccttcgttactagtttacggnggtacacctacgtcccgacggaccggaccctagtcgttaccncccgagtcccggttaggttcgtaacgggtccgggtgttacggggtcgggtttacgtaacgggggtaactaaccggttcggttttaccccaacggtaccgttaccccgaaaccttacgttaaccggtaacgcccgggttaaacttcccgttaccggacggtttaacggttaccgttaagggttaagttttaacgtttaccgttaaggttttaaccggttttaacttacgggttacgtttaacggttaaactaacgttaaaccgtttaagtttaacgaaccggtttcccgcccggtttacccggtacccctttaggttaccccggtttacgggggtttaccggaaccggggttaacgggtaaccggttaaacgggtaccgggtaacgtaaaacggttaaccggtaaaccggttagggtaaccgggttcgttaacgtaccggtttacccttaaccggtcgttttacctcggggtttaccctttcccgttacccg

SEQ ID NO: 196290 - DNA, 683 bp, Homo sapiens
  misc_feature: GYAE6OF01BB93K.16.70.G04.1.454.CMB.1.raw
  modified_base (205)..(205): a, c, t, g, unknown or other
  misc_feature (205)..(205): n is a, c, g, or t
tcagtgtactactccacgaccggtgctcgatttagtgtagtgtgaagggaaaggggggaactgctcagttaggacccagacggaaccatggaagccccagcgcagcttctcttcctcctgctactctggctcccagactaccactgggaagaaatagtgatgacgcagtctccagccaccctgtctgtgtctcgaggggaagacnccaccctctcctgcacgggccactcagagtattaccagaccaacttagccgtggtaccagcaacgaaacctggccaggcctcccaggcctccctactacgtttagtggtcgactactcccaccggtacgggccctacgttggtactccccgagaccgtaggttcacggtggaccgtagggtcgggtccgtaggggaactaggtacgtttaccaccgttctacccaaccgtatccgaaggcctaccggtcctcgccgtaacgtctaacgtaagttacgttttgacctttaagttttaaccttacgttagtacctaagtactaacttaattaactcgtacgtccgccttcccgtcttaccgttacggtttcgggaacgggtaccgggtaaccgtaggggtacgtagtaaccgtaacgaaacggttacgtgggtacgacgtacgactaccgttacgttagttccgttccttaccgtacccg

SEQ ID NO: 196291 - DNA, 990 bp, Homo sapiens
  misc_feature: GYAE6OF01CJS1L.16.70.G04.1.454.CMB.1.raw
  modified_base (202)..(202): a, c, t, g, unknown or other
  misc_feature (202)..(202): n is a, c, g, or t
  modified_base (738)..(738): a, c, t, g, unknown or other
  misc_feature (738)..(738): n is a, c, g, or t
  modified_base (751)..(751): a, c, t, g, unknown or other
  misc_feature (751)..(751): n is a, c, g, or t
tcagtgtactactccacgaccggtgctcgatttagtgtagtgtgaagggaaaggggggaactgctcagttaggacccagacggaaccatggaagccccagcgcagcttctcttcctcctgctactctggctccagactaccactggagaaatagtgatgacgcagtctccagcccacctgtctggtgtcctcgaaggggaanacgccacccgtctcctgccgacgggtccactccgaaggtacgtaacttaccgagacgtaaaccttacgccgttacgggtaccaaggtaccgaacggtaaaacccgttgggacccgtaacgggtcccttacccgtaagggtcccttacccgttaacttaagttttaggtcggggtacgtaccccgtacgtttaccccgaaccggtaaccgggggtaccccaacggtttacgggttaaacccgtccccggtaaacggggttacccccgttaaggggttttacccgaaggggttcccggggtaaccgttaacggggggtttacggggtttacccggaaggggggtaaacctaaccggggggtttaactttacccggtttaacccggtaccctttaaccgaaaccccggttaaacttaacccggaaccggtttaccggacccggtaccgtttacggaaccgttaacggtttccgttaacgggtaaacggttttaacttttacggttaaccgtttaaacgtttttacctttaaccgggttnttaaccggttaanaaccgtttaaattaacgttaaggtaccgtacggttcccggttacccgtccgtaccgttacgttaccgggtttaccgggaaccgggtacgggtaaaccggtagggtaccgggttaaacgaaacggttaaacccggtaaaacggtttccggtaacggggtttccggaaaccgttaccggtaacccggttacttaaaccggtttcccgttttaaccggttccgtttacccgtttaaccccgg

SEQ ID NO: 196292 - DNA, 792 bp, Homo sapiens
  misc_feature: GYAE6OF01C873I.16.70.G04.1.454.CMB.1.raw
  modified_base (387)..(387): a, c, t, g, unknown or other
  misc_feature (387)..(387): n is a, c, g, or t
tcagtgtactactccacgaccggtgctcgatttagtgtagtgtgaaggggaaaggggggaactgctcagttaggacccagacggaaccatggaacgccccagcgcagcttctcttcctcctgctactctggctcccagactaccactggaagaaatagtgatggacgcagtctccacgccaccctgtctgtcgtcctaccggaaggggaaacgaccgccctaccctccgtccgcggacgacgggcctacgtacaggtaacgttaactaaccgaacgtactaactttacggaccgttacggtaaccgacgaccgtaaacggaaccgtcgggacccgaacggtcccctaccggaccggtccttacccgttattacgtttggtcggtacncctaactcccggaacccggtacgggtacccttacggtacggtaccctccggacgtaccgtagggttaccagggtcggacggtgggttacgggtccgaaggggtacaggttaccgtactaccgttccaacccgaactgtaaccgacgtcgaacggtccgtactcgtaacgttacggtaacgtttaacggtttgttttaaccggtagtttaaactttcgttaactacgtagtaactagttaaactagttacgaaccgtcggttacccgtaccctttaccgaccgttcgttaccggacgggtacgggaacgggttaaccggtaggtaaggtaactaccgtaaaccggaacgttggacggtcgaccgtcggaacccttacttacgagtttccgttacgttcccttcccg

SEQ ID NO: 196293 - DNA, 719 bp, Homo sapiens
  misc_feature: GYAE6OF01C2K7I.16.70.G04.1.454.CMB.1.raw
  modified_base (386)..(386): a, c, t, g, unknown or other
  misc_feature (386)..(386): n is a, c, g, or t
  modified_base (406)..(406): a, c, t, g, unknown or other
  misc_feature (406)..(406): n is a, c, g, or t
  modified_base (424)..(424): a, c, t, g, unknown or other
  misc_feature (424)..(424): n is a, c, g, or t
  modified_base (456)..(456): a, c, t, g, unknown or other
  misc_feature (456)..(456): n is a, c, g, or t
tcagtgtactactccacgaccggtgctcgatttagtgtagtgtgaaggggaaaggggggaactgctcagttaggacccagacggaaccatggaagccccagcgcagcttctcttcctcctgctactctggctcccagataccactggaagaaatagtgatgaccgcagtcctccgacgcccacccttgtctgtgtcctacgaagggggaaagccgaccctaccctctcctcgcgacgggcccactacgaagaacgttaacttaacccgagacctaacgttacgcccttaggaaccaggaacaaacggtaaacccgtggaccgacggccctacccgagtccttctactagtttcgtgtcgacactccgacgtacgactacgacgtcnccagacctaggtcaggtcgngtaggtcggtcgtagganagttcgtacgtactctaccgactagtacacgnggaactccgtagtaccgtacggttacgtagtttaagttacttttaggaacgttttaagttttaacgttacttacggtaactaacgttaaactaaagtttaaacgttactaaccgggttacgtaacccgttcccgttaccgtacgttacccggttacgggttaccgggtacgggaacggtaaccgggtaggtacggaaacgtacgtaacgaacggttacgtggtacgtccgacgtactaccttatacgtcttcttcgttacccg

SEQ ID NO: 196294 - DNA, 837 bp, Homo sapiens
  misc_feature: GYAE6OF01CTESN.16.70.G04.1.454.CMB.1.raw
  modified_base (186)..(186): a, c, t, g, unknown or other
  misc_feature (186)..(186): n is a, c, g, or t
  modified_base (426)..(426): a, c, t, g, unknown or other
  misc_feature (426)..(426): n is a, c, g, or t
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggaagaatagtgatgacgcagtctcagccaccctgtctggtntcgtaccgaggggaaagcgcccaccctctcctgcgacgggcactacgagtactacttaccagactaacgttcgccgtaggtaccaggacaaacggtaaaccgtcggacccgtaacggtcccgtacccgaaccgggtccttacccgttacgttaattttacggtcggtacgtaccgtacctaccccgaccggtaaccggccctcgttaccgggtacctccccgacggtccgtacggtttcngggtacggtacggtagggttcgggtcggtaacgggtacaacgggtttaccgttaccgtaaccgtttccctaacccgaacccgtagtaacccgacggtaccgtaccgtcccgttacggtaccgtacgggtttaccgttaaaggttacggttttacgtttttacggtaaccgtttttaacgggtttttacttaccgggtttcgtaaacgtaacggtaacctttaaggtttaaactacggttaccgttacggtaccgttcccgttaccgttcttacccggttacgggttaccgggaacggtacgggtaccggtaacggttcggaacgtaccgaaacggtaaaccggtgttacgggtcgtaccgttcccggacgttacccttaacgttgtttacccgcccgttttacgtaccccg

SEQ ID NO: 196295 - DNA, 529 bp, Homo sapiens
  misc_feature: GYAE6OF01EL5D2.16.70.G04.1.454.CMB.1.raw
  modified_base (205)..(205): a, c, t, g, unknown or other
  misc_feature (205)..(205): n is a, c, g, or t
  modified_base (493)..(529): a, c, t, g, unknown or other
  misc_feature (493)..(529): n is a, c, g, or t
tcagtgtactactccacgaccggtgctcgatttagtgtagtgtgaaggggaaaggggggaactgctcagttaggacccagacggaaccatggaagccccagcgcagcttctcttcctcctgctactctggcctcccagataccactggaagaaatagtgatgacgcagtctccagccacctgtctgtgtctaccgaaggggaaancgcccaccctctccgtgcgacgggccactcaagtaagtacttaccagacctaaacttacgccgtaggtaaccaggaccaacggtaaaaccctggacccaacgggaccctccccgacggccttaccctactaagtttaagtcgggtcgtacctacttaccccgtaaccgacgggtaccctaacgtacgggtaacctcccgacgacccgtaaggttacacgggttcggaccgtaggttcggtcggtacggggacaacggtagttacccgtactaccgtacctaacctacnnnnnnnnnnnnnnnnnnnnnnnnnnnnnnnnnnnnn

SEQ ID NO: 196296 - DNA, 784 bp, Homo sapiens
  misc_feature: GYAE6OF01BUVK0.16.70.G04.1.454.CMB.1.raw
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggaagaaatagtgatgacgctagtctccacgcccaccctgtctgtgtcctaccgaaggggaagcgcccaccctctccgtcgcgacggccactacgaagtagttactaccgagacctaacttacgccgtaggaccgaagaccgaacgtaaccgtcggaccgtacggtcctacccgacgtccttaccttacgttacgtttacgtcggtacgtacctaccgtacccgaaccggaccggtacccgtcgttacggtaccctacccgacgtaccggtacggttacgaggtcggtcgtagggtcggtacggtagggaacgtacggttactaccgtacgtccgtaccacctactccgacgtccgacggtccgtcgacgttacggtaccgtaagttacgtttacgtttacggtaaccgttttaagtttaccgtttagttccgtaaacgtaacttaactaaagttaacgttaattacggtacgttacccgttacgttacccgtaccgttaccggttaccgggttaccggaccggggtaaccgggtaacggtacggaaccgtaaacggtaaccgtaaaccggtaacgttacggtcggtcggaccgttaccgaccgttacttaccgttacgttccgttaccgtaccgtcccg

SEQ ID NO: 196297 - DNA, 752 bp, Homo sapiens
  misc_feature: GYAE6OF01AZ3DT.16.70.G04.1.454.CMB.1.raw
tcagtgtactactccacgaccggtgctcgatttagtgtagtgtgaagggaaagggggaactgctcagttagacccagacggaaccatggaagccccagcgcagcttctcttcctcctgctactctggctcccagactaccactggagaaatagtgatgacgcagtctccagcccaccctgtcctgtcgtctccgaaggggaaagcgccctaccctctcctcgcgacgggccactcgagagtacttaccagactaacttagccgtgaccagcaacgaaccgtggccgacggcctaccgagcctccgtactagtttgtaggtcgactaccgtcccaccgacggcctacgtacggtacctacccgtacgcccgtacggttaccaggtcggacgtacgggtggtccggtaggacgaggttacgttaccgccttacgtacctaccgtactacgacgtacacgttccgagtaccgtagttacgtaacggttaagtttacgttttacgtacggtttaccgttttaaacgtccgttagtacgtaaacgaacccttaaagttaaccgttaagtcccgttaacggttccggacccccgtttacgacccgtttaccgttaaccgggtttacccggggagggttaacccgacgggtttaaggacggtaactaaccggtaaacccgttaaacgaccgggttggtacccggtcccttaacgacccgttaactacgggttctttccgggttaacccttcgtaccccg

SEQ ID NO: 196298 - DNA, 727 bp, Homo sapiens
  misc_feature: GYAE6OF01BJ3XN.16.70.G04.1.454.CMB.1.raw
  modified_base (171)..(171): a, c, t, g, unknown or other
  misc_feature (171)..(171): n is a, c, g, or t
  modified_base (690)..(690): a, c, t, g, unknown or other
  misc_feature (690)..(690): n is a, c, g, or t
tcagtgtactactccacgaccggtgctcgatttagtgtagtgtgaagggaaaggggggaactgctcagttaggacccagacggaaccatggaagccccagcgcagcttctcttcctcctgctacctctggcctcccagataccactggagaaatagtgatgacgcagtccnccagcccacctgtctgtcgtctacgaaggggaaacgcgcccaacccctctccgtggaccgacgggccactccgaaggtacttaacttaccgacgtacgtaaaccgtttcgcccgttaggaaccgacgacgtaaacgaaaccgtcgggacccgacggtccctacccggacggtccctaccttcgtaacgttttagcggtcgactacgtaccccgaccgacgggtaccctacgtacggtaccctacccgacggccgttacgggttacgacggtggacgtacggggttcggtacgggtagggaactcgggtacttaccaccttccgtaccctaactcgtaacacgacggcctaccgtcgacgtacggtccgtaaggtaattacggtttctaacgttaggtttactagtcgtatacgtaataactaatagtcgtacgtcgtccctccgtataccggtaccggtagggtaccggaacgggactagggtaacggataacgacggtaaaccgtagacggtaccggntaccaacgtacctagttcgttacgtcttccgtaaccg

SEQ ID NO: 196299 - DNA, 665 bp, Homo sapiens
  misc_feature: GYAE6OF02FMFZL.16.70.G04.1.454.CMB.1.raw
  modified_base (199)..(199): a, c, t, g, unknown or other
  misc_feature (199)..(199): n is a, c, g, or t
  modified_base (295)..(295): a, c, t, g, unknown or other
  misc_feature (295)..(295): n is a, c, g, or t
  modified_base (299)..(299): a, c, t, g, unknown or other
  misc_feature (299)..(299): n is a, c, g, or t
tcagtgtactactccacgaccggtgctcgatttagtgtagtgtgaagggaaagggggaactgctcagttaggacccagacggaaccatggaagccccagcgcagcttctcttcctcctgctactctggctcccagataccactggagaaatagtgatgacgcagtctccagccaccctgtctgtgtctccaggggaaanaggccacctctcctggccagggccactcagagtattaccagcgaacttagcctggtaccagcagaacctggccaggctcccaggctcctcatttanggtncatccacagggccactggtactcccgagtccaggttcaggttggcagtggtctggggacaggagtttccacgttccgtacaacccgtattccaggtccaaggtccctaggacagtccgtagaacgtagtttttgaccttagtttattacgttaggttctagtactaaagttattaaagtacgtaacgttcggtacccttaccgtacctttaccgtaaccgtttttccgggaccggtaacgggtaaccgtaacggggttagggtacgaagttaacccggtaaaaccggtaacgttacgggttaaccgggaccgtttacggaccgtaacccgttaacgttccgttacgtttaccgttaccgtaaccgg

SEQ ID NO: 196300 - DNA, 507 bp, Homo sapiens
  misc_feature: GYAE6OF02JCS54.16.70.G04.1.454.CMB.1.raw
  modified_base (199)..(199): a, c, t, g, unknown or other
  misc_feature (199)..(199): n is a, c, g, or t
  modified_base (292)..(292): a, c, t, g, unknown or other
  misc_feature (292)..(292): n is a, c, g, or t
  modified_base (296)..(296): a, c, t, g, unknown or other
  misc_feature (296)..(296): n is a, c, g, or t
  modified_base (354)..(354): a, c, t, g, unknown or other
  misc_feature (354)..(354): n is a, c, g, or t
  modified_base (504)..(504): a, c, t, g, unknown or other
  misc_feature (504)..(504): n is a, c, g, or t
tcagtgtactactccacgaccggtgctcgatttagtgtagtgtgaagggaaagggggaactgctcagttaggacccagacggaaccatggaagccccagcgcagcttctcttcctcctgctactctggctcccagataccactggagaaatagtgatgacgcagtctccagccaccctgtctgtgtctccaggggaaangccaccctctcctgcagggccactcagagtattaccagcaacttagcctggtaccagcagaaacctggccaggctcccaggctcctcatttanggtncatccaccagggccactggtactcccagccagggttcagtggcaggtggtctgggacngagttcactctcaccatcagcagcctgcagtctagaagtattttgcttagtttattactgttcagcaattataatgactggcctcgctctactttcggcggacggacgaggtggagagtacgaacgtactggtgctgcacatctcgtctntac

SEQ ID NO: 196301 - DNA, 507 bp, Homo sapiens
  misc_feature: GYAE6OF02HUST9.16.70.G04.1.454.CMB.1.raw
  modified_base (352)..(352): a, c, t, g, unknown or other
  misc_feature (352)..(352): n is a, c, g, or t
  modified_base (393)..(393): a, c, t, g, unknown or other
  misc_feature (393)..(393): n is a, c, g, or t
  modified_base (503)..(503): a, c, t, g, unknown or other
  misc_feature (503)..(503): n is a, c, g, or t
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccactcagagtattaccagcaacttagcctggtaccagcagaaacctggccaggctcccaggctcctcatttatggtgcatccaccagggccactgtactcccagccagttcagtggcagtggtctgggacngagttcactctcacctatcagcagcctgctagtctgaagtntttgctagtttattatgtcagcaatatatgactgcctcgctctacgtttcggcggaggaccaggtgagagtacgaaacgtacgtgtcgcgtgacacgtatcttcgtcttntacg

SEQ ID NO: 196302 - DNA, 546 bp, Homo sapiens
  misc_feature: GYAE6OF02H1KS6.16.70.G04.1.454.CMB.1.raw
  modified_base (200)..(200): a, c, t, g, unknown or other
  misc_feature (200)..(200): n is a, c, g, or t
  modified_base (294)..(294): a, c, t, g, unknown or other
  misc_feature (294)..(294): n is a, c, g, or t
  modified_base (298)..(298): a, c, t, g, unknown or other
  misc_feature (298)..(298): n is a, c, g, or t
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccactcagagtattaccagcaacttagcctggtaccagcagaaacctggccaggctcccaggctcctcatttanggtncatccaccagggccactggtatcccagccaggttcagtggcagtggtctgggacagagttcactctcaccatccagcagcctgcagtctgaagtattttgctagtttattacttgtctagctaatataatgactggacctccgcttctacgtttcggcggtacggaccgtaagggtggagtacgtaccgaaacggtaaccgtggtacggcttaggaccaaccgtacttccgtcgttccttacgtaacc

SEQ ID NO: 196303 - DNA, 505 bp, Homo sapiens
  misc_feature: GYAE6OF02IO4U9.16.70.G04.1.454.CMB.1.raw
  modified_base (199)..(199): a, c, t, g, unknown or other
  misc_feature (199)..(199): n is a, c, g, or t
  modified_base (502)..(502): a, c, t, g, unknown or other
  misc_feature (502)..(502): n is a, c, g, or t
tcagtgtactactccacgaccggtgctcgatttagtgtagtgtgaagggaaagggggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccactcagagtattaccagcaacttagcctggtaccagcagaaacctggccaggctcccaggctcctcatttatggtgcatccaccagggccactggtactcccagccaggttcagtgcagtggtctggggacagagttcactctcaccatcagcagcctgcagtctgaagtatttgctagtttattactgtcagacaatataatgactggcctcgctctacgttcggcggaggaccgaaggtggagagtacgaaacgaacgtggtgctgacacatctgtctntac

SEQ ID NO: 196304 - DNA, 564 bp, Homo sapiens
  misc_feature: GYAE6OF02GPPYB.16.70.G04.1.454.CMB.1.raw
  modified_base (298)..(298): a, c, t, g, unknown or other
  misc_feature (298)..(298): n is a, c, g, or t
  modified_base (373)..(373): a, c, t, g, unknown or other
  misc_feature (373)..(373): n is a, c, g, or t
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccactcagagtattaccagcaacttagcctggtaccagcaagaacctggccaggctcccaggctcctcatttatggtncatccaccagggcccactggtactcccagccaggttcagtggcaggtggtctggggacaggagttcactctcacntcagcagcctgcagtctagaagtatttgcttagtttattacttgtcagtactaatataatcgtacgtcggcctccgtcttcctacgtttccgggacgggtaacgggaaccgtaagggtggacgtacgtaccgaaaacggtacgttgggtacggtaccgttgacctaccgtattccgtgttccttactaccg

SEQ ID NO: 196305 - DNA, 516 bp, Homo sapiens
  misc_feature: GYAE6OF02JD7Q9.16.70.G04.1.454.CMB.1.raw
  modified_base (293)..(293): a, c, t, g, unknown or other
  misc_feature (293)..(293): n is a, c, g, or t
  modified_base (395)..(395): a, c, t, g, unknown or other
  misc_feature (395)..(395): n is a, c, g, or t
tcagtgtactactccacgaccggtgctcgatttagtgtagtgtgaagggaaagggggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccactcagagtattaccagcaacttagcctggtaccagcagaaacctggccaggctcccaggctcctcatttanggtgcatcccaccagggcccacgtggtactcccagccaggttcagtggcaggtggtctgggacagagttcactctcacatcagcagcctgcagtctagagtntttgctagtttattactgtcagtcaatataatgtactgcctccgctctacgttcggacggaggaccgaggtgagagtacgaaacgtactggtcgcgtgaccactatctacgtccttctacg

SEQ ID NO: 196306 - DNA, 511 bp, Homo sapiens
  misc_feature: GYAE6OF02JQNSG.16.70.G04.1.454.CMB.1.raw
  modified_base (294)..(294): a, c, t, g, unknown or other
  misc_feature (294)..(294): n is a, c, g, or t
  modified_base (298)..(298): a, c, t, g, unknown or other
  misc_feature (298)..(298): n is a, c, g, or t
  modified_base (417)..(417): a, c, t, g, unknown or other
  misc_feature (417)..(417): n is a, c, g, or t
tcagtgtactactccacgaccggtgctcgatttagtgtagtgtgaagggaaagggggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccactcagagtattaccagcaacttagcctggtaccagcagaaacctggccaggctcccaggactcctcatttanggtncatccaccgagggccactggtactcccagccaggttcagtggcagtggtctgggacagtagttcactctcaccatcagcagcctgcagtctagaagtatttgctagtttatactgtcanactaatatatgactggcctccgctctacgtttcggcggtaggaccgaggtgagagtacgaaacgtactgtacgctgacacagtctcgtctctac

SEQ ID NO: 196307 - DNA, 557 bp, Homo sapiens
  misc_feature: GYAE6OF02F7BB1.16.70.G04.1.454.CMB.1.raw
  modified_base (299)..(299): a, c, t, g, unknown or other
  misc_feature (299)..(299): n is a, c, g, or t
  modified_base (398)..(398): a, c, t, g, unknown or other
  misc_feature (398)..(398): n is a, c, g, or t
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccactcagagtattaccagcaacttagcctggtaccagcagaaacctggccaggctcccaggcctcctcatttatggtncatccaccgagggcccacgtggtactccccagccctaggttcaggtggaagtggggtctggggacaggagttcactctacaccatcagcacgcctgacngtctgaagtatttttcagttttacttacttgtacagtcaaattataatgactggtccctccgcttctaccgtttcgggacggtagggaccaagggttgaagtactacgaaaccgtagtggtagcgtagcaccgtatctacgttctctacttccgtcccg

SEQ ID NO: 196308 - DNA, 565 bp, Homo sapiens
  misc_feature: GYAE6OF02ICZIL.16.70.G04.1.454.CMB.1.raw
  modified_base (402)..(402): a, c, t, g, unknown or other
  misc_feature (402)..(402): n is a, c, g, or t
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtctccagccaccctgtctgtgtctccaggggaagagcccaccctctcctgcagggccactcagagtattaccagcaacttagcctggtaccagcagaaacctggccaggctcccaggctcctcattttatggtgcatcccaccgagggccacgtggtactcccagccaggttcagtggcaggtgggtctggggacagacgttcactctcaccatcagcagcctgcagtctagaagtntttgcttagttttattacttgtacagactaattataatgtactcggtcctcccgcttctaccgtttcgggcgggacggaccgaagggtcggacgtagtaaccgaaacggtacttgggtaggtcctaggaccaaccgtagttccgttagttccttactaacccg

SEQ ID NO: 196309 - DNA, 511 bp, Homo sapiens
  misc_feature: GYAE6OF02IO8QM.16.70.G04.1.454.CMB.1.raw
  modified_base (287)..(287): a, c, t, g, unknown or other
  misc_feature (287)..(287): n is a, c, g, or t
  modified_base (508)..(508): a, c, t, g, unknown or other
  misc_feature (508)..(508): n is a, c, g, or t
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccactcagagtattaccagcaacttagcctggtaccagcagaaacctggccaggctccaggctcctnattatgtgcatccaccagggccactggtactcccagccaggttcagtggcaggtggtctgggacagagttcactctcaccatcagcagcctgcagtctagagtattttgctagtttattactgtacagactaatataatgactggcctccgctctacgttcggcggacggaacgaggtggagatacgaaagtaacgtggtgcgtgacactatcgtcgtctntac

SEQ ID NO: 196310 - DNA, 533 bp, Homo sapiens
  misc_feature: GYAE6OF02G7T36.16.70.G04.1.454.CMB.1.raw
  modified_base (204)..(204): a, c, t, g, unknown or other
  misc_feature (204)..(204): n is a, c, g, or t
  modified_base (296)..(296): a, c, t, g, unknown or other
  misc_feature (296)..(296): n is a, c, g, or t
  modified_base (300)..(300): a, c, t, g, unknown or other
  misc_feature (300)..(300): n is a, c, g, or t
  modified_base (374)..(374): a, c, t, g, unknown or other
  misc_feature (374)..(374): n is a, c, g, or t
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagttctccagcccaccctgtctgtgtctccgaggggaaagngcccacccgtctcctgcagggccactcagagtacttaccagcaacttgcctggtaccagcagaacctggccaggctccaggctcctcattanggtncatccacgagggccacgtggactcccagcctaggttcagtggcaggtggtctgggacagagttcactctcaacntcagcagcctgcagtctagaagtatttgactagtttattactgtacagacaatataatgtactcggtcctcgctctacgtttcggcggtaggaccgtaaggtggagagtacgaaacgtacgtggtcggctgacctactattcgtacgttcttactaccg

SEQ ID NO: 196311 - DNA, 516 bp, Homo sapiens
  misc_feature: GYAE6OF02F00HB.16.70.G04.1.454.CMB.1.raw
  modified_base (199)..(199): a, c, t, g, unknown or other
  misc_feature (199)..(199): n is a, c, g, or t
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtctccagccaccctgtctgtgtctccaggggaanagccaccctctcctgcagggccactcagagtattaccagcaacttagcctggtaccagcagaaacctggccaggctcccaggcctcctcatttatggtgcatccaccagggccactggtatcccagccaggttcagtgcagtggtctgggacagagttcactctcaccatcagcagcctgcagtctagaagtattttgctagtttatactgtcagtcaatatatgactggcctccgctctacgtttcggacggacggaccagggtgagagtacgaaacgtacgtgtggtctgcaccgtacttcgtgttcttgtaccg

SEQ ID NO: 196312 - DNA, 544 bp, Homo sapiens
  misc_feature: GYAE6OF02G3JBA.16.70.G04.1.454.CMB.1.raw
  modified_base (200)..(200): a, c, t, g, unknown or other
  misc_feature (200)..(200): n is a, c, g, or t
  modified_base (494)..(494): a, c, t, g, unknown or other
  misc_feature (494)..(494): n is a, c, g, or t
  modified_base (541)..(541): a, c, t, g, unknown or other
  misc_feature (541)..(541): n is a, c, g, or t
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccactcagagtattaccagcaacttagcctggtaccagcaagaaacctggccaggcctccccaggcctcctctattttagtggtgcactcccaaccgagggcccacgtggtactcccgagcccaggttcagtggcaggtgggtctggggacaggtagttcactctcaaccatccagcacgcctgcagtctagaagttatttgacttagtttatactgtacagactaatataatgactcggcctccgctctacgtttcggcggtacggacgaggnggagatacgaacgtacgtggacggtcgtagacaccgtatctgttctntac

SEQ ID NO: 196313 - DNA, 522 bp, Homo sapiens
  misc_feature: GYAE6OF02FS6UY.16.70.G04.1.454.CMB.1.raw
  modified_base (200)..(200): a, c, t, g, unknown or other
  misc_feature (200)..(200): n is a, c, g, or t
  modified_base (287)..(287): a, c, t, g, unknown or other
  misc_feature (287)..(287): n is a, c, g, or t
  modified_base (357)..(357): a, c, t, g, unknown or other
  misc_feature (357)..(357): n is a, c, g, or t
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccactcagagtattaccagcaacttagcctggtaccagcagaaacctggccaggctccaggctcctnatttatggtgcatccaccagggccactggtactcccagccaggttcaggtgcaggtggtctggggacagngttcactctcaccatcagcagccctgcagtctgaagtatttgctagtttattactgtcagctaatataatgactcggcctccgctctacgtttcggcggtacgggacgaaggtggagagtacgaaacgaacgtaggtggacgtgcaccagtctcgttcttctacg

SEQ ID NO: 196314 - DNA, 553 bp, Homo sapiens
  misc_feature: GYAE6OF02FZQK2.16.70.G04.1.454.CMB.1.raw
  modified_base (200)..(200): a, c, t, g, unknown or other
  misc_feature (200)..(200): n is a, c, g, or t
  modified_base (291)..(291): a, c, t, g, unknown or other
  misc_feature (291)..(291): n is a, c, g, or t
  modified_base (297)..(297): a, c, t, g, unknown or other
  misc_feature (297)..(297): n is a, c, g, or t
  modified_base (410)..(410): a, c, t, g, unknown or other
  misc_feature (410)..(410): n is a, c, g, or t
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccactcagagtattaccagcaacttagcctggtaccagcccagaaacctggccaggctcccaggcctcctnatttanggtgcatcccaccgagggcccacgtggtactcccagcctaggttcaggtggcaggtgggtctggggacaggtagttcactctacaccatcagccagcctgctagtctgaagtntttgacttagtttactacttgtctagactaattataatgactcggcctccgctcgtacgtttcggcggacggacgagggtgagtacgtacgaaacggtacgtggtacggtcgtacgaccgtactactctcgttaccttgtacc

SEQ ID NO: 196315 - DNA, 556 bp, Homo sapiens
  misc_feature: GYAE6OF02HKRBS.16.70.G04.1.454.CMB.1.raw
  modified_base (295)..(295): a, c, t, g, unknown or other
  misc_feature (295)..(295): n is a, c, g, or t
  modified_base (321)..(321): a, c, t, g, unknown or other
  misc_feature (321)..(321): n is a, c, g, or t
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtctccagccaccctgtctgtgtctccaggggaaagagcccaccctctcctgccagggccactcagagtattaccagcaacttagcctggtaccagcagaaacctggccaggctccaggcctctcatttanggtgcatccaccagggccatggtacncccagccaggttcagtggcaggtggtctggggacaggtagttcactctcaccatcagcagcctgctgtctagaatatttgactagtttattactgttcagactaattataatgactcggccctccgtctactacgtttccggacgggacggaccgtaagggtggtacgaagtaccgtaaaacggacgttggtacggtccgtagaccaccgtagttccgtcggttccttcctaccg

SEQ ID NO: 196316 - DNA, 511 bp, Homo sapiens
  misc_feature: GYAE6OF02F2BOT.16.70.G04.1.454.CMB.1.raw
  modified_base (296)..(296): a, c, t, g, unknown or other
  misc_feature (296)..(296): n is a, c, g, or t
  modified_base (385)..(385): a, c, t, g, unknown or other
  misc_feature (385)..(385): n is a, c, g, or t
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtctccagccaccctgtctgtgtctccaggggaaagagcccaccctctcctgcagggccactcagagtattaccagcaacttagcctggtaccagcagaaacctggccaggctcccaggcctcctcatttanggtgcatcccaccagggccactggtactcccagccaggttcagtggcagtggtctgggacagagttcactctcacatcagcagcctgcngtctgaagtatttgactagtttattactgtcagtcaatatatgactggcctcgctctacgttcggcggaggacgagggtgagacgtacgaaacggtacgtggtcggctgcaccatctgttctctac

SEQ ID NO: 196317 - DNA, 518 bp, Homo sapiens
  misc_feature: GYAE6OF02IG1V1.16.70.G04.1.454.CMB.1.raw
  modified_base (200)..(200): a, c, t, g, unknown or other
  misc_feature (200)..(200): n is a, c, g, or t
  modified_base (356)..(356): a, c, t, g, unknown or other
  misc_feature (356)..(356): n is a, c, g, or t
  modified_base (392)..(392): a, c, t, g, unknown or other
  misc_feature (392)..(392): n is a, c, g, or t
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtctccagccaccctgtctgtgtctccaggggaaanagccaccctctcctgcagggccactcagagtattaccagcaacttagcctggtaccagcagaaacctggccaggctccaggctcctcatttatggtgcatccaccgagggccactggtactcccagccaggttcagtggcagtggtctgggacagngttcactctcacatcagcagcctgcagtctgaagtnttttgctagtttattactgtcagataatataatgactggacctccgtctctacgttcggacggacggaccgtaggtggagactacgaaacggtactggtcgtactgacacctatctcgttctctac

SEQ ID NO: 196318 - DNA, 523 bp, Homo sapiens
  misc_feature: GYAE6OF02GS03V.16.70.G04.1.454.CMB.1.raw
  modified_base (298)..(298): a, c, t, g, unknown or other
  misc_feature (298)..(298): n is a, c, g, or t
  modified_base (519)..(519): a, c, t, g, unknown or other
  misc_feature (519)..(519): n is a, c, g, or t
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccactcagagtattaccagcaacttagcctggtaccagcagaaacctggccaggctcccaggctcctcatttatggtncatccaccgagggcccactggtactcccagcccaggttcagtggcaggtggtctggggacagagttcactctcaccatcagcagcctgcagtctagaagtatttgctagtttatactgtcagctaatataatgactcggacctccgtctctacgttcgggcggacggaccaagggtggagtactacgaaacgacgttggtggctagcaccatctgtccttntacg

SEQ ID NO: 196319 - DNA, 628 bp, Homo sapiens
  misc_feature: GYAE6OF02GDIYV.16.70.G04.1.454.CMB.1.raw
  modified_base (432)..(432): a, c, t, g, unknown or other
  misc_feature (432)..(432): n is a, c, g, or t
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtctccagccaccctgtctgtgtctccgaggggaaagagccaccctctcctgcagggccactcagagtattaccagcaacttagcctggtaccagcagaaacctggccaggctcccaggcctcctctatttatggtgcactccgaccgacgggcccacgtggtaactcccgagcccgtaggttccaaggtcggactaggtcgggtctggggaaccaggtacgtttcacttcctacacctatccagcacgcctgctagtctagtaagtntttgacttagtttactacgtgttacagtactaaataataagttacgaccgttcggacccttcccgcttacccgttacggtttccggggacgggtaacgggtaccggtaagggtaggtagtaacgtaacggaaaaccggtaacgtgggttacggacgttacgacctaaccgtagttccgtacgtttacttactaccg

SEQ ID NO: 196320 - DNA, 588 bp, Homo sapiens
  misc_feature: GYAE6OF02GZ625.16.70.G04.1.454.CMB.1.raw
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccactcagagtattaccagcaacttagcctggtaccagcagaaacctggccaggctcccaggcctcctctatttatggtgcactcccaccgacgggcccacgtggtactcccgagcccaggttcaggtggcaggtgggtcgtggggacaggtagtttcacgttctaccaccatcagcagccctgctagtctagaagttatttgacttagttttatacgtgttcagtacaattataatgactcggcctccgtctcgtacgtttcgggcgggaacggaccgtagggtggacgtacgtaaccgaaacggtacgttgggtacggtcgttacggacctaccgtacgttccgttcggttacctttaccgtaccg

SEQ ID NO: 196321 - DNA, 741 bp, Homo sapiens
  misc_feature: GYAE6OF02GJRP2.16.70.G04.1.454.CMB.1.raw
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccactcagagtattaccagcaacttagcctggtacacgacagaaacctacggtcgacgacgtccctacgcgtccctctattattagtggcatcctaccacggaccgacctggtacgtcccacgaccgacggttacgtacgtggtcgacgttgggtcgtgggtacgagtagggttctacgtacttaccgacccgtaactacgtacgaccgaacgtcccgtacgccgtaacggttcgttacgtaaagggtaaacttttttggtaccgtaagttttttaaacgtttaacctttacggttacgtacggaacgttaaacttaaagttaaacgtttaaacggtacgttaccgggttcccgttacccgttaccgttccttaacccgttttaccggggggtcccggaaaccggggtaaaccgaaacggggttccggggaataacggttaacccaaacggtaaaacgttggttaccgggtactaccgacggtacccaacggttcttcggttacccgtactttaaccccgg

SEQ ID NO: 196322 - DNA, 551 bp, Homo sapiens
  misc_feature: GYAE6OF02JAABW.16.70.G04.1.454.CMB.1.raw
  modified_base (201)..(201): a, c, t, g, unknown or other
  misc_feature (201)..(201): n is a, c, g, or t
  modified_base (287)..(287): a, c, t, g, unknown or other
  misc_feature (287)..(287): n is a, c, g, or t
  modified_base (293)..(293): a, c, t, g, unknown or other
  misc_feature (293)..(293): n is a, c, g, or t
  modified_base (297)..(297): a, c, t, g, unknown or other
  misc_feature (297)..(297): n is a, c, g, or t
  modified_base (408)..(408): a, c, t, g, unknown or other
  misc_feature (408)..(408): n is a, c, g, or t
  modified_base (537)..(537): a, c, t, g, unknown or other
  misc_feature (537)..(537): n is a, c, g, or t
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtctccagccaccctgtctgtgtctccaggggaaagngccaccctctcctgcagggccactcagagtattaccagcaacttagcctggtaccagcagaaacctggccaggctcccagctcctnatttanggtncatcccaccgagggccacgtggtactcccagcctaggttcagtggcaggtcgggtctggggacaggtgttacacttctaccactactcagcagcctgcagtctaggaagtntttgacttagtttatactgttacagtactaattataatcgtacgtggccctcgtctcgttacgtttcgggacgggtacggacgtagggtaggagtactacgaaacgtacgtggtcgacgtgaccacgtntcgtcgttctctac

SEQ ID NO: 196323 - DNA, 464 bp, Homo sapiens
  misc_feature: GYAE6OF02IIOFT.16.70.G04.1.454.CMB.1.raw
  modified_base (246)..(246): a, c, t, g, unknown or other
  misc_feature (246)..(246): n is a, c, g, or t
  modified_base (354)..(354): a, c, t, g, unknown or other
  misc_feature (354)..(354): n is a, c, g, or t
  modified_base (430)..(464): a, c, t, g, unknown or other
  misc_feature (430)..(464): n is a, c, g, or t
tcagtgtactactccacgaccggtgctcgatttagtgtagtgtgaagggaaaggggcgtggagtggagtcgggaatatctattatagtgggagcacctactacaacccgtccctcaacgagtcgagtcgccatatccgtagacacgtccaagaaccacttctccctgaaactgagctctgtgaccgccgcagacacggctgtctattactgtgcgagacagagttacgacggtggttactccggtntcttgacacgtgggcagggaccctggtcaccgtctcctcagcctccaccaagggcccactcgtcttccccctggcaccctcctccaagacgcacctcgtggggcaacngcgccctgggctgcctgcaaggctactccgagtagtacgactgagcggggactggcaaagggccgactagagctgnnnnnnnnnnnnnnnnnnnnnnnnnnnnnnnnnnn

SEQ ID NO: 196324 - DNA, 892 bp, Homo sapiens
  misc_feature: GYAE6OF02ITR7O.16.70.G04.1.454.CMB.1.raw
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtctccagccaccctgtctgtgtctcaggggaaagagccaccctctcctgcagggccactcagagtattaccagcaacttagcctaggtaccagcaagaaacctggaccaggcctccccgaggcctcctctattttagtgggtacgctactccaaccgacggggacccacgtgggtaacctaccccgacgacccgtaagggttccgaggttgggacgtacgggttcggggtacgttacggggaactagggtaaccgttttcaaaccgttcctaccctaaccctacgttaccgaacggtacccctaacgggtacccgttccgggaccggttaacggtttacccgttaagggtaaacgggtttttaagttttttacggacggtttaaacggtttttttacgttttaacccgtttaggttacccgtaaacggttaccctttaaaattaaacgtttaaacggttacggttaacccgttccgggttaccccgtttaccccggtacccgtttaccgttaaccccgggtttttaccggggaaccgggggtaaaccggggtaaaccccggtaaagggggttaacggggttaaacgtaaccggttaaacccggtaaaaaaccggggttaacccggtttagggggttaacccgggtaccgtaacccggggttacccaaccccggtttaaccgtttaccggttttaaccggtttacccgtttaccccggtttaaccccg

SEQ ID NO: 196325 - DNA, 520 bp, Homo sapiens
  misc_feature: GYAE6OF02GLY9O.16.70.G04.1.454.CMB.1.raw
  modified_base (201)..(201): a, c, t, g, unknown or other
  misc_feature (201)..(201): n is a, c, g, or t
  modified_base (286)..(286): a, c, t, g, unknown or other
  misc_feature (286)..(286): n is a, c, g, or t
  modified_base (292)..(292): a, c, t, g, unknown or other
  misc_feature (292)..(292): n is a, c, g, or t
  modified_base (516)..(516): a, c, t, g, unknown or other
  misc_feature (516)..(516): n is a, c, g, or t
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtctccagccaccctgtctgtgtctccaggggaaagngccaccctctcctgcagggccactcagagtattaccagcaacttagcctggtaccagcagaacctggccaggctccaggctcctnatttanggtgcatcccacagggccacgtggtactcccagccaggttcaggtggcaggtggtctgggacagagtttcactctcaccatcagcagcctgcagtctagaagtatttgacttagtttattactgttcagtctaatatatgactcgcctcgctctacgttcgcggacggaccgagggtgagatacgaaacgtacgtgtcgtacgtgacctactactcgtgttctntacc

SEQ ID NO: 196326 - DNA, 792 bp, Homo sapiens
  misc_feature: GYAE6OF02GOSW2.16.70.G04.1.454.CMB.1.raw
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtcctccacgccaccctgtctgtgtctaccgaggggaaagcgcccaccctctcctgcgacgggccactcagaacgttacttaccgagacctaacttacgccgtcggtaccagacaacgtaaaccgtcggaccacggcctacccgacggtcccttccctacgttaagttttacgtaggtcgtacctaccgtaccccgaaccggaccgggaccctaccggtacggtacctaccccgacgtaccggttaggtccggtaaggtcgggacgtaggggttcgggtaccggtagggaacgttaggtaacgtttccaacctcctaaccaaccgtacacggaccgcgtaccgtccgtagaccgtagttacgtaacggttaaagtttcgtttacggaacgtttagttttaacctacggttcgttaacaacggttaaacttaagttaaacttaggttaccgtaccgttccggtccctaccgttaccttacggttacccgggttacggggaacggtaccgggtaaaggtacgggtaacggtaaccgtaacggaaccggtaaacggtacggttacgggtaccggtacgtaccggaaccttacgttaccggttctttaccggttacttaccccgttacccgg

SEQ ID NO: 196327 - DNA, 582 bp, Homo sapiens
  misc_feature: GYAE6OF02IY7CL.16.70.G04.1.454.CMB.1.raw
  modified_base (201)..(201): a, c, t, g, unknown or other
  misc_feature (201)..(201): n is a, c, g, or t
  modified_base (284)..(284): a, c, t, g, unknown or other
  misc_feature (284)..(284): n is a, c, g, or t
  modified_base (294)..(294): a, c, t, g, unknown or other
  misc_feature (294)..(294): n is a, c, g, or t
  modified_base (376)..(376): a, c, t, g, unknown or other
  misc_feature (376)..(376): n is a, c, g, or t
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtctccagccaccctgtctgtgtctccaggggaaagngccaccctctcctgcagggccactcagagtattaccagcaacttgcctggtaccagcagaacctggccaggctccaggctccntattatggtncatccacgagggccactggtactcccgagccaggttcagtgctaggtcggtcagggacagtacgtttcacgttctacaaccntacgacgtcacgtcctgaccgtagtccgttaggaagttatttcgacttagtttattacctgttacaagtacaataatagtagtacgtaggcccttcgctcgtaccgttcggacggacggtaaccgaggtcggacgtacgtaaccgaaacgtaccgtggtacggtcgtacgtaccaccgtattccggttacgttaccgtcctaaccg

SEQ ID NO: 196328 - DNA, 590 bp, Homo sapiens
  misc_feature: GYAE6OF02HP4KB.16.70.G04.1.454.CMB.1.raw
  modified_base (200)..(200): a, c, t, g, unknown or other
  misc_feature (200)..(200): n is a, c, g, or t
  modified_base (292)..(292): a, c, t, g, unknown or other
  misc_feature (292)..(292): n is a, c, g, or t
  modified_base (295)..(295): a, c, t, g, unknown or other
  misc_feature (295)..(295): n is a, c, g, or t
  modified_base (346)..(346): a, c, t, g, unknown or other
  misc_feature (346)..(346): n is a, c, g, or t
  modified_base (395)..(395): a, c, t, g, unknown or other
  misc_feature (395)..(395): n is a, c, g, or t
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtctccagccaccctgtctgtgtctccaggggaaanagcccaccctctcctgcagggccactcagagtattaccagcaacttagcctggtaccagcagaacctggccaggctccagctcctcatttangtncatccacgaggccatggtactcccagcccaggttcaggtggcaggtggtcngggacagtagttcactctacacatcaagtcagcctgcagtctagaagtntttgacttagtttacttactgttacagtactaataataatgtacgtcggtaccctacgtcctacgtaccgtttccggaccggggtaacggaaccgaagggtaggacgtaacgttaaccggaaaacggtaaccgttacgggtacggtcgtacgtacccgtaccgtacgttccgtacgttaccgttacgttaacccg

SEQ ID NO: 196329 - DNA, 528 bp, Homo sapiens
  misc_feature: GYAE6OF02GKKX8.16.70.G04.1.454.CMB.1.raw
  modified_base (200)..(200): a, c, t, g, unknown or other
  misc_feature (200)..(200): n is a, c, g, or t
  modified_base (209)..(209): a, c, t, g, unknown or other
  misc_feature (209)..(209): n is a, c, g, or t
  modified_base (283)..(283): a, c, t, g, unknown or other
  misc_feature (283)..(283): n is a, c, g, or t
  modified_base (292)..(292): a, c, t, g, unknown or other
  misc_feature (292)..(292): n is a, c, g, or t
tcagtgtactactccacgaccggtgctcgatttagtgtagtgtgaagggaaaggggggaactgctcagttaggacccagacggaaccatggaagccccagcggcagcttctcttcctcctgctactctggctcccagataccactggagaaatagtgatgacgcagtctccagccaccctgtctgtgtctccaggggaangccaccctntcctgcagggccactcagagtattaccagtcaacttgcctggtaccagcagaactgccaggctccaggctcctnattatggtncatccaccagggccaactggtactcccagcctaggtcagtgcagtggctgggacagagttcactctcgacatcagcagcctgcagtctgaagtatttgactagtttattactgttcagtactaatataatgactgacctccgcttctacgtttccggcggacggaaccgaaggtggagtactacgaaacgtaacgttggcggtacgttcgaccactacgtctcgttacttctaccg

SEQ ID NO: 196330 - DNA, 599 bp, Homo sapiens
  misc_feature: GYAE6OF02G1TYD.16.70.G04.1.454.CMB.1.raw
  modified_base (201)..(201): a, c, t, g, unknown or other
  misc_feature (201)..(201): n is a, c, g, or t
  modified_base (299)..(299): a, c, t, g, unknown or other
  misc_feature (299)..(299): n is a, c, g, or t
  modified_base (324)..(324): a, c, t, g, unknown or other
  misc_feature (324)..(324): n is a, c, g, or t
  modified_base (392)..(392): a, c, t, g, unknown or other
  misc_feature (392)..(392): n is a, c, g, or t
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtctccagcccaccctgtctgtgtctccaggggaaanagccaccctctcctgcagggccactcagagtataccagcaacttagcctggtaccagcagaaacctggccaggcctccaggctcctctatttatggtncactccaccgagggccactggtacncccagccagttcagtggcaggtggtctgggacaggtacgttcactctcaaccatcagtccagcctgcngtctgtaatatttgcttagtttactacgtgtcagtactaaattattaaatcgtaactcggtacccttcccgtcttaccgtacggtttaccgggacgggaacgggtaacccgaaggggttacggacgtaacgtaaccgtaaaacggtaaccgttgggtacggtacgtaccggaccgtaccgtacgttccgttagttccttacctaccg

SEQ ID NO: 196331 - DNA, 700 bp, Homo sapiens
  misc_feature: GYAE6OF02IC2NH.16.70.G04.1.454.CMB.1.raw
  modified_base (200)..(200): a, c, t, g, unknown or other
  misc_feature (200)..(200): n is a, c, g, or t
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtctccagccaccctgtctgtgtctccgaggggaanagccaccctctcctgcagggccactcagagtacttaccagcaacttagcctggtaccagcaacgaaacctggaccaggcctcccgaggcctcctctatttatggtcgctactccaccgagggccacgtcggtactccccgagccctaggtttcaggtcggctagggttgggtcgtgggaccaggtactacgactctccacactcgagcacgtcctagctaggttctaggtaacgttacgttttgaacgtttagtttttacttacgttcggtacctagtaactaaacttaaagttaagtacggtaaccgtttccggaccccttacccggtactttaaccggttcccggttttacggggacccggggttaaacgggtaacccgtaaggggttacggaagttaaccggtaacccgaaaacgggttaccggttgggtaccggttacgtcccggtaacctacccggttaagttcccgttttaacggttcccttaaccttaccccg

SEQ ID NO: 196332 - DNA, 883 bp, Homo sapiens
  misc_feature: GYAE6OF02GJWA0.16.70.G04.1.454.CMB.1.raw
  modified_base (138)..(138): a, c, t, g, unknown or other
  misc_feature (138)..(138): n is a, c, g, or t
  modified_base (200)..(200): a, c, t, g, unknown or other
  misc_feature (200)..(200): n is a, c, g, or t
tcagtgtactactccacgaccggtgctcgatttagtgtagtgtgaagggaaaggggggaactggctcagttaggacccagacggaaccatggaagccccagcgcagcttctcttcctcctgctactctggctcccagntaccactggagaatagtgatgacgcagtctccagcccaccctgtctgtgtctccaggggaangccacctctctagcagggccactcagagtattaccagcaacttagcctggtaccagtcaacgtaaccgtggaccacggtcctacccgacggtccttacccctataagtttttacgtcgggtacgttcaacgttcccccgaaccggtaccggggacccctaacggtttaccggggttaaccctccccccgagggtaaccccgttagggttttacccgaaggggttccggaaccggtaggggtttcgggtaccggttacggggaaccgtagggtaccgttttaccgacccgtttaccgttaccccaaaccctacgttccgtaaccggaacctaccgtacccggttcggaacgttcggtttaccgttaacgggtaaagtttacggtttttacgaccgtttaaggtttttactttaccggtacggttacacggttaacttaaagttaaactttaacgggtacggtaaccgttccggtacccttacccggttcttaaccggtttacccgggttttaccggggaaccggggtaaacgggttaaaccgttaacgggggtccggtaaagggtaacccttaacgggaaaaaccgggtttaccggtttacgggaaccgggtttaccgtaacggtaccccttaaacgttccggttacccgttttaccgtttaccgttaccggtttaacccccgg

SEQ ID NO: 196333 - DNA, 741 bp, Homo sapiens
  misc_feature: GYAE6OF02JWD0F.16.70.G04.1.454.CMB.1.raw
tcagtgtactactccacgaccggtgctcgatttagtgtagtgtgaagggaaagggggaacgtgctcagttaggacccagacggaaccatggaagccccagccgcagcttctcttcctcctgctactctggctcccagataccactggagaaatagtgatgacgcagtctccagccaccctgtctgtgtctccaaggggaaagcgcccaccctctcctgcacgggccactcagacgtaattacccgagacctaacgttacgcccgtaggtaacccagacctacgaaaacccgtcgggacccaacgggcctacccgacggtccttcccgtactacgttttagtcggttcgcaacgtcccctaaccgaggaccctacgtcggtacttacccgacgcccgtacgggttcaacggttggccgtaaggtcgggtctacgggggactacggtacgtcgtacgttcgacctaacccgtaacttccgaacgtccgtaacgtccgtacgaccgtacgttacgtacgtaacgttacgttttacgacggtttaacgtttagttaccttgtaccgtataacgttaataattacggtacgacgttaccggtccttccgtaccgttacgttacggtttccggacgggtaacggaaccgtagggtacgtacgtaacggtaccgaaacggttaaccgtggtaaccggtacgttacgacccggttaacaccgtttacgtccgtttacctcgttacccgg

SEQ ID NO: 196334 - DNA, 852 bp, Homo sapiens
  misc_feature: GYAE6OF02HV57J.16.70.G04.1.454.CMB.1.raw
  modified_base (201)..(201): a, c, t, g, unknown or other
  misc_feature (201)..(201): n is a, c, g, or t
tcagtgtactactccacgaccggtgctcgatttagtgtagtgtgaagggaaagggggaacgtgctcagttaggacccagtacggaaccatggaagcccagcggcagcttcgtcttcctcctgctactctggctcccagataccactggagaaatagtgatgacgcagtctccagccacctgtctgtgtctcgaggggaaancgccacctctcctgcagggccactcagagtattaccagcaacttagcctggtaccagacagtaaacctggacctagggccttaccccgaggtccttacccgtactaacgttttagtcgggtacgaccgtaacgttccccgaaccggacggggtccctacgtttacgggtaaccttcccccgaaggtaccccgttaaggggtttccaaacgggtttcgggacccgtaagggggtttcggggttaccgttacggggggtaaacctaagggttaaccggttttacccgaaaccgttttcccgtaaccgtaaaccccttaaagtttcccggaaacggtaccctaaccgggtcccgtttacggaccgttaacggtttaccgttaacgggtaaacggtttacgtttttacggaccgtttaacgggtttttaaccttaaccggtttacgttaaccgtaagtaaccctttaaataacgttaaacgtacggtaccgttacggtaccctaccggtcctttaccgtacggttttaccgggacgggtaacggtaaccgtacgggtaggtaacgtacgtaaccggaaacggttaaccggttggtaacggtaccgtgtacccaaccggttagtttacccgttaggtttacccttacgttaacccg

SEQ ID NO: 196335 - DNA, 802 bp, Homo sapiens
  misc_feature: GYAE6OF02IVKS0.16.70.G04.1.454.CMB.1.raw
  modified_base (553)..(553): a, c, t, g, unknown or other
  misc_feature (553)..(553): n is a, c, g, or t
tcagtgtactactccacgaccggtgctcgatttagtgtagtgtgaaggggaaaggggggaactgctcagttaggacccagacggaaccatggaagcccagcgcagcttctcttcctcctgctactctggctcccagactaccactggaagaaatagtgatgacgcagtctccacgccaccctgtctgtcgtcctaccgaaggggaaacgcgaccctaccctcctccgtcggaccgacgggacccactcgaagtaacgttaacttaccgaagtacctaacgttacgcccgttaggaaccagacgtaacgtaaaccgtcggaccgacgggtcctacccgtaacggccttaccgttaccgttacgtttagtcggtacgtaccctacgtacccgaaccggaccggtacctaacgttcgtacctcccgtacgaccgttaggttcgacgggttcggacgtagggttcggtacgtacggggacgtaacggtactttcgaactcgtaccaacgtaactcgagtacgacgtcgtacgactaggtaacgtagtaaacggtttntttacgaacgtttaacgttttacttaacgtcggtaaacgtaagttacttaaacgtaacgttaaccgtaacggtcctacgggtacccttccgtaacgttccggtttaaccggttcccggggaacgggttaaggtaaacccggtaggggttaaccggaactaacggttaacggaaaacccgtagggtttcgtaaccggtaccgtacgaaccgttaccgtacgttaccgtttcggttaccttaccgttaccg

SEQ ID NO: 196336 - DNA, 671 bp, Homo sapiens
  misc_feature: GYAE6OF02H82DR.16.70.G04.1.454.CMB.1.raw
  modified_base (201)..(201): a, c, t, g, unknown or other
  misc_feature (201)..(201): n is a, c, g, or t
  modified_base (305)..(305): a, c, t, g, unknown or other
  misc_feature (305)..(305): n is a, c, g, or t
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtctccagccaccctgtctgtgtctccaggggaaagngcccaccctctcctgcagggccactcagagtattaccagcaacttgcctggtaccagcagaaacctggcaggctccaggcctctcatttatgtgcatccaccgnggccagtgactcccagccgaggttcaggtggcaggtcggtcgtacgggacagtacgtttcacgtctccgacactccgagctaacgccgtagcgtacgttcgtaaggtacgtttaacgttttgacgttaagttttaactttacgttcgttacgtacgtactaaagttaataaactaggtacgttccggttaccccgttcccgtacgttacccgttaacgggttttaccggggaccggggtaaacgggtaaccccggttaaaggggtcggtaacggtaaccggtaaaccgtaaaccggttaacgttgggtaacggtacgtaccgaccgtaccgtaccgttcgttaccgttttaccgttcttaaccccg

SEQ ID NO: 196337 - DNA, 704 bp, Homo sapiens
  misc_feature: GYAE6OF02IK5O3.16.70.G04.1.454.CMB.1.raw
  modified_base (202)..(202): a, c, t, g, unknown or other
  misc_feature (202)..(202): n is a, c, g, or t
  modified_base (317)..(317): a, c, t, g, unknown or other
  misc_feature (317)..(317): n is a, c, g, or t
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtctccagccaccctgtctgtgtctccgaggggaaagngcccaccctctcctgcgagggccactcagagtacttaccagacctaacttagcctaggtaccagacacgaaacctggaccaggcctcccgaggtcctacctactacgttttacgngggttcgctaactcccgaaccggacggggaccctaacgttcgggtacctccccgaacggtacccgttagggtttaccagggttcgggacgtaggggttcgggtacgttaggggaactaggtacgtttaccacttccgtacaaacctgtaccgacgtacgcgtaccgtagacgtacgttcgtaagtaagttacgttttacgacgtttagttttactacgttacgtacgacgtataaatttataagtcgtacgtacgtccttaccgacttcgtacggttacgggaacgggtaacggaccgtagggtacgtacgaacgtacggtaaacggtacgttggtaccggtactacggtacctaacgttacgttccgttacttccgtacttacccg

SEQ ID NO: 196338 - DNA, 816 bp, Homo sapiens
  misc_feature: GYAE6OF02F2AP1.16.70.G04.1.454.CMB.1.raw
  modified_base (307)..(307): a, c, t, g, unknown or other
  misc_feature (307)..(307): n is a, c, g, or t
  modified_base (311)..(311): a, c, t, g, unknown or other
  misc_feature (311)..(311): n is a, c, g, or t
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtctccagccaccctgtctgtgtctccgaaggggaaagacgcccaccctctcctgcgagggccactcagagtacttaccagcaacttagcctggtaccagcaagaaccgtggccaggcctcccgaggcctcctactatttagnggtnactactcccaccgacgggccacgtcggtactcccgagccgtaggttcaggtcggcgtaggtcgggtcgaggggactaagggtattaccacttcctaccaacctaacgtcgaacgtccgaacgtcccttcggaccgtacggttaccggtaaggttaaacggtttagtttttacggtaccgtttaaaggtttttaactttaccgtttacggttaacgtaacgttaacgtaaaacgtttaagttaaacttaaccgggtaacccggttccgggtacccccggttacccggttaccgttttaccggtttacccgggttttccgggggaacccgggggttaaaccgggggtaacccggttaaaggggggtaccgggtaaacggttaccgttaaacccgggtaaaacgggtttaacccgttagggggttacccgggtacccggttaaccggtacccgtaaacccgttaagtttacccggtttaccgtttacccgtttaccggttaacccccg

SEQ ID NO: 196339 - DNA, 861 bp, Homo sapiens
  misc_feature: GYAE6OF02GTDUQ.16.70.G04.1.454.CMB.1.raw
  modified_base (201)..(201): a, c, t, g, unknown or other
  misc_feature (201)..(201): n is a, c, g, or t
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtctccagccaccctgtctgtgtctccgaaggggaanacgccaccctctcctgcagggccactcagagtacttaccagcctaacttacgcctggtaccagccaagaaacctggccaggcctcccgaggccttcctctatttagtggtagcactcccgaccgaggggccctacgtcggttacctccccgagtacccgtacgggtttcaagggttcggaccgtaggggttcggggttaccgtagggggaacctacgggtaacgttttccccgaaaccttccgttacccgaacccgtaacgttccgaaccgggtaccctaaccgggtcccctttacgggacccgtaaggtttcccgttaagggtaaacgtttacgttttttacggaccgtttaagtttttaacctttaaccgttacggttaccgtaacggttaacctaaagtttaaagtttaagttaccgggttaaccgttaccggggttccccttacccgggtacctttaccggtttaaccgggttttcccgggaacggggttaaacccggggtaaaccggtaaagggggttacgggtaaccggtaaccgttaaaccgggtaaaaccgggttaaaccggtttggggttaaccggtacccgttaacggacccgttaacccgtttaacgtttacccggtttacggttttacccctttaccgttaaccccgg

SEQ ID NO: 196340 - DNA, 667 bp, Homo sapiens
  misc_feature: GYAE6OF02I52AA.16.70.G04.1.454.CMB.1.raw
  modified_base (201)..(201): a, c, t, g, unknown or other
  misc_feature (201)..(201): n is a, c, g, or t
  modified_base (302)..(302): a, c, t, g, unknown or other
  misc_feature (302)..(302): n is a, c, g, or t
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtctccagccaccctgtctgtgtctccgaggggaaancgccaccctctcctgcagggccactcagagtattaccagcaacttagcctggtaccagcaagaacctggccaggcctccccgaggcctcctctatttacgnggtgcctatcccgaccgtcgggcccaacgtggtacctcccaggtcccagggtttaccaggttcggccgtaggtcgggtcgtacggggacaggtacgtttccaccgttcctaccgaccctagtaccgtacgccacggtcccttcgacgtacgttccgtaaggtaagttacgttttgacgtttaagttttacttaccgttcgtactaggtaacttaagttaactaagttcggaacgttccggtacctccgtcctaccgttacgttccggggacggtacggtaccgtagggttacgagtactaacggtaacgtacgttcggtacgtccgtacgaccgtactacgttcttacggttaccttcggtaccc

SEQ ID NO: 196341 - DNA, 767 bp, Homo sapiens
  misc_feature: GYAE6OF02HJH3A.16.70.G04.1.454.CMB.1.raw
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtctccagcccaccctgtctgtgtctccgaggggaaagacgcccaccctctcctgcgagggccactcagagtactaccagacaacttagccgtaggtaccagcaacgaaaccgtcggaccgacggcctcccgacggtcctccgtactatttagtggtgcacgtcccaccgacgggccctacgtggtacctcccgacgaccgtaggtttcgacggtcgggcgtagggtcggtcggacggggtacaggtagttccgacgttcctaccgaacctactacgacgaccgtacgtcccgtagaccgttaggttaccttaaggtaaacgtttcgtttttacggactttaagtttttaacgtttacgttcggttaaccgtaaagttaacctttaaattaacgtttaacggtacggttaaccgttccgggtaccccttaccggttcccttacggtttacccgggtttccggggaaacggggtaccggtaaccgggtaaggggttacggaacggttaacgtaacccggtaaacggtacggttagggttaccggacgttccgacccgttaacgttaccgtttccgttacgttttcccgttaccgtttaaccccg

SEQ ID NO: 196342 - DNA, 786 bp, Homo sapiens
  misc_feature: GYAE6OF02JG03J.16.70.G04.1.454.CMB.1.raw
  modified_base (149)..(149): a, c, t, g, unknown or other
  misc_feature (149)..(149): n is a, c, g, or t
  modified_base (168)..(168): a, c, t, g, unknown or other
  misc_feature (168)..(168): n is a, c, g, or t
  modified_base (544)..(544): a, c, t, g, unknown or other
  misc_feature (544)..(544): n is a, c, g, or t
  modified_base (609)..(609): a, c, t, g, unknown or other
  misc_feature (609)..(609): n is a, c, g, or t
tcagtgtactactccacgaccggtgctcgattttagtgtagtgtgaagggaaaggggggaactggctcagttaggacccagacggaaccagtggaagcccagcgcagcttctcttcctctgctactctggctcccagataccactgganaaatgtgatgacgcagtcnccagccacctggtctggtctcgtaccgaagggggaaagacgccaacccttctcctggactacgggccatccaggacttacttaacccaagtaccgtaaacttacggccgttagggtaaccaaggaccaaacggtaaaacccgttggggacctacgggaccttaccccggaacggtcctaacccggttactaaagttttaacggcggttaccggacctaaaccgtcccgtaacccggaacggggaccctaacggtttacggtaacgtacccccaaggtacccgtagggtttaacacgggtacgaccggtaggggttaccgggtagttacggggtaaccaagggttacggtttcaaaccggtcgttaccaacttaacncgaacgcaacgtcccgtgacgtagttccgtaagtacgttagtttgacttaacggtttattaccgngtaacccagtactaaagttctaacgtccgtaggtcccttcgtaacccgtccttaaggttaccggttaccgggaccgggtaacggtaaccgtaagggttcggaactattaaaccggaacggtaaacggtttggccgttaacaggtaaccacgtagtttaccgacgttctaccgtaccg

SEQ ID NO: 196343 - DNA, 791 bp, Homo sapiens
  misc_feature: GYAE6OF02HRUPA.16.70.G04.1.454.CMB.1.raw
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtctccagccaccctgtctgtgcctccgaggggaaagacggccaccctctcctgccagggccactcagagtataccagcaacttagcctggtaccagcaagaaacctggaccaggcctcccaggcctcctctatttagtggtcgtcaacgtccaaccggacgggaccctacgtcgggtaacctccccaaggtccctaagggtttaccgagggttcgggcgtaacggttggggttaccgtggggaaccgtaaggtacgtttaccctaacgtttcccgtacccaaccctacgttaccacggtaccgaaccgtcccgtacggtaccgtaacggttaccggtaggtaaacgttagtttttacgtaacgtttaacgttttttaacttacgttcggttaaccgtaacgtaacgttaaatttaaacgtaagtagttaccggtaccgtccccgttacccgtaccgttaccgtttaccggttttcccggggaaccggggtaacggaaacccgggttaagggtacgggtaacgttaacggtaacccgtaaaaccgggttaccggtacggttaccgggtacctacgggtaaccctaccgttaaccgttccgttaccgtttaccggttacccttacccg

SEQ ID NO: 196344 - DNA, 763 bp, Homo sapiens
  misc_feature: GYAE6OF02JNLS7.16.70.G04.1.454.CMB.1.raw
  modified_base (201)..(201): a, c, t, g, unknown or other
  misc_feature (201)..(201): n is a, c, g, or t
  modified_base (452)..(452): a, c, t, g, unknown or other
  misc_feature (452)..(452): n is a, c, g, or t
  modified_base (514)..(514): a, c, t, g, unknown or other
  misc_feature (514)..(514): n is a, c, g, or t
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtctccagccaccctgtctgtgtctaccgaggggaanacgccaccctctcctgcgacgggccactcgagagtacttaccagactaactagcctaggtaccagcgaacgaaccgtcggaccaacggcctacccgacggtcctccctacgtaattttacgtggttcgccgtaacttaccccaccggaaccggggccctaacgttcgggtaaccttccccgaacgtcccggtaaggttccgtaaggtcggccgtaggtcgggtctacgggggaacacggttacgtttaccnccgttcctaccgaacctacgtccgaacgtcacgtccctagccgtacgttacgtagtaacgtnttttcggacttaacggttttagttacgttacggtaacgtacgtaacgtaatttaaagtacgttaggtaccggttaccggtcccgttacccgtcgtttaccgttaccgggttacccgggtacggggtaccggtaaccggttaaggtacggaccggttaacgtaaccggtaaacccggttaactggggtccggtaccgttacggaaccttacccggtatttccgtttaaccggttcctttacggtaccccg

SEQ ID NO: 196345 - DNA, 713 bp, Homo sapiens
  misc_feature: GYAE6OF02F216G.16.70.G04.1.454.CMB.1.raw
  modified_base (343)..(343): a, c, t, g, unknown or other
  misc_feature (343)..(343): n is a, c, g, or t
tcagtgtactactccacgaccggtgctcgatttagtgtagtgtgaagggaaaggggggaactgctcagttaggacccagacggaaccatggaagccccagcgcagcttctcttcctcctgctactctggctcccagactaccactggaagaaatagtgatgacgcagtctccagcctaccctgtctgtcgtctaccgaaggggaatacgccctaccctctcctgacgagggccactcagagttactaccagacctaacttacgaccgtacggtaaccagccaaacggaaacctcggaccgacggtacctaccccgaaggtccctaccctagttaattttacgngggtacctcgtacctacccgacggtaccgggaccctcgtaggtaacctcccgagtacccgtaggttccaggttcggcagggttcggtgtacgggacgtaagtcgttccacgttcactaccgtataccgagaccgagtcccgtacgactagtcgtagtacgttatttacgtacttaagtttataacgttgtacgtacgtagttaattacgtaagttcgaacgttcccggtaacctacccgtacttaccggttaccgttacggggtaaccgtacgggaaccgtaaggggtacgtacgtacgtaaaccggtaacgaccggttggtaacgtacgtaccggactccgtaattccgttacgttacctacgttaccc

SEQ ID NO: 196346 - DNA, 880 bp, Homo sapiens
  misc_feature: GYAE6OF02IK57M.16.70.G04.1.454.CMB.1.raw
  modified_base (210)..(210): a, c, t, g, unknown or other
  misc_feature (210)..(210): n is a, c, g, or t
tcagtgtactactccacgaccggtgctcgatttagtgtagtgtgaagggaaaggggggaactgctcagttaggacccagacggaaccatggaagccccagcgcagcttctcttcctcctgctactctggcctcccagataccactggagaaatagtgatggacgcagtcctaccagcccaccctgtctgtcgtcctccgaaggggaaacncgccctacccctcttcctgaccgacgggccaactccgaagtacgttactaaccagtacctaacgttacgcccttggtaacccagaccaaacgtaaacccgtcgggacccaacgggtccctaccccgacggtaccccttccttacttaagttttacggcggttcacctacctccccgaaccggtacgggacctacgtacggtacctcccgaggtaccccgttaggttaccgacggttcggtacgtacggggttcgggtaccgtacggggactaacggtacgtttaccctacttccgtacctaaccgtacttacggaccgtacgtaccgtaccgtacgtaccgtaacggtacgttaagggtaacgtttacgtttttacggaactttacggttttaaacttcggttacgtaaccgtaagtaaaccttaaagttaacgttaacgtaccggttaacccgtcccgggtccttacccggttacttacccgggtttacccgggttacgggaacccggggttaaacggtaaacccgggttaaggtacgggtaaacccgttaggttaaaaccccgtaaacgggtttacccggttaggggtaaccggttcccgtaaaccggtacccgttaaccgtttaccgttaccggtttacccgtttccccgttaaccgttaacccccg

SEQ ID NO: 196347 - DNA, 567 bp, Homo sapiens
  misc_feature: GYAE6OF02FIYSA.16.70.G04.1.454.CMB.1.raw
  modified_base (200)..(200): a, c, t, g, unknown or other
  misc_feature (200)..(200): n is a, c, g, or t
  modified_base (273)..(273): a, c, t, g, unknown or other
  misc_feature (273)..(273): n is a, c, g, or t
  modified_base (282)..(282): a, c, t, g, unknown or other
  misc_feature (282)..(282): n is a, c, g, or t
  modified_base (286)..(286): a, c, t, g, unknown or other
  misc_feature (286)..(286): n is a, c, g, or t
  modified_base (289)..(289): a, c, t, g, unknown or other
  misc_feature (289)..(289): n is a, c, g, or t
  modified_base (291)..(291): a, c, t, g, unknown or other
  misc_feature (291)..(291): n is a, c, g, or t
  modified_base (345)..(345): a, c, t, g, unknown or other
  misc_feature (345)..(345): n is a, c, g, or t
  modified_base (357)..(357): a, c, t, g, unknown or other
  misc_feature (357)..(357): n is a, c, g, or t
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtctccagccaccctgtctgtgtctccgaggggaanagcccaccctctcctgcagggccactcagagtacttaccagcaacttagcctggtacagcagaacctgcagcnccagctctnattntgncntccacgacggccactacggtctcccagtccagttccgagtggctaggtggtcgngggacagtgtcnctctcgtaccatcgagtccacgtccgtgactacgtcgtagtaagttatttgtaccttaagtttactcgttagctaagtagtaaatatagtagtccgtacgtccgtcgtcttacgttaccgttcggaccggaggacctaagggtggacgaactacggaaacgtaagtcggtacgtcgagacctacgtgttacgtccttacttacgtacccg

SEQ ID NO: 196348 - DNA, 672 bp, Homo sapiens
  misc_feature: GYAE6OF02HQXB7.16.70.G04.1.454.CMB.1.raw
  modified_base (489)..(489): a, c, t, g, unknown or other
  misc_feature (489)..(489): n is a, c, g, or t
  modified_base (506)..(506): a, c, t, g, unknown or other
  misc_feature (506)..(506): n is a, c, g, or t
  modified_base (542)..(542): a, c, t, g, unknown or other
  misc_feature (542)..(542): n is a, c, g, or t
  modified_base (558)..(558): a, c, t, g, unknown or other
  misc_feature (558)..(558): n is a, c, g, or t
  modified_base (587)..(587): a, c, t, g, unknown or other
  misc_feature (587)..(587): n is a, c, g, or t
  modified_base (600)..(600): a, c, t, g, unknown or other
  misc_feature (600)..(600): n is a, c, g, or t
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgagtgacgcagtctccgagccaccctgtctgtcgtcctaccgaaggggaaacgacgaccctacccgttctacctggaccgacgggccaccgtacagacgttactaccgagtaccaacgttacgccgttaggtaccgagaccgtaacgaaccgtcggaccgaacggtcctacccgaccggtaccttccctactagttttacgtcggttagcctaccgtacctaccggtaccggaccctcggtaaggtaccctccgacgccgtacggtacaggttcgacgtggtcggtacgtggaacgtggtacgttacacgtccgtaccacgtactacgacgacncgtccgaggactcggtntaacgtaagttcgtttagacttatttaatcgtgtanactaactaatactaancgtacgtcgactccgctacgtcgtacggngagaccgttaggnggactacgaacgtaacgtgtcggtaccgtcgcgttaaccgatacccgtttagccgttttacgtcttacccgg

SEQ ID NO: 196349 - DNA, 682 bp, Homo sapiens
  misc_feature: GYAE6OF02F94MS.16.70.G04.1.454.CMB.1.raw
  modified_base (200)..(200): a, c, t, g, unknown or other
  misc_feature (200)..(200): n is a, c, g, or t
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtctccagccaccctgtctgtgtctccaggggaaancgccaccctctcctgcagggccactcagagtattaccagcaacttagcctggtaccagcaagaacctggaccaggcctcccgaggcctcctctatttatggtcgcactcccaccgacgggcccacgtggtactccccgagcccgtaggttccaggtcggacctaggtcgggtcgttggggacaggtacggtttcaacttctacaacctatccagccaacgcctgactagtcctagaagttagttttcgacttaagttttacttacgtcgttccgaagtacctaaagttaacttaagtacgtaaccgttcgggacccttccggtacctttaccgttacccggtttaccggggaaccgggtaacggggtaacccgtaaggggtacgggtaacgtacgttaaccggaaaaccggttaacggttacgggtacggacccgttaggaccctaaccggtacgttcgttacccggttctacgttaccccg

SEQ ID NO: 196350 - DNA, 856 bp, Homo sapiens
  misc_feature: GYAE6OF02IO4X3.16.70.G04.1.454.CMB.1.raw
tcagtgtactactccacgaccggtgctcgatttagtgtagtgtgaagggaaaggggggaactgctcagttaggacccagacggaaccatggaagccccagcgcagcttctcttcctcctgctactctggctcccagataccactggagaaatagtgatgacgcagtctccagccacctgtctgtgtcctccgagggaagacgcccaccctctcctgcgacggccactcagtagtacttacccagtacaaccgttagccgtacggtaccagcaacggaaaccgtcgaccggaacggccctccccgaaggtcccttcccgttactacgttttaagtcgggtactaccgtaaccttaccccgacccggtaccgggacccgtaacgttaccgggttaaccctacccgaaaccggttcccggttaaagggttccctaagggtttcggggaccgtaagggggtttccggggttacggttacggggtaaacgtaacgggttaccgttttaccgtaacccttaccggttaacccgaacccttacgtaaccggtaccgacgtaacccgtccggtacgccgtaacgttcggttaacgtaaacgtttaacgtttttgggtaacctttaagttttaaacccgttttcgttaacggtaccggtaacgtaaaccttaaagttaacgttaaaacgggtctacccgggttaaccggtcccctttacccggttaccgttaacccggtttaccgggtttaaccgggaccggggtaacggtaaacccgtagggggacgtaacgtacgtaaccgtaaacggtacgtacggtagtaccgacggtactacctagttcctaacggttcctattaacccg

SEQ ID NO: 196351 - DNA, 748 bp, Homo sapiens
  misc_feature: GYAE6OF02HD0BZ.16.70.G04.1.454.CMB.1.raw
  modified_base (146)..(146): a, c, t, g, unknown or other
  misc_feature (146)..(146): n is a, c, g, or t
  modified_base (204)..(204): a, c, t, g, unknown or other
  misc_feature (204)..(204): n is a, c, g, or t
  modified_base (540)..(540): a, c, t, g, unknown or other
  misc_feature (540)..(540): n is a, c, g, or t
tcagtgtactactccacgaccggtgctcgatttagtgtagtgtgaagggaaagggggaactgctcagttaggacccagacggaaccatggaagccccagcgcagcttctcttcctcctgctactctggctccagataccactgganaaatagtcgatgacgtcagtcctccagccctacctgtctgtcgtctaccgagggaaancgcccacctctctcgcgaggccactcgagtacgtacttaccagacctaacttacgccgttaggaaccgagacgaaccgtaaaccggttcggacccgtaacggtccctacccggtacggtcctaccccttagtaacttttaaggtcggttcaacgtacttaccccgaacggtaccgggaaccctacgtcggttaccaccgacggtcgtacgttcgaacggtcgcgtagggtcggtcgacgggtagacgtacggttctaacgtcctaaccacgtacgtacgtagaccgacgttccgtacgcggtaacgtccgttaagtatttacggtttgaaccgttntttaacgttacgtcggtaatacgtaacgaagttaactaagtacgtacgtacgtcccgtactaaccgttcgttaaccggttaccgggcgggtaaaccggtaccggtaaggggtcgtaacggtaactaacccggtaacggtacgtcgggttacgtaaccgtcgaaccgtaaccgttaccgtttcgttaccgttaccgttaccgttacccg

SEQ ID NO: 196352 - DNA, 762 bp, Homo sapiens
  misc_feature: GYAE6OF02HNXAO.16.70.G04.1.454.CMB.1.raw
  modified_base (147)..(147): a, c, t, g, unknown or other
  misc_feature (147)..(147): n is a, c, g, or t
  modified_base (200)..(200): a, c, t, g, unknown or other
  misc_feature (200)..(200): n is a, c, g, or t
  modified_base (340)..(340): a, c, t, g, unknown or other
  misc_feature (340)..(340): n is a, c, g, or t
tcagtgtactactccacgaccggtgctcgatttagtgtagtgtgaagggaaagggggaactgctcagttaggacccagacggaaccatggaagccccagcgcagcttctcttcctcctgctactctggctcccagataccactgganaaatagtgatgacgcagtctccagccaccctgtctgtgtctccgaggggaaancgccaccctctcctgcagggccatcagacgtacttaccagctaacttacgccgttaggtaccaggacaacggaaacccgttgggacccctaagggcccttaccccgaggtcccttaccgtactaagttttagcgggtacncctaccgtacccgtaaccggacgggccctaagttcggtacctcccgaacggtcctaggtttccaaggttcggactagggtcggtacgtggggacctaggttacgttccaacgttctacaacctataccgagaccgtacgcccgttgaccgtacgtacttacgtaagtttacgtttcggactttagttttaacgttacgtagttacgaagttacttaaacttaagtaacgtccggttaccgtaccggttcccgttaccgtaccgttaccgttccgggtttaaccgggaccgggtaacggtaaccggtttaggtacggtaacgttaaccgtaaccggtaaacggttccgtacgggttaacggtacccgttaccgtaccggtaactttaccggttacctttacgttcccgttaccgtttaccccg

SEQ ID NO: 196353 - DNA, 953 bp, Homo sapiens
  misc_feature: GYAE6OF02IZHGC.16.70.G04.1.454.CMB.1.raw
tcagtgtactactccacgaccggtgctcgattttagtgtagtgtgaagggaaaggggggaactggctcagttaggacccagacggaaccatggaagccccagcgcagccttctcttcctcctgctactctggcctcccagactaccactggaagaaatagtgatgacgcagtcctaccacgccctaccctgttctgtcgtccgtaccgaagggggaaacgacgaccctacccctcctcccgtcggaccgacgggcccactacgaagtagtaacttaccagtaccaacttacgccgtacggtaccgacgaccgaacggaaacccgtcggacccgacggtaccctaccccgacggtcccttccccgttactagttttacgtcggttcgacctaaccgtaccccgaaccgggaccgggtaccctaccggttacgggttaacccctaccccggaaccggtcccggtaacgggtttacccgtagggggttacgggaccggttaaccgggggtttaccggggttaccgggttaaggggaacccgttaggggttaacccgttttacctaaccctttacccgtaaccgtaaacccgttacgtaaccgaacccggtaccgaaccggttcccgtcggtaaccgtacggtttaccgttaagggttaacgttttacgtttttacggtaacgttttaacggttttaacctttacggtttaaccgtaccgtaacgttaaaccttaaacgtttaacgttaacgtaccggttacccggttacccgttaccccgttaccggttccgtttaaacccggttaccgggttacccggggtaacgggaacccgggtaaaccggttaacggggttaagggacgtaacgttaaacccggtaacggttaaacggttcgggacggttacctaccggtacctaaccgttaccgtcgttttaaccgttccttacctcccgg

SEQ ID NO: 196354 - DNA, 936 bp, Homo sapiens
  misc_feature: GYAE6OF02GHS87.16.70.G04.1.454.CMB.1.raw
  modified_base (148)..(148): a, c, t, g, unknown or other
  misc_feature (148)..(148): n is a, c, g, or t
  modified_base (350)..(350): a, c, t, g, unknown or other
  misc_feature (350)..(350): n is a, c, g, or t
  modified_base (355)..(355): a, c, t, g, unknown or other
  misc_feature (355)..(355): n is a, c, g, or t
  modified_base (389)..(389): a, c, t, g, unknown or other
  misc_feature (389)..(389): n is a, c, g, or t
tcagtgtactactccacgaccggtgctcgatttagtgtagtgtgaagggaaaggggggaactgctcagttaggacccagacggaaccatggaagccccagcgcagcttctcttcctctgctactctggctcccagactaccactgganaaatagtgatgacgcagtcctaccagcccaccctgtctgtcgtcgtaccgaaggggaagccgaccctacccctctccgtacgccgacggccactcgaagtaacttaccttaaccgactactaacgttaccgccgtacggaaccacgaccgaaacgtaaccgccgaccacggtcctaccgacgtcctccgtacttagttacgnggtcnctacctaccgacgtacggcctacggtacgtaccnccacgtaccgtaggtacgacggtcggacgtagggtcggtcggtacggaacgtacgttacggttaccacttccgaaccgtccaacgtaccgacgtaccgtcccgtacgttactacccggtaggtaaccgttaaggttaaaggtttaccgtttacggttaaccgttttaaacgggttttaaacttttaccccggtaaggtttaaacccctaaggttaaaacgtttaaactttaaaacgggttttaaacccgttaacggggttaccccggttttaaccccgggtaccccggttttaccccgttttacccgtttaaacccggggtttcccggggtttaaaacccgggggggaccggtttaaaaccgggggttaaaacccgggggtaagggtacccgggtttaaaacccgaaacggggtttaaaaaccccgttaaccggggttaacgggtttaccgggtacccgggtttaaacgccccggttaaccccgtaacccgggtttttaacgttcccgtttttaaaccccggtacccgttttccgttaaccccccgg

SEQ ID NO: 196355 - DNA, 841 bp, Homo sapiens
  misc_feature: GYAE6OF02FPO36.16.70.G04.1.454.CMB.1.raw
tcagtgtactactccacgaccggtgctcgatttagtgtagtgtgaaggggaaaggggggaactgctcagttaggacccagacggaaccatggaagccccagcgcagcttctcttcctcctgctactctggctcccagactaccactggagaaatagtgatgacgcagtctccagcccacctgtctgtcgtctaccgaggggaagacgcccaccctctcctgcgacggccactcgagagtattaccagacctaacttacgccgtacggtaaccacgacaacgaaaccgtcggaccgacggtcctaccccgacggcccttaccttacgtaattttacggtcggtcgacctaacgtaccccgaccggaccggggacccttacggttacggttaacctcccggacggtacccggttaacgggttccgaaggggtcggacgttagggggttcgggtacgggtacgggtaacgtacggttacgtttaccctaccgtacctacccgaaacctacgtaccgtaacggacccgtaccggtccgtacgtaccgtcgttaccgtaaggtaaacggttttacgttttacgtaactttaacggtttttacgttacggttcttaaccggtaacgtattaaaccggttaaattaaccggtagttccggtaccggttaccccgttacccgtaccgtttaccggttaaccggggttcggggtaaccgggaaacccgggttaacgggtaaggggttaacccggagttaaccgtaaccggtaaacgtcgggttacggtaccggtacgtcccggtaacctaccggttacgttcggtttaccgttaccgtttaccttccccg

SEQ ID NO: 196356 - DNA, 696 bp, Homo sapiens
  misc_feature: GYAE6OF02GAJRP.16.70.G04.1.454.CMB.1.raw
  modified_base (329)..(329): a, c, t, g, unknown or other
  misc_feature (329)..(329): n is a, c, g, or t
tcagtgtactactccacgaccggtgctcgatttagtgtagtgtgaaggggaaaggggggaactgctcagttaggacccagacggaaccatggaagccccagcgcagcttctcttcctctgctactctggctcccagactaccactggagaaatagtgatgacgcagtcctccacgccaccctgtctgtagtcctaccgaaggggaagagccctaccctctcctgcgacgggccactcagtagtactaccagactaacttcgacctacggtaccagcaacgaaccgtcggaccacggtcctcccgaacgtcctaccctatatttgtggcnctacgtacccacggacggtaccagtcgtacctcccagtccgtaggttcgaggtcggactgggtcggtcgtagggacaggtctacactctaccactagtccaagtccacgtccgcgtacgtagtacgtaggtaagtttacgtttcgaaccttttaagtttaccgttacgtttcggtaacgtaccgtaagttaaacttaagtaacttacgggaaccgttccggtacccttacccggtacgttaccgttacggtttaccggggaacggtaacgggtaacggtaaggtaacggtactaaccgtaacgggaacttagggtacggtcgtacgtacggactaccggtatttcccgttacgtacttccgtaaccg

SEQ ID NO: 196357 - DNA, 787 bp, Homo sapiens
  misc_feature: GYAE6OF02I0Y8W.16.70.G04.1.454.CMB.1.raw
tcagtgtactactccacgaccggtgctcgatttagtgtagtgtgaaggggaaaggggggaactgctcagttaggacccagacggaaccatggaagccccagcgcagcttctcttcctcctgctactctggcctcccagataccactggaagaaattagtgatgacgcacgtctccagcccacctgtctgtcgtcctacggaaggggaaagcgacccaccctctacctgaccgacggcctactacgagtacgtaacttaccgacgacctaacttacgccgtacggaaccagacgaacgtaaccgtggacccacggtccacccgacggtcccttaccgtacttaagttttcgcggttacgacctaccgtacccgaccggacgggacctacgtacggttaacctacccgacgtaccgtacggttcgtacggtcggtaccggtaggttcggtcggtacgggaacgtacggtacgtttccgtaccgttaccgtaacctaacccgacgttaaccgacccggacacccgggtccgtacggacgttacggttcttaaaggtaacgtttttacgttacgttaactttaacggtttacttacgtgttaaacgacttaaactagtttaaactagtaccggccgttcctacccgttcgttaacgtccgttaaccggggtaccggcgggtaaaacggtaccggttaaggtaccggtaataccggtaaacgtaaccgggtacgtggtaccgtcgtaactacccgtattacccgtagtttaccgttacccttacttccccgg

SEQ ID NO: 196358 - DNA, 763 bp, Homo sapiens
  misc_feature: GYAE6OF02GZ83Q.16.70.G04.1.454.CMB.1.raw
  modified_base (95)..(95): a, c, t, g, unknown or other
  misc_feature (95)..(95): n is a, c, g, or t
  modified_base (201)..(201): a, c, t, g, unknown or other
  misc_feature (201)..(201): n is a, c, g, or t
  modified_base (270)..(270): a, c, t, g, unknown or other
  misc_feature (270)..(270): n is a, c, g, or t
  modified_base (464)..(464): a, c, t, g, unknown or other
  misc_feature (464)..(464): n is a, c, g, or t
tcagtgtactactccacgaccggtgctcgatttagtgtagtgtgaagggaaaggggggaactgctcagttaggacccagacggaaccatggaacnccccagcgcagcttctcttcctcctgctactctggctccagataccagtggataaactgtgatgacgcagtctcagtcccacctgtctgtgcctacgaggggtaancgcccaccttctcgtgcgacggccaacgtcagtacgttactaccaggactaacgttgaccgtggtaccngacaacgaaccgtcggaccgacggtccaccgtcggtccttaccgttctaagtttcgtcggggtctcgtaacctccccgaacggaccggacctacggttcggtacctcccgaggtcccgtaacggttcgaaggtcggtcgtacgggttcggttcgacggggaactacgggtattactcgtccgtaccaacgtacnccgagaccgtacgtccgtcgtacgttacggtacgtaagtacggtttcgtttacgacgtttaaacgtttaccttacgttcggtaacttaaccgttaatttaaagtaccgtttaaagtccgtaaccggttccgtcccgtttcccggacgttcccggtttaacggtaccggggttaaccgggaacctaacgggttacggttaacgaccgttaactaaaccgggtaaacgtccggtttacggaacggtacccttaggacctttaccggtagtttcccggttaactttccttaacggttccccg

SEQ ID NO: 196359 - DNA, 855 bp, Homo sapiens
  misc_feature: GYAE6OF02JSZSP.16.70.G04.1.454.CMB.1.raw
  modified_base (191)..(191): a, c, t, g, unknown or other
  misc_feature (191)..(191): n is a, c, g, or t
  modified_base (203)..(203): a, c, t, g, unknown or other
  misc_feature (203)..(203): n is a, c, g, or t
tcagtgtactactccacgaccggtgctcgatttagtgtagtgtgaagggaaagggggaacgtgctcagttaggaccagacggaaccatggaacgcccagcgcagcttctcttcctctgctactctggcctaccagactaccactggacgaatagtgatgacgcagtctacgagccacctgtactgtcgtcnccgagggaaacncgccctaccctcgtctcgaccgtgggacctactacgaggtaacttaccgtaaccaaggtacctaaaccgttacgacccgttggaaccctaggaacctaacgaaacccgttggacccgtaacgggtaccgttacccgaacgggtcctttaccccgtacttaacggttttaaccggcggggtttccgaacccttaaccggaccctttaaacccgggccggggtttacccttaaccgggttttaaccggccgtttaaacccccgtacggtaccccgggttaaagggtttacgtaacggggttccggggacgttaaaccggtttcgggggtaaccgttaccgggaaagtcgggtaaattttccccgaacccttaccgttaccaaccgttaacgggtacaaaccggtcgtaaacccgtcgtacgtaccgtacggttcggttacgtaagtttacctttgtaacgttacgtttaacgtttcgttacggttactacggtaatacttaagtacttacgtacgtcgtacctacgttacgttacgtaccggtttcggaacggtaacggttacgaaccgggtagaacgtacggtaaccgaacgttaacggtagtacggtacgtcggtactccgtacgttacgttaccggtacttacttacccgg

SEQ ID NO: 196360 - DNA, 726 bp, Homo sapiens
  misc_feature: GYAE6OF02HFS5P.16.70.G04.1.454.CMB.1.raw
  modified_base (104)..(104): a, c, t, g, unknown or other
  misc_feature (104)..(104): n is a, c, g, or t
  modified_base (202)..(202): a, c, t, g, unknown or other
  misc_feature (202)..(202): n is a, c, g, or t
tcagtgtactactccacgaccggtgctcgatttagtgtagtgtgaagggaaaggggggaactgcctcagttaggacccagacggaaccatggaagccccagcgnagcttctcttcctcctgctactctggctcccagataccactggagaaatagtgatgacgcagtctccagccaccctgtctgtgtctccgaggggaaangccaccctctcctgcaggccactcagagtattaccagactaacttcgctaggtaccagcgaagaaaccgtggaccgaaggcctcccgaacggctccctactatttactacggtcgtccgtaactacccgtaccgacgggcctaacgttcggtactccccagtccgtaacgttcgaggtcggacgtaggtcgggtctgggacgagtacgttccaacgttctaccaccgaacttaccgacgaccgtacgtacctaggacctacggttaccgtaggtaacggttagttttacgacgtttaaggttttaattaccgttgttaaccgaagttaacccgtaattaaacgtaaacttacggtaaccgtacgggtaccctcccgtcctaccgtaaccggttttccgggacggtaaccggaaccggtaacgggtacggaacgtaacgttaaccgaaaaccggtaacggttacggtgggtaccctacggaacctaccgttaccggttacttaccggttaccgttaccctaaccg

SEQ ID NO: 196361 - DNA, 758 bp, Homo sapiens
  misc_feature: GYAE6OF02I9ONN.16.70.G04.1.454.CMB.1.raw
  modified_base (384)..(384): a, c, t, g, unknown or other
  misc_feature (384)..(384): n is a, c, g, or t
tcagtgtactactccacgaccggtgctcgatttagtgtagtgtgaaggggaaaggggggaactgctcagttaggacccagacggaaccatggaagccccagcgcagcttctcttcctcctgctactctggctcccagataccactggagaaatagtgatgacgcagtctccacgccaccctgtctgtgtcctaccgaaggggaaagacgccaccctccttccgtgccgacgggccactacgagagtacttaccgagactaacttacgccgtacggtaaccagaccaacgaaacctcggaccgacggcctcccgacggtcctcccgtacttagtttagtaggtcgtacaccttcccgaccgacgggaccctacgttacggtaccncccgacggtacccgtacgttcggaggtcggtacgtagggttcggtacgtggggaactaggtaccgttcaactcctacgacctataccgtactacgacggtcctacgacgtacgtagtaacgtaacgttagttttactacggtttaattttaccgttacgttagtacgtaacgtacttaaagttactaagtaccgtaacgtcccgtaccgtccgttaccgttaccgttaccgggtttaccgggaccgggtaacgggtaccggttacgggtaacggtacgtaacggtaacgaaaccgggtaagtttcgggtaccggtacgtaaccgtaccggaccttaccgtttaccgtttaccggtaccgtttactaacccccgg

SEQ ID NO: 196362 - DNA, 516 bp, Homo sapiens
  misc_feature: GYAE6OF01BEM3M.37.12.B01.1.454.CMB.1.raw
  modified_base (487)..(487): a, c, t, g, unknown or other
  misc_feature (487)..(487): n is a, c, g, or t
  modified_base (509)..(509): a, c, t, g, unknown or other
  misc_feature (509)..(509): n is a, c, g, or t
  modified_base (516)..(516): a, c, t, g, unknown or other
  misc_feature (516)..(516): n is a, c, g, or t
tcagtagtgtagatcacgaccggtgctcgatttagtagtgtagatttgggtctgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatattactgtgtgaaaggctgggggatggggggactactggggccagggaaccctggtcaccgtctcctcagcctccaccaagggcccatcggtcttccccctggcaccctcctccaagacgcacctctggggcacagcggccctgggctgcctggtcaaggctacttccatctacnctactgagcgggctggcaaggngcagtgn

SEQ ID NO: 196363 - DNA, 552 bp, Homo sapiens
  misc_feature: GYAE6OF01DHIH2.37.12.B01.1.454.CMB.1.raw
  modified_base (529)..(529): a, c, t, g, unknown or other
  misc_feature (529)..(529): n is a, c, g, or t
tcagtagtgtagatcacgaccggtgctcgatttagtagtgtagatttgggtcgtgggggaggcctggtgcagccttggggggtccctgagactctccgttgggtgcagcctctggattaatgtttagcaactctggcatgaactgggtccgccaggctccaggcactggggctgcaggtgggtctcgaagtcgtagtgctcctggtaatagagcagacctacgcaggactccgtgaaggccgttcaccatctccagagacaattccaagaacacgctctatctgcgaaatgaacagccttgagagccgaagacacggcccgtagtattaactcgtagtgaaaggctggggtatggggggactacgtggggccgagggaaccctggtccacgtctcctcacgcctccaccgaacgggcccagtcggtccttcccccgtggcctaccctcctcccaagacgccgacctcgtggggcacgagtcgccgtgggctgcctgtcaggctactccatctacactagcgagcgggtnttcgggtcgaaggcgacagtgcg

SEQ ID NO: 196364 - DNA, 552 bp, Homo sapiens
  misc_feature: GYAE6OF01BAYMO.37.12.B01.1.454.CMB.1.raw
tcagtagtgtagatcacgaccggtgctcgatttagtagtgtagatttgggtctgggggaggcctggtgcagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacgggaaccctggtcaccgtctcctcagcctccaccaagggcccatccggtccttccccctcggccaccctccctcccaacgacgcaccctcgtcgggggccacgacgccgggcccgtgggcctcggccgtcggtcaacgggacctacttccgactctacactacctgacgcgggctggcaggcgc

SEQ ID NO: 196365 - DNA, 597 bp, Homo sapiens
  misc_feature: GYAE6OF01EJEK0.37.12.B01.1.454.CMB.1.raw
tcagtagtgtagatcacgaccggtgctcgatttagtagtgtagatttgggtctgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccgttcaccatctcagagacaattccaagaacacgctctatctgacaaaatgaacagcctgagagccgaagacacggccgtatattactgtgtagaaaggcgtaggggagtggggggactacggtggggaccgacgggaacccgtggtcacccgtctcctcacgccctaccaaccgaacggcccagtccggtcccttcccccgtcggccctacccctcctacccgaacgacgccaccgtcggtcggggccacgacggccggcccgtgggcctcggcccgtcggtacgaacggaccttaccgttcccacttacctaccgtaccttacgtggacggccgggctcgggaccgaacgggccgacgtatggcg

SEQ ID NO: 196366 - DNA, 230 bp, Homo sapiens
  misc_feature: GYAE6OF01BAJFF.37.12.B01.1.454.CMB.1.raw
  modified_base (228)..(230): a, c, t, g, unknown or other
  misc_feature (228)..(230): n is a, c, g, or t
tcagtagtgtagatcacgaccggtgctcgattagtagtgtagattcggggagttatgtctggggccagggaaccctggccaccgtctcctcagcctccaccaagggcccatcggtcttccccctggcgccctgctccaggagcacctccgagagcacagcggccctgggctgcctggtcaaggactacttccatctacactactgagcgggctggcaaggcgcatagnnn

SEQ ID NO: 196367 - DNA, 802 bp, Homo sapiens
  misc_feature: GYAE6OF01CAJXV.37.12.B01.1.454.CMB.1.raw
tcagtagtgtagatcacgaccggtgctcgatttagtagtgtagatttgggtctgggggaggcctggtgcagcctgggggggtccctgagactctcctgtgcagcctctggaataatctttagcaaatacgccatgatctgggtccgccaggcctccgaggggaaggggctgggagtgggtctcagcctatttccggcaagtggtggtgcacgcactacgcagactccgtggaacgggccgttcaccgtctccagagacaattcaggaacactctatatctgcaaatgaacagcctgagagccgagaccacggccatatattatgtgacaaacgaccccgaaggtcgaaccacgtaagtttggacgtttctttacggacgttttcggtcgggggaacccgaaagggggtaaccgtaaacccgggttccaacccggttccttacccgttacaaccggtccccttacccgaaccccggaaccggggtccccaacgttcccgggtttacccctttccccccggtcgggccccgtacccccgttcggccccgtttaccccggaacggggtacccgtacccgtaaccccgttacccgggaacgtaaccggcccgaaaccggaccgggtccccggggttaccccggtcggggtcccgttcccgggacccggtttcggggtaaccccgaaaccgggttacccgtttaaccccgttacccgtaaactttccccgttaaaccgtaacccgtttaccggtaccggggtaaccggcccgggggtaaccttcgggggaacccggtaaacccgggg

SEQ ID NO: 196368 - DNA, 686 bp, Homo sapiens
  misc_feature: GYAE6OF01DBLAC.37.12.B01.1.454.CMB.1.raw
  modified_base (247)..(247): a, c, t, g, unknown or other
  misc_feature (247)..(247): n is a, c, g, or t
  modified_base (427)..(427): a, c, t, g, unknown or other
  misc_feature (427)..(427): n is a, c, g, or t
  modified_base (683)..(683): a, c, t, g, unknown or other
  misc_feature (683)..(683): n is a, c, g, or t
  modified_base (685)..(685): a, c, t, g, unknown or other
  misc_feature (685)..(685): n is a, c, g, or t
tcagtagtgtagatcacgaccggtgctcgatttagtagtgtagatttgggtctgggggaggcctggtgcagcctgggggggtccctgagactctcctgtgcagcctctggattaatgtttagcaactctggcatgaacgtgggtccgccaggctccaggcagtggggctgcaggtgggtctcaagtactagtgctcgtaggtaatagagcagactacgcagactccgtggaacggccgttcacatcncagagacaataccaagaacacgctctatctgacaaatgaaacagcctagagacgaccgaagacacgggacctataacttactggtagtaggaaaagggtcggtaggggggaaggtcgggggtaactacgggtacggggaccgaaacgggtacccgtggtaccgtacccgttctccccgtnaaccggccctaccgaacccgaacgggaccctacgtccggttcccttcccccggtcgccccgaccccttaccgtaccaacggtaccacccgtaccgtccgggtacggggaccaaccggacggcccgggcccggtcgggtccgtcggtcccgttgggtaacccaacgggtaaccttaccgttacccacgttaccgtaaccgtaccgtacgtacgggcggaccgggtcgtacggaccgtaaacgggccacgtaaacggngng

SEQ ID NO: 196369 - DNA, 584 bp, Homo sapiens
  misc_feature: GYAE6OF01C0C7A.37.12.B01.1.454.CMB.1.raw
  modified_base (351)..(351): a, c, t, g, unknown or other
  misc_feature (351)..(351): n is a, c, g, or t
tcagtagtgtagatcacgaccggtgctcgatttagtagtgtagatttgggtctgggggaggcctggtgcagcctggggggtccctgagactctcctgtgcagcctctggattaatgtttagcaactctggcatgaactgggtccgccaggctccaggcagtggggctgcagtgggtctcaagtactagtgctcctggtaatagagcagactacgcagactccgtgaaggccgttcaccatctccagagacaattcaagaacacgctctatctgacaaatgaacagcctagagagccgaagacgacgaccgtatatactgtgtagaaggcgtggggagtgggggacttacgngggaccgaggaaccgtggtacaccggtctccgtcacggcctaccaccgaacggccctaacgtccggttacccttccccgtcgccctacccgttcccaccgtaagacgtccgaacctcggtcggggccacgacggccggtccgcgggtcctgccgtggtaccgaaggtacctacttccgaacttcctaaccgtacaacttcggagccgggctggaccgaaggcggcacgtaggc

SEQ ID NO: 196370 - DNA, 530 bp, Homo sapiens
  misc_feature: GYAE6OF01AOPD9.37.12.B01.1.454.CMB.1.raw
  modified_base (286)..(286): a, c, t, g, unknown or other
  misc_feature (286)..(286): n is a, c, g, or t
  modified_base (308)..(308): a, c, t, g, unknown or other
  misc_feature (308)..(308): n is a, c, g, or t
  modified_base (312)..(312): a, c, t, g, unknown or other
  misc_feature (312)..(312): n is a, c, g, or t
  modified_base (319)..(319): a, c, t, g, unknown or other
  misc_feature (319)..(319): n is a, c, g, or t
  modified_base (345)..(345): a, c, t, g, unknown or other
  misc_feature (345)..(345): n is a, c, g, or t
  modified_base (350)..(350): a, c, t, g, unknown or other
  misc_feature (350)..(350): n is a, c, g, or t
  modified_base (387)..(387): a, c, t, g, unknown or other
  misc_feature (387)..(387): n is a, c, g, or t
tcagtagtgtagatcacgaccggtgctcgatttagtagtgtagatttgggtctgggggaggcctggtgcagcctgggggggtccctgagactctcctgtgcagcctctggattaatgtttagcaactctggcatgaactgggtccgccaggctccaggcagtggggctgcagtgggtctcatccattagtagtagtggtactacatatactacgcagactcaggtggaggggccattcaccatctccagagacaacgccaagactcactgtatctgcaaatgaacncgcctgagagccgagacacggntgtntattacngtgcgagacgccctcactcagcagcngcgtnacttgcgggaccacgggacctggctaccgtctcctcncgcctccacgacgcctacgtcgtccctcccgtcgccaccctcctaccgaacgtcgacctaccgtcgacggggccacgcggccgcccgtggcctcgtcgtcgacgacgtaccctactcctactactacccacgtcgtggaccgg

SEQ ID NO: 196371 - DNA, 619 bp, Homo sapiens
  misc_feature: GYAE6OF01CQ2TN.37.12.B01.1.454.CMB.1.raw
  modified_base (350)..(350): a, c, t, g, unknown or other
  misc_feature (350)..(350): n is a, c, g, or t
tcagtagtgtagatcacgaccggtgctcgatttagtagtgtagatttgggtctgggggaggcctggtcaagcctggggagtccctgagactctcctgtgcagcctctggattcaccttcagtagctatagcatgaactgggtccgccaggctccgagggaaggggctggaggtgggtctcatccattagtagtagtggtacttacatatactacgcagactcagtggaggggccattcaccatctaccagagacaacgccaaagactcactgtatctgacaaatgacagcctagagacgccgaaggacacggtctgtgtattacgtgtgacgagacgtcccctccacctnagcagcgaggcggtgtaccgtttcggcgggggacccaacggggacccttcgggtaccgtacccgtcctccctcacgtcccctaccgaaccgaacgggcccctacgttcccggttcccttcccccgtcggccctaccccgtccctaccgaacgccgaccgtacccgtcgggtacggggaccacgacgggcccggtcccggtcggcccgtcgcccgtgggtaccgaggtaccttaccgtcctactctaaccactacgtcggcgccgggtcg

SEQ ID NO: 196372 - DNA, 691 bp, Homo sapiens
  misc_feature: GYAE6OF01BDJSM.37.12.B01.1.454.CMB.1.raw
tcagtagtgtagatcacgaccggtgctcgatttagtagtgtagatttgggtctgggggaggcctggtgcagcctgggggggtccctgagactctcctgtgcagcctctggattaatgtttagcaactctggcatgaactgggtccgcaggctccaggcagtggggctgcaggtgggtctcaagtactagtcgctcgtaggtaatagagcagactacgcagtactccggtaggaacggggtccgttacaccatcctaccgaagacgaacaacttaccgaaagaaccacgtctacttatctgacaaagtgaaacacgtccgtagaacgacgaccgaacgacgaccggcgtaattatactgtgtagaaggcgtggggagtggggacgtacggtcggggcgaacgggaccgtggtaccgtacccgtctccgtcacgtccctaccgaaccgaacggccctacggttcccgttcccttcccccggtcggtaccctaccccgtacctacccgaagtccgacctacccgtcggtcccggggacaccggtaccgggcccggtcccggtcgggtccgtaccggtccgttcgggtaaccgtaaccgggtaccttacccgttaccacgttacccgttaaccgtaccgttaacgtggacgggccgggtcggtaccgggaacggacgggccggaactacgtagcg

SEQ ID NO: 196373 - DNA, 640 bp, Homo sapiens
  misc_feature: GYAE6OF01CISUV.37.12.B01.1.454.CMB.1.raw
  modified_base (146)..(146): a, c, t, g, unknown or other
  misc_feature (146)..(146): n is a, c, g, or t
  modified_base (246)..(246): a, c, t, g, unknown or other
  misc_feature (246)..(246): n is a, c, g, or t
  modified_base (271)..(271): a, c, t, g, unknown or other
  misc_feature (271)..(271): n is a, c, g, or t
  modified_base (298)..(298): a, c, t, g, unknown or other
  misc_feature (298)..(298): n is a, c, g, or t
  modified_base (319)..(319): a, c, t, g, unknown or other
  misc_feature (319)..(319): n is a, c, g, or t
  modified_base (322)..(322): a, c, t, g, unknown or other
  misc_feature (322)..(322): n is a, c, g, or t
  modified_base (349)..(349): a, c, t, g, unknown or other
  misc_feature (349)..(349): n is a, c, g, or t
  modified_base (353)..(353): a, c, t, g, unknown or other
  misc_feature (353)..(353): n is a, c, g, or t
tcagtagtgtagatcacgaccggtgctcgatttagtagtgtagatttgggtctgggggaggcctggtgcagcctgggggggtccctgagactctcctgtgcagcctctggtttcatctttagcaactacgccatgagctgggtccnccaggctccgagggaaggggctggagtgggtctcaggtattacgtggtagtggtaataccgcatactacgcagactccgtgacgggtccgttcaccgtcncagagactaatccaaagaatacgtntatcgtaggaaatgaacagcctgaganccgagacacggcctatatacngtncgagagatcaagacggagtaatagganaganagctcgtcgaactacggtcggggaccaacgggtaaccctggtaccaccgtctccgtacgacgtccctaccaaccgaacggtacccaacgttccggttacccttcccccgtgacccctacccgttccctaaccgaacgacgacccaacgtccggcggggaccaacgaccggtacccgggcccgtcgggtccgtccggtaccgtacgggtacctaaacgggtaccttaaccgttacccgtactacctaaccacgtacgtacgacggccggacgacggacgacggcgacg

SEQ ID NO: 196374 - DNA, 562 bp, Homo sapiens
  misc_feature: GYAE6OF01E3M55.37.12.B01.1.454.CMB.1.raw
  modified_base (323)..(323): a, c, t, g, unknown or other
  misc_feature (323)..(323): n is a, c, g, or t
tcagtagtgtagatcacgaccggtgctcgatttagtagtgtagatttgggtctgggggaggcctggtgcagcctggggggtccctgagactctcctgtgcagcctctggattaatgtttagcaactctggcatgaactgggtccgccaggctccaggcagtggggctgcagtgggtctcaagtactagtgctcctggtaatagagcagactacgcagactccgtgaagggccgttcaccatctcagagacaattccaagaacacgctctatctgacaaaatgaaacagcctgagacgccgaaagacacggccgtaatattacngtgcgagagatcagacggatatagcagcagctctgactacgtgggaccacggaaccctggtccaccgtctacctcacgcctaccaaccgaacggcccagtccgtccttcccccgtcggccacccctcctaccaacgtacgacctaccgtcgtacggggacacgacggccggcccgtcgggcgtcgccgtggtccaaacggtaccttacgttacccacttacctaactacgtacgtacgg

SEQ ID NO: 196375 - DNA, 758 bp, Homo sapiens
  misc_feature: GYAE6OF01CZCTG.37.12.B01.1.454.CMB.1.raw
  modified_base (145)..(145): a, c, t, g, unknown or other
  misc_feature (145)..(145): n is a, c, g, or t
  modified_base (757)..(757): a, c, t, g, unknown or other
  misc_feature (757)..(757): n is a, c, g, or t
tcagtagtgtagatcacgaccggtgctcgatttagtagtgtagatttgggtctgggggaggcctggtgcagcctggggggtccctgagactctcctgtgcagcctctggattaatgtttagcaactctggcatgaactgggtccnccaggctccaggcagtggggctgcagtgggtctcaagtactagtgctcgtggtaatagagcagactacgcagactccggtagaacgggtccgttacacctagtcctaccgagacgaactaaattccaaagaacacgctctatctgacaaatgaacagcctaggaagacgaccgaagacgacggtaccgtattaagttactgtgtaggaaaggtcggtaggggaggtacggggggtaactacggtcgggggaccgaacgggtaacccgtggtaccgaccgttacctccgtaccgacgcccttacccgaaccgtaaccgggtcccctaacgttcccggttccccgttccccccgttacgggccccttaacccccgttcccgtaacccgtaaacggaccggtaaccctacccggttacgggttccgggggacccaaccggaacgggtccccgggtaccccggtcgggtccgtaccgggtcccgttacggggtacctaacggggtaccttacccgtttaccgaaaccgtttccgtaaccgtaaccgttaccggtaacgggtcgggtacccgggtcggttacgggaaccgtaaacgggcctaacggtgttaaccggng

SEQ ID NO: 196376 - DNA, 765 bp, Homo sapiens
  misc_feature: GYAE6OF01AUI1E.37.12.B01.1.454.CMB.1.raw
tcagtagtgtagatcacgaccggtgctcgatttagtagtgtagatttgggtctgggggaggcctggtgcagcctggggggtccctgagactctcctgtgcagcctctggattcaactttggtagctattggatggactgggtccgccagtctccagggaaggggctggagtgggtgccaacataaagcaagatggaagtgagaaatactatgtggactgtgtagaagggccgattccaccatcctccagacgacaacgcccagaactcattgtatctgacaaatgaacagtactagagacgcgagacgacgctgtatatacgtgtgacggtagaggaggacggtcgtaagtttaggtaagtaaagtggtcgtcgggtccctttacgaacctttaacgtaaccttaactacgtagttcgggtaaccggttacggtacggggtaaacggaaaccggggaacccgtaccgggttacccgtacccgttccctacccgtaccgtaccgtccccttacccgaacccggtaaccgggtacccctacgttaccccggtttccccgttacccccgtcccgggccccctaacccccgttcccctaaccccgaacggacccgtaccccgtacccgttccggggtaccgggggtacctaaccgggaccggtccccggggtaccccggtggggttacccgtcccggttacccgggtacggtacccggtaaacgggttaccctttaaccccgtttaccctaccttacccgttaaacccg

SEQ ID NO: 196377 - DNA, 784 bp, Homo sapiens
  misc_feature: GYAE6OF01B4FZI.37.12.B01.1.454.CMB.1.raw
  modified_base (224)..(224): a, c, t, g, unknown or other
  misc_feature (224)..(224): n is a, c, g, or t
tcagtagtgtagatcacgaccggtgctcgatttagtagtgtagatttgggtctgggggaggcctggtgcagcctggtgggtccctgagactctcctgtgcagcctctggattaattgtttagcaactctggcatgaactgggtccgccaggctccaggcagtggggctgcagtgtgtctcaagtactagtgctctggtaatagagcagactacgcagactccgnggaacgggtccgttacaccatcctccagagacaactaccaagaacacgctctatctgacaatgaacacgcctagagacgacgaacgacgacggactatattacgtgtgtaggaaggcggtaggggaggtagggggactacgggtcggggaccgaacgggaacccgttcggtacccgacccgttaccgtcccgtacgacgccctacccgaacccggtaaccgggccctacgttccccggttacccttccccccgtcggtacccctacccccgttacccgtacccgaaacggtccgacccgttaaccccggttcgggtacccgggggtacccaaaccgggaccccggggtcccccgggtccccgggttaccgggggtcccgtttacccggggtcccggtttaccggggtaacccggttaaaaccgggttaaccccctttaacccgtttaccccgtaaacccgttttacccgtaacccttaacccgggttaaccgttaccgggtaaccggggacccggggttaccgtacccggggtaacggaacccggggtgaaccgtaacgg

SEQ ID NO: 196378 - DNA, 805 bp, Homo sapiens
  misc_feature: GYAE6OF01EE773.37.12.B01.1.454.CMB.1.raw
  modified_base (178)..(178): a, c, t, g, unknown or other
  misc_feature (178)..(178): n is a, c, g, or t
  modified_base (249)..(249): a, c, t, g, unknown or other
  misc_feature (249)..(249): n is a, c, g, or t
tcagtagtgtagatcacgaccggtgctcgatttagtagtgtagatttgggtctcgggggaggcctggtgcagcctggggggtccctgagactctcctgtgcagcctctggattaatgtttagcaactctgcactgaactgggtccaccaggctcaggctagtggggctgcagtcggtntcaagtctagtgctccgtggtaatagagcagtactacgcagtacctcgttaggaaggccgtttcaaccgtnttctaccgaggtactaattaccgaaagaacactacgtcgttccttctagaactaaagttacgaaaccacggtcctaggtaacggtacgtacggaacggtaaccgtacggtttacccttttaaagtaacttttaccgtaagttcggtacggtaaaaaccgggccccttttcgtaaccggtacccccttttaagtaccggacgtaaccggtcccggtacctttcggggtccttaacggtttacgtttcgtaacggacggttacgggccggtaacggaacccgttcggtccgtacccggttacctacccgtacggtaacccgtcccgttaacccgaacccggttaacccgggaccccttaaccggttccccgttacccttccccccgttacggccccgtaccccgttcgacccgtaccgtacggaccgtaccctacccgtccgaacgtacgacccgaaccggttcggaccccggtccgttacgggcgttccggaccgttacgggaccgtaaccggtaaccttccgttaacctacctacccttaaagcccggttaaccgg

SEQ ID NO: 196379 - DNA, 610 bp, Homo sapiens
  misc_feature: GYAE6OF01EVJ5Q.37.12.B01.1.454.CMB.1.raw
tcagtagtgtagatcacgaccggtgctcgatttagtagtgtagatttgggtctgggggaggcctggtgcagcctggggggtccctgagactctcctgtgcagcctctggattaatgttttagcaactctggcatgaactgggtccgccaggctccaggcatgggggctgcagtgggtctcaagtactagtgctcctggtaatagagcagactacgcagactccgtgaagggccgttcaccatctccagagacaattccaagaacacgctctatctgacaaatgaacagcctgagagccgaagaccgacggccgtatattactgtagtaggaaggcgtggggaggtgggggactacggtcggggaccgacgggaacccgtggtccgacccgtcgtccgtcacgtccctaccgaaccgaaccgggcccacgtccggttcccttacccccgtgaccctaccctcccaccgaacgcgaccctaccgtccggtcggggaccaccgacggccgggtcccgtacggggctcgccggttcgtacgaacgtaccaccttccactacctaacgtacgtacgtggacgggccggtcgcggtccgaagggccacgaagtgcg

SEQ ID NO: 196380 - DNA, 232 bp, Homo sapiens
  misc_feature: GYAE6OF01D2M2A.37.12.B01.1.454.CMB.1.raw
  modified_base (223)..(223): a, c, t, g, unknown or other
  misc_feature (223)..(223): n is a, c, g, or t
  modified_base (229)..(232): a, c, t, g, unknown or other
  misc_feature (229)..(232): n is a, c, g, or t
tcagtagtgtagatcacgaccggtgctcgatttagtagtgtagattcggggagttatgtctggggccagggaaccctggccaccgtctcctcagcctccaccaagggcccatcggtcttcccctggccgccctgctccaggagcacctcgagagcacagccggccctgggctgcctggtcaaggactacttccatctacactactgacgcggctggcaaggcncatagnnnn

SEQ ID NO: 196381 - DNA, 892 bp, Homo sapiens
  misc_feature: GYAE6OF01DTJID.37.12.B01.1.454.CMB.1.raw
tcagtagtgtagatcacgaccggtgctcgatttagtagtgtagatttgggtctgggggaggcctggtgcagcctgggggggtccctgagactctcctgtgcagcctctggattaatgtttagcaactctggcatgacgtgggtccgccaggcctccaggcagtggggctgcaggtgggtctcaagtctagtgctcctaggtaatagagcagactacgacagaccgtcgtaggaacgggtccgttacaccgtatcctaccgaagacgtaactaaacgttaccgaaaacggtaaaccaccggttaccttaccttaacttccgtacggaacctaaaaacgtacgaaaccgacggtacccgtagggaaacggaccggaaccggaaacgtaacccggtaccggtaccgttaatttaaacgtttaccggtaggtacggttaaggggaaacgggttacggggtaacgggggtacgggggtaccgggggtaaccggttaccgggggtccggggaacccggtaaccggggtaacccgttccgggttaacccgtccccgggtttaccctaccgtacggtacccgtccccgtaacccgggaccggttaacccgggtccttacccggtccggtttcccccttccccggtacgacccccttacccttcccggaccgtaaagtcccggtacccttccgggtacgggggtacgacacccggtccggggcccgggttacccggtcggttacccgtacgggtcccgttaacgggtaacccgtaccggttaacctttacccccgttcctaaccgttacccgtaacccggtaaacgtttcggcgggggtaaccgttccccgggaagggttaccccggaaaggggtcctaacccggagttcgtaaagggtcc

SEQ ID NO: 196382 - DNA, 207 bp, Homo sapiens
  misc_feature: GYAE6OF01BL1S3.37.12.B01.1.454.CMB.1.raw
  modified_base (185)..(207): a, c, t, g, unknown or other
  misc_feature (185)..(207): n is a, c, g, or t
tcagtagtgtagatcacgaccggtgctcgatttagtagtgtagatttggggttagggggggaagaggaagactgaccggtcccccaggagttcaggtgctgggcacagcggccctgggctgcctggtcaaggactacttccatctactactactgacgcggggtcttgggcaaggcgacaatagnnnnnnnnnnnnnnnnnnnnnnn

SEQ ID NO: 196383 - DNA, 897 bp, Homo sapiens
  misc_feature: GYAE6OF01C27Q4.37.12.B01.1.454.CMB.1.raw
  modified_base (150)..(150): a, c, t, g, unknown or other
  misc_feature (150)..(150): n is a, c, g, or t
tcagtagtgtagatcacgaccggtgctcgatttagtagtgtagatttgggtctgggggaggcctggtgcagcctgggggggtccctgagactctcctgtgcagcctctggtattaattgtttagcaactctggcatgaacgtgggtcccncaggctccgaggcagtggggctgctaggtggtctacaagttacgtagtgccttccgtagggtaaactaggacgtcaacgtaaccgtacgacaacgtaccgtccggtaagggaaaccgggtccgttaccaacctagtcctaccgaagacgaactaaacttccgaaaacgaacgaaccgtaccttacttaactaccgttacgaacgaaaatacggaaaccgacgtcccggtaacggaaaggacccggaaccggaaaacggaaccgtaacccggggtacgttaaacgttaagtttaaccgttggttacgggtaagggtaaaacgggtcggtaagggggtacggtacggggggtaacctacggggtacggggaaccggtaacggggtaacccggtacggtcccgtaaaccgggtttcccgtacccgtacgtaacccggcccgttaccccgaaccggtaacccggggccccttaaccggttccccgggttaaccccgtttccccccggtaccggtacccctaccccccgttacccggttaaccccgaaaggttacccggaaccctaaccccggttacggggtacccggggacctaaccgggccgggtccccggtcgggtaccgggtcctacggtccggttcgggtaaaccacgggttaaccttacccgttaccgaacgttcctaaaccgtaaccgttacgtacgggtacggcccgggtactaccggacggttacgaccggacgtagtcgtag

SEQ ID NO: 196384 - DNA, 909 bp, Homo sapiens
  misc_feature: GYAE6OF01AW907.37.12.B01.1.454.CMB.1.raw
  modified_base (253)..(253): a, c, t, g, unknown or other
  misc_feature (253)..(253): n is a, c, g, or t
tcagtagtgtagatcacgaccggtgctcgatttagtagtgtagatttgggtctgggggaggcctggtgcagcctgggggggtccctgagactctcctgtgcagcctctggtttcatcttttagcaactacgccatgagctgggtccgccaggctccgaggggaaggggctggagtgggtctcaggtattacgtggtagtggtaatccgcatactacgcagactccggtgacgggtccgttcaccgtctcaganacatccaagataggtctatcaggaatgaacagcctgagagccgtaggacaccggcccttatattaccgtgtggcgagagacttagacggaccgggtagtaagtacgcgtacgcaaggtccttcgtacgaccttaccggggtccggggaccctaaacccggggtaccccttgggtacccctaccccggttcctttacccccgtacgtaccgtccccctaaccccgtaaccccgggtaaccccggtcccccgtaaacgtttccccggggtttccccctttacccccccggtacggggttaccccccaaccccccggtttcccccgtaaaccccgtaaaaccggggtccctaacccccgggtaaccccgtttcccggggttaccgggggggaccccctaaaccggggtaaccccgggggtcccccgggttaacccccggggtcggggggttaccccctttcggggtaccccccggtttcgggtaaccccgggtaaaaccgggtttaaccccctttaacccggtttaccccggtaaccttttaacccccggttaaacccttacccggtttaaaccccggttggggtaacccccgggggtaaccggggtttcccgggttaaccggggaacccggttaaaaccggggcccgggttaaacccg

SEQ ID NO: 196385 - DNA, 524 bp, Homo sapiens
  misc_feature: GYAE6OF02G8TM2.37.12.B01.1.454.CMB.1.raw
tcagtagtgtagatcacgaccggtgctcgatttagtagtgtagatttgggtctgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccggttcaccatctccagagacaactccaacaacacgctgtctctgcaacttaacagcctgagagacgaggacacggccgtatattactgtgcgaaggaagggtctagcagtgcctggtactcccactactatatggacgtctggggcaaaggaatcgcggtcaccgtctcctcacgcctccaccaagggcccatcggtcttcccctggccaccctcctcccaagacgcacctctgggggcacgagcggccctgggctggcctggtcaaggactacttccatctacactactcgg

SEQ ID NO: 196386 - DNA, 516 bp, Homo sapiens
  misc_feature: GYAE6OF02H945Y.37.12.B01.1.454.CMB.1.raw
  modified_base (512)..(516): a, c, t, g, unknown or other
  misc_feature (512)..(516): n is a, c, g, or t
tcagtagtgtagatcacgaccggtgctcgatttagtagtgtagatttgggtctgggggaggcctggtgcagcctggggggtccctgagactctcctgtgcagcctctggattcaccttttaatacctattggatgagttgggtccgccaggttccagggaaggggctggagtgggtggccaacataaagcaagatggaagtgagaaatactatgtggactttgtgaagggccgattcaccatctccagagacaactccaagaactcagtgtatctacacatgaacaaccttagagtcgaggacacggctgtttattactgtagaaaaggccactatggagtctggggccgagggaccacggtcaccgtctcctcagcctcaccaagggcccatcggtcttccccctggcgccctgctccaggacgcacctccgagagcacagcgccctgggctgcctggtcaaggactacttccatctaacactactgacgcgggctggcaaggcgcatagnnnnn

SEQ ID NO: 196387 - DNA, 582 bp, Homo sapiens
  misc_feature: GYAE6OF02IY7RO.37.12.B01.1.454.CMB.1.raw
tcagtagtgtagatcacgaccggtgctcgatttagtagtgtagatttgggtctgggggaggcctggtgcagcctggggggtccctgagactctcctgtgcagcctctggattaatgtttagcaactctggcatgaactgggtccgccaggctccaggcatggggctgcagtgggtctcaagtctagtgctcctggtaatagagcagactacgcagactccgtgaagggaccgggttccgtaccactctccacgagacaattaccaacgaacacgctcctatctgcaaatagaacaagcctgagagccgaacgaacacggccgtatattactgtgtgaaggcgtgggagtgggggacgtactgggcgaggaaccgtcggtcaacgtctcctcacgcctccaccaacgggcccatcggtccttcccctggccaccctccctccaagagccaccctcgtgggggccacacggccggcccgtgggcttcgcccgttagggtcgaaacggaccttacctttccacttacttacccgaactaccgttggacggccgggcttcgggactaaacgggccggccagtagcg

SEQ ID NO: 196388 - DNA, 184 bp, Homo sapiens
  misc_feature: GYAE6OF02HF920.37.12.B01.1.454.CMB.1.raw
  modified_base (174)..(184): a, c, t, g, unknown or other
  misc_feature (174)..(184): n is a, c, g, or t
tcagtagtgtagatcacgaccggtgctcgatttagtagtgtagatttgggtttagggggaagaggaagactgacggtcccccaggagttcaggtgctgggcacagcggccctgggctgcctggtcaaggactacttccatctacactactgagcgggctggcaaggcgcatagnnnnnnnnnnn

SEQ ID NO: 196389 - DNA, 512 bp, Homo sapiens
  misc_feature: GYAE6OF02HY16I.37.12.B01.1.454.CMB.1.raw
  modified_base (453)..(453): a, c, t, g, unknown or other
  misc_feature (453)..(453): n is a, c, g, or t
  modified_base (484)..(484): a, c, t, g, unknown or other
  misc_feature (484)..(484): n is a, c, g, or t
tcagtagtgtagatcacgaccggtgctcgatttagtagtgtagatttgggtctgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatattactgtgtgaaaggctggggatggggggactactggggccagggaaccctggtcaacgtctcctcagcctccaccaagggcccatcggtcttcccctggccaccctcctccaacgacgcacctctggggcacagcgccngggctgcctgtcaaggactattccatctacnctactgagcggctggcaaggcgcatagc

SEQ ID NO: 196390 - DNA, 525 bp, Homo sapiens
  misc_feature: GYAE6OF02IY82X.37.12.B01.1.454.CMB.1.raw
  modified_base (145)..(145): a, c, t, g, unknown or other
  misc_feature (145)..(145): n is a, c, g, or t
  modified_base (463)..(463): a, c, t, g, unknown or other
  misc_feature (463)..(463): n is a, c, g, or t
tcagtagtgtagatcacgaccggtgctcgatttagtagtgtagatttgggtctgggggaggcctggtgcagcctggggggtccctgagactctcctgtgcagcctctggattcaccttcagcaactatggcatgcactgggtccnccaggctccaggcaaggggctggagtgggtggcagttatatcagatgatggaagtgttgaggagtatgcagactccgtgaagggccgattcaccatctccagagacaattccaaaaactcactgtatctgcaaatggacggcctgagatccgaggacacggctgtgtattattgtgcgagagtatttagactacaaagtttcgagtgacgtggtatgatgcttatgataccgtggggaccaagggaccagtggtcaccgtctcttcagccctccaccgaaggcccatccggtccttcccctgcgccctgctccaggcncacctccgagcgaccacgacgccggcccgtcgggcctcggcccgtgggtaccaagggtaccc

SEQ ID NO: 196391 - DNA, 527 bp, Homo sapiens
  misc_feature: GYAE6OF02I8L7F.37.12.B01.1.454.CMB.1.raw
tcagtagtgtagatcacgaccggtgctcgatttagtagtgtagatttgggtctgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatattactgtgtgaaaggctggggatggggggactacgtggggccagggaaccctggtcaccgtctcctcagcctccaccaaggcccatccggtcttccccctggccaccctcctccaacgacgccaccctcgtcgggggcacgacgcggccctgggctcgccgtggtcaacggactacttccatctacgctactgagcggctggcaaggcgcatgc

SEQ ID NO: 196392 - DNA, 514 bp, Homo sapiens
  misc_feature: GYAE6OF02JZ8E1.37.12.B01.1.454.CMB.1.raw
  modified_base (430)..(430): a, c, t, g, unknown or other
  misc_feature (430)..(430): n is a, c, g, or t
  modified_base (484)..(484): a, c, t, g, unknown or other
  misc_feature (484)..(484): n is a, c, g, or t
  modified_base (497)..(497): a, c, t, g, unknown or other
  misc_feature (497)..(497): n is a, c, g, or t
tcagtagtgtagatcacgaccggtgctcgatttagtagtgtagatttgggtctgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatattactgtgtgaaaggctggggatggggggactacgtggggccgagggaaccctggtcaaccgtctcctcagcctccaccaagggcccatcggtctcccctggcaccctctccaagcncacctctcggggcacagcgccctgggctgcctggcaaggactactccatctacnctactgagccggntcggcaaggcgcatagc

SEQ ID NO: 196393 - DNA, 523 bp, Homo sapiens
  misc_feature: GYAE6OF02GJWL4.37.12.B01.1.454.CMB.1.raw
  modified_base (426)..(426): a, c, t, g, unknown or other
  misc_feature (426)..(426): n is a, c, g, or t
  modified_base (523)..(523): a, c, t, g, unknown or other
  misc_feature (523)..(523): n is a, c, g, or t
tcagtagtgtagatcacgaccggtgctcgatttagtagtgtagatttgggtctgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatattactgtgtgaaaggctggggatggggggactacgtggggccagggaaccctggtcaccgtctcctcagcctccaccaagggcccatccggtcttccccctggcacccctccncccaagacgcacctctcggggcacagccggccctgggctcgcctggtcaaggctactccatcctacactactgacgcgggctggcaaggcgcatagn

SEQ ID NO: 196394 - DNA, 517 bp, Homo sapiens
  misc_feature: GYAE6OF02GLDKT.37.12.B01.1.454.CMB.1.raw
  modified_base (236)..(236): a, c, t, g, unknown or other
  misc_feature (236)..(236): n is a, c, g, or t
  modified_base (488)..(488): a, c, t, g, unknown or other
  misc_feature (488)..(488): n is a, c, g, or t
  modified_base (517)..(517): a, c, t, g, unknown or other
  misc_feature (517)..(517): n is a, c, g, or t
tcagtagtgtagatcacgaccggtgctcgatttagtagtgtagatttgggtctgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccggttnaccatctccagagacaattccaagaacacgctctatctgcaaatgaacagcctgagagccgaagacacggccgtatattactgtgtgaaaggctggggatggggggactacgtggggccagggaaccctggtcaccgtctcctcagcctcaccaagggcccatcggtcttcccctggccaccctccctccaagacgcacctctgggggcacagcggccctgggctgcctggtcaaggactactccatctacnctactgagcgggctggcaaggcgcatagn

SEQ ID NO: 196395 - DNA, 498 bp, Homo sapiens
  misc_feature: GYAE6OF02GLPL3.37.12.B01.1.454.CMB.1.raw
  modified_base (414)..(414): a, c, t, g, unknown or other
  misc_feature (414)..(414): n is a, c, g, or t
  modified_base (418)..(418): a, c, t, g, unknown or other
  misc_feature (418)..(418): n is a, c, g, or t
  modified_base (435)..(435): a, c, t, g, unknown or other
  misc_feature (435)..(435): n is a, c, g, or t
tcagtagtgtagatcacgaccggtgctcgatttagtagtgtagatttgggtctgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatattactgtgtgaaaggctggggatggggggactacgtggggccagggaacctggtcaccgtctcctcagcctcaccaaggccatcgtctccctgcacctccncagngcacctctggggcacgngcgccctggctgctgtcaggactactccatctacactactgagcggctcggcaggcgcatagc

SEQ ID NO: 196396 - DNA, 226 bp, Homo sapiens
  misc_feature: GYAE6OF02HPTR5.37.12.B01.1.454.CMB.1.raw
  modified_base (183)..(183): a, c, t, g, unknown or other
  misc_feature (183)..(183): n is a, c, g, or t
  modified_base (185)..(226): a, c, t, g, unknown or other
  misc_feature (185)..(226): n is a, c, g, or t
tcagtagtgtagatcacgaccggtgctcgatttagtagtgtagatttgggtttaggggggggaaaggaggaagactgacggtccccccaggagttcaggtgcgtgggcacaggccggccctgggctgcctgggtcaaggctacttccatctacactactgagcgggctggcaaggcgcatagncnnnnnnnnnnnnnnnnnnnnnnnnnnnnnnnnnnnnnnnnnn

SEQ ID NO: 196397 - DNA, 551 bp, Homo sapiens
  misc_feature: GYAE6OF02GUQXL.37.12.B01.1.454.CMB.1.raw
tcagtagtgtagatcacgaccggtgctcgatttagtagtgtagatttgggtctgggggaggcctggtgcagcctgggggggtccctgagactctcctgtgcagcctctggattaatgttttagcaactctggcatgaactgggcccgccaggctccaggcatggggctgcagtgggtctcaagtactagtgctcctggtaatagagcagactacgcagactccgtgaagggccggttcaccatctccagagacaattccaagaacacgctctatctgcaaaatgaacagcctgagagccgaagacacggccgtatattactgtgtgaaaggctgggggatggggggactagtggggccagggaacctggtcaccgtctcctcacgcctccaccaaacgggcccagtccggtccttccccgtggccacccctcctacccgaagacgccacctcgtgggggccacgacgccggcccgtgggctcggccttcggtcaaacggctacttcccatcctacaactactgacgcgggctaggcgaaggcgcgatagcg

SEQ ID NO: 196398 - DNA, 750 bp, Homo sapiens
  misc_feature: GYAE6OF02IFKFH.37.12.B01.1.454.CMB.1.raw
tcagtagtgtagatcacgaccggtgctcgatttagtagtgtagatttgggtctgggggaggcctggtgcagcctggggggtccctgagactctcctgtgcagcctctggattaatgttttagcaactctggcatgaactgggtccgccaggctccaggcatggggctgcagtgggtctcaagtactagtgctcctggtaatagagcagactacgcagactccgtgaagggccggttcaccatctcagagacaattccaaagaacgccacgtctactactcgtacgaaactaaagtaacgaaacgccgtaccgtaggaacggaaccggaaccggaacgaaccggaccggtaaccgttaatttaacttacgttaggtacggtaaagggaacggtcggggtagggtagggggtacgggggtaactacggggtacgggaccggtaaaccggtaccgtcggtaaccgtaccgttccctccgtacgccgtccctaacccgaacggacccggtacctacggtcccgttcccttcccgcgaccctaccctaccaacgaacgaccgacctaccgtcggggtcggaccacggaccggtcccggtccggtcggtccgtcccggtaccggttacggtaaaccggaaaccggttaacctttacccgttacctaccgtttaacccgtaaccgtaaccgttacggtacgggtaccgggtcccgggtacggtaccgggtaaaccgggaccggccggtactagtacg

SEQ ID NO: 196399 - DNA, 794 bp, Homo sapiens
  misc_feature: GYAE6OF02HHC60.37.12.B01.1.454.CMB.1.raw
  modified_base (189)..(189): a, c, t, g, unknown or other
  misc_feature (189)..(189): n is a, c, g, or t
  modified_base (206)..(206): a, c, t, g, unknown or other
  misc_feature (206)..(206): n is a, c, g, or t
  modified_base (243)..(243): a, c, t, g, unknown or other
  misc_feature (243)..(243): n is a, c, g, or t
  modified_base (792)..(792): a, c, t, g, unknown or other
  misc_feature (792)..(792): n is a, c, g, or t
tcagtagtgtagatcacgaccggtgctcgatttagtagtgtagatttgggtctggggaggccgtggtgcagcctggggggtcccgtggagactctcctgtgcagcctctggtttcatctttagcaactacgccatgagctgggtccgccaggctccagggaagggctggagtgggtctcaggtattacnggtagtggtaataccgnatactacgcagactccgtgacgggcggttcaccgtcncagagacaattccaagacacgctctatctgcaaatgaacagctcgagagaccggaagacgacgaccgtatagtactgtgtagaaaggctaggggagtaggggggactaacggtcggggtccgaacggggtaaccccgtgggtaccgaacccggttctccccgttacgaaccggtcccttaccccgaaaccgtaaacggggacccccgtaagttccccgggtttcccgtttaccccccggttacgggtccccgtaaccccccgttacccccttaccccgaaaccggtaacggacccgtaaaccccgttcggtaccgggggtacccgaaccggtaacccgggccgggtaccccggttcggggaacccggttccggtaccccgggtttacgggtaccccggtaaaacgggtaacccgtttaaacccggtttcccctaaaccgtttaacccgttaaccctaacccgttaaccgttaccggaccgggtaccggggtccgtaccggggtacgaaaccggggtacccggacgtaacgttaacggcgacgcgcgcgntc

SEQ ID NO: 196400 - DNA, 541 bp, Homo sapiens
  misc_feature: GYAE6OF02I3F0D.37.12.B01.1.454.CMB.1.raw
tcagtagtgtagatcacgaccggtgctcgatttagtagtgtagatttgggtctgggggaggcctggtgcagcctggggggtccctgagactctcctgtgcagcctctggattaaatgtttagcaactctggcatgaactgggtccgccaggcttccaggcatggggctgcagtgggtctcaagtactagtgctcctggtaatgagcagactacgcagactccgtgaagggccggttcaccatctccagagacaattccaagaacacgctctatctgcaaatgaacagcctgagagccgaagacacggccgtatattactgtgtgaaaggctaggggatggggggactactggggccagggaaccctggtcaccgtctcctcagcctccaccaagggcccatccggtcttccccctggccaccctcctcccaagacgccaacctctcggggcaccgagccggccctgggcctgcctggtcaacggtactacttccgattctacgacttactgacgcgggctggctaaggccgcacgtagacg

SEQ ID NO: 196401 - DNA, 618 bp, Homo sapiens
  misc_feature: GYAE6OF02GNQB4.37.12.B01.1.454.CMB.1.raw
tcagtagtgtagatcacgaccggtgctcgatttagtagtgtagatttgggtcgtgggggaggcctggtgcagcctggggggtccctgagactctcctgtgcagcctctggattaatgttttagcaactctggcatgaactgggtccgccaggctccaggcatggggctgcagtgggtctcaagtactagtgctccgtggtaatagagcagactacgcagactccgtgaagggccggttcaccatctccagagacaattccaagtaacacgctctatctgcaaatgaacagcctgagagccgaagacacggccgtatattactgtgtgaaaggctggggatgggggactagtggggccagggacctggtcacgtctcctcagcctaccaccgaacgggcccaagtccggtccttcccccgtggccctaccctccctaccaacgacgaccacccgtcgtcggggccaccgacggccggccctacgggcctacggcccgttacgggtccgaaacggtacctaaccgttccgtacgtccgttaaccgtaccgttaccttgggaaccggtccggggtccttacggggaccgtaacgggtccggaacgtacggttaaggaccgg

SEQ ID NO: 196402 - DNA, 598 bp, Homo sapiens
  misc_feature: GYAE6OF02F6OES.37.12.B01.1.454.CMB.1.raw
tcagtagtgtagatcacgaccggtgctcgatttagtagtgtagatttgggtctgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatattactgtgtgaaaggctggggatggggggactacgtggggccagggaaccctggtcaccgtctcctcacgcctccaccaagggcccatcggtccttcccccgtggccaccctccctccaacgcgccacctccgtcgggggccaccgagccgggtacccgtggggcctcggcccgttcgggtccaaacggaaccttaccgttcccgacttacctaaccaaccgttaactcggaacggccggggtcctacggggtaccgaaacggggccgaccgtaagttacggacg

SEQ ID NO: 196403 - DNA, 536 bp, Homo sapiens
  misc_feature: GYAE6OF02FQBAR.37.12.B01.1.454.CMB.1.raw
  modified_base (332)..(332): a, c, t, g, unknown or other
  misc_feature (332)..(332): n is a, c, g, or t
  modified_base (440)..(440): a, c, t, g, unknown or other
  misc_feature (440)..(440): n is a, c, g, or t
  modified_base (536)..(536): a, c, t, g, unknown or other
  misc_feature (536)..(536): n is a, c, g, or t
tcagtagtgtagatcacgaccggtgctcgatttagtagtgtagatttgggtctgggggaggcctggtgcagcctgggggggtccctgagactctcctgtgcagcctctggattaatgttttagcaactctggcatgaactgggtccgccaggctccaggcatggggctgcagtgggtctcaagtactagtgctcctggtaatagagcagactacgcagactccgtgaaggggccggttcaccatctccagagacaattccaagaacacgctctatctgcaaatgaacagcctgagagccgaagacacggccgtatattactgtgtgaaaggntggggagtggggggactacgtggggccgagggaaccctgggtcaccgtctcctcagcctccaccaagggcccatccggtcttcccctggccaccctcctccaacgacnccacctcgtcggggcacgagccggcccgtgggcctgcctggctaacggactactccatctacgctactgagcggcgtggcgaacggcgacgatagn

SEQ ID NO: 196404 - DNA, 620 bp, Homo sapiens
  misc_feature: GYAE6OF02IW6H4.37.12.B01.1.454.CMB.1.raw
tcagtagtgtagatcacgaccggtgctcgatttagtagtgtagatttgggtctgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccggttcaccatctccagagacaattccaaagaacacgctctatctgcaaatgaacagcctgagagccgaagacacggccgtatattactgtgtgaaaggcgtggggatggggggactacgtggggccagggacctggtcaccgtctcctcagccctccaccgaacgggcccagtccggtccttcccccgtgggccacccctccctccgaacgacgccaccgtccgtcgggggcctacgacgtcggtcccgtcgggcctcggtccgttcgggttccgaaacgggtaccctaaccgtttcccgacttacccgttaccgtaaccttaccggttcggaacggtccggggaccgttacggggaccgtaacgggtcccgacgtaacgttaggaccg

SEQ ID NO: 196405 - DNA, 640 bp, Homo sapiens
  misc_feature: GYAE6OF02JYAUE.37.12.B01.1.454.CMB.1.raw
  modified_base (284)..(284): a, c, t, g, unknown or other
  misc_feature (284)..(284): n is a, c, g, or t
tcagtagtgtagatcacgaccggtgctcgatttagtagtgtagatttgggtctgggggaggcctggtgcagcctgggggggtccctgagactctcctgtgcagcctctggattaatgtttagcaactctggcatgaactgggtccgccaggctccaggcagtggggctgcagtgggtctcaagtactagtgctcctggtaatagagcagactacgcaagacctccgtggaacgggccggttcaccatcctccagagacaattccaagaacacgctctatctganaaatgaacagaccgtgagacgaccgaagacgacggcgtatattactgtgtaggaaggcggtaggggagtgggggactacggtggggccgacgggtaccgtgtaccgtacccgtctacccgtcgacgtcctaccgaccgacggacctacgtccggtcccttccccgtagccctacccgtccgtacccaaggtaccgaccgtacccgtcgtcggggaccaccgacgcccggccgtcgggtcctcggacccgttcggaccggtaacgtaccgttaccttaccgactaccgtacctaaccgttaccggtacggtacggccgggtccgttacggacggtaacggaccggtcgtagcgtacg

SEQ ID NO: 196406 - DNA, 601 bp, Homo sapiens
  misc_feature: GYAE6OF02GRRLQ.37.12.B01.1.454.CMB.1.raw
tcagtagtgtagatcacgaccggtgctcgatttagtagtgtagatttgggtctggggggaggcctggtgcagcctgggggggtccctgagactctcctgtgcagcctctggattaaatgtttagcaactctggcatgaactgggtccgccaggctccaggcatggggctgcagtgggtctcaagtactagtgctcctggtaatagagcagactacgcagactccgtgaagggccgttcaccatctccagagacaattccaagaacacgctctatctgcaaatgaacagcctgagagccgaagacacggcgtatatactgtgtgaaaggctaggggatggggggactacgtggggccaagggaacctggtcaaacgtctcctcacgcctccaccgaagggcccaatccggtacttcccccgtggaccaccctcctacccaaaggacgaccacccgtcgtcggggaccacgacgccggaccctggggacctcggacccgtggtaccgaaagggtaccttaacgttccgattacctaacgtaaccttaaccgtaggtacggaccggggtcgtacggtaccgaacgggtcgaccgaagttaggac

SEQ ID NO: 196407 - DNA, 664 bp, Homo sapiens
  misc_feature: GYAE6OF02GTIP3.37.12.B01.1.454.CMB.1.raw
  modified_base (432)..(432): a, c, t, g, unknown or other
  misc_feature (432)..(432): n is a, c, g, or t
tcagtagtgtagatcacgaccggtgctcgatttagtagtgtagatttgggtctgggggaggcctggtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccgttcaccatctccagagacaattccaagaacacgctctaatctgacaaatagaacagcctgagagccgaagacacggcctatattactgtgtagaaaggcgtggggagtgggggactacggtggggaccgagggaacctggtacaacgtcctcctcacgcctcccaaccgaacgggacccctacgtccggtcccttccccncgggacctaccccgtaccctccaacggacgacctaccgtccggtacggggccaaccgacggcccgggtacccggtcgggtccgtcggtacccgttcgggttaaccgaaacgggtacccttaaccgttacccacgttacccgtaacccgtaaccgttaaccgttacgggtaaccggtaccggggtaccgttaccggggaccgtaaaccgggtcccggaacgtacggtacgacg

SEQ ID NO: 196408 - DNA, 785 bp, Homo sapiens
  misc_feature: GYAE6OF02FZOAR.37.12.B01.1.454.CMB.1.raw
  modified_base (205)..(205): a, c, t, g, unknown or other
  misc_feature (205)..(205): n is a, c, g, or t
  modified_base (291)..(291): a, c, t, g, unknown or other
  misc_feature (291)..(291): n is a, c, g, or t
tcagtagtgtagatcacgaccggtgctcgatttagtagtgtagatttgggtctgggggaggcctggtgcagcctgggggggtccctgagactctcctgtgcagcctctggattaatgttttagcaactctggcatgaactgggtccgccaggctccaggcatggggctgcagtgggtctcaagtactagtgctcctggtaatagngcagactacgcagactccgtaggaagggccggttcaccatctccagagacaattccaaagaacacgctctatctgacaaatgaacngccctgagaggaccgaaagacgacggaccgttatatttactgtgtaggaaaggcgtagggggagtggggggactacggtgggggaccgaacgggtacccgttagggtcctaccggttaccctcccgtacgaccgaccctcccaacccggtaaccgggcccctagttacccggtccccctttccccccggtacggtaccccctaaccccgttccccgtaacccgaaacggtacccggaacccgttaacccgttacccggggtcggggggaaccctaacccggacggggcccccggggtaccccgggttcgggggcccgttaccgggtccccgggtttacggggttaacccgaaaccggggttaacccttttacccgttacctaccgtttacccttaaacccgtaacttttaacccggacgggttaaacccgggccgggggttaccggttcggggaacccgggtaaacgggtcccggaaccggttacggtaggacg

SEQ ID NO: 196409 - DNA, 716 bp, Homo sapiens
  misc_feature: GYAE6OF02FUNNT.37.12.B01.1.454.CMB.1.raw
tcagtagtgtagatcacgaccggtgctcgatttagtagtgtagatttgggtctgggggaggcctggtgcagcctgggggggtccctgagactctcctgtgcagcctctggattaatgttttagcaactctggcatgaactgggtccgccaggctccaggcatggggctgcagtgggtctcaagtactagtgctcctggtaatagagcagactacgcagactccgtgaagggccggttcaccatctccagagacaattccaaagaacacgctctatctgacaaatagaacagcctgaggacgaccggaagaccacggccgtatattactgtgtaggaaggtcgtagggggaggtggggggactacggtcggggaccgaacggggaacccgtgggtaccgtacccggtcttccctcgacgtcccctacccgaacccggaacgggccccaacgttcccgggttcccctttcccccggtacggtcccctaccccgtcccctacccgaaacggaccgccccgtaacccgttccgggtcggggggccaaccggaccggcccgggtccccggtcggggccttccggcccgtttcgggtacccgtaaacgggtaaccctttacccgttacccacgtttacccttaaccgtaacccgttaccgtacggaccggggcccggggtaccgttacgggaccggaaccgggtacccgacgtaggtacggc

SEQ ID NO: 196410 - DNA, 582 bp, Homo sapiens
  misc_feature: GYAE6OF02GRCSI.37.12.B01.1.454.CMB.1.raw
  modified_base (216)..(216): a, c, t, g, unknown or other
  misc_feature (216)..(216): n is a, c, g, or t
  modified_base (303)..(303): a, c, t, g, unknown or other
  misc_feature (303)..(303): n is a, c, g, or t
  modified_base (422)..(422): a, c, t, g, unknown or other
  misc_feature (422)..(422): n is a, c, g, or t
tcagtagtgtagatcacgaccggtgctcgatttagtagtgtagatttgggtctgggggaggcctggtgcagcctgggggggtccctgagactctcctgtgcagcctctggattaatgtttagcaactctggcatgaactgggtccgccaggctccaggcatggggctgcagtgggtctcaagtactagtgctcctggtaaatagagcagactacgnagacctccgtgaagggccgttcaccatcctcagagacaattccaagaacacgctctatctgacaaatgaacagcctgagagccgaanacacggccgtatattactgtgtagaaagctggggatggggggactacgtggggaccaagggaaccctggtaccaccgtctcctcacgcctaccacaacggcccagtcggtcttccccgngccaccctcaccaagtacgctacctcgtggggcacgacgccggacccgtggcctggtcccgtaggtaccgaaacggtaccttaccgttccacgtccctaacgaccgttacctagggacgtaccgggcgtacgggacgtaacgggccgtacgagttagacg

SEQ ID NO: 196411 - DNA, 568 bp, Homo sapiens
  misc_feature: GYAE6OF02FLTHF.37.12.B01.1.454.CMB.1.raw
  modified_base (560)..(560): a, c, t, g, unknown or other
  misc_feature (560)..(560): n is a, c, g, or t
tcagtagtgtagatcacgaccggtgctcgatttagtagtgtagatttgggtctgggggaggcctggtgcagcctgggggggtccctgagactctcctgtgcagcctctggattaatgttttagcaactctggcatgaactgggtccgccaggctccaggcatggggctgcagtgggtctcaagtactagtgctcctggtaatagagcagactacgcagactccgtgaagggccggttcaccatctccagagacaattccaagaacacgctctatctgacaaatgaacagcctgagagccgaagacacggccgtatattactgtgtagaaaggcgtggggagtggggggactacggtggggaccagggaacccgtggtaccaccgtcctcctcgacgccctccaaccgaacgggcccacgtccggtccttcccccgtggccctacccctcctccaagacgaccaacgtcgtgggggcaccgacgccggcccgtgggcctcgccttggtcaacggacctacgttccatcctactactactggacgcggcgtcggcgaaggcnctagtagc

SEQ ID NO: 196412 - DNA, 630 bp, Homo sapiens
  misc_feature: GYAE6OF02HU3EU.37.12.B01.1.454.CMB.1.raw
  modified_base (148)..(148): a, c, t, g, unknown or other
  misc_feature (148)..(148): n is a, c, g, or t
  modified_base (183)..(183): a, c, t, g, unknown or other
  misc_feature (183)..(183): n is a, c, g, or t
  modified_base (193)..(193): a, c, t, g, unknown or other
  misc_feature (193)..(193): n is a, c, g, or t
  modified_base (209)..(209): a, c, t, g, unknown or other
  misc_feature (209)..(209): n is a, c, g, or t
  modified_base (253)..(253): a, c, t, g, unknown or other
  misc_feature (253)..(253): n is a, c, g, or t
  modified_base (282)..(282): a, c, t, g, unknown or other
  misc_feature (282)..(282): n is a, c, g, or t
  modified_base (460)..(460): a, c, t, g, unknown or other
  misc_feature (460)..(460): n is a, c, g, or t
tcagtagtgtagatcacgaccggtgctcgatttagtagtgtagatttgggtctgggggaggcctgggtgcagcctgggggggtccctgagactctcctgtgcagcctctggattaatgtttagcaactctggcatgaactgggtcccnccaggcctccaggcagtggggctgcagtgggtctnaagtactagngctcgtagtaatagancagactacgcagacctccggaggaacgggccgttacaccatccncagagacattaccaagaacacgcttctanctagactaaatcgaaacacgtccctaggagtacgaccgaagacacggtctatattactggtgtaggaaggcgtaggggagtcgggggtaactcggtcggggacacggggtaacctggtaccaccgtctacccgtcacgccctaccgaacgaccgggcctagtccggttccctccccgnggacccaccctccgtaacaaggcctccaccgtcggtacgggctaccgacggcccggccgtacgggcttcggccgttacggacgaacgtacctacctacgacgtacctaacctaccgttaacgtcggaggtccgggtactacgggaccgtaaacggccgtactaggtagac

SEQ ID NO: 196413 - DNA, 831 bp, Homo sapiens
  misc_feature: GYAE6OF02J1HLN.37.12.B01.1.454.CMB.1.raw
  modified_base (211)..(211): a, c, t, g, unknown or other
  misc_feature (211)..(211): n is a, c, g, or t
tcagtagtgtagatcacgaccggtgctcgatttagtagtgtagatttgggtctgggggaggcctggtgcagccgtgggggggtccctgagactctcctgtgcagcctctggattaatgtttagcaactctggcatgaacgtgggtccgccaggctccaggcagtggggctgcaggtggtctcgaggtattacgtggtagtggtaataccgnatactacgcagacctccgtggaccgggtccggttcaccgtctccaggacgaacaattaccaagaatacggtctatcaggaaatcgaacacgtaccgtggaaggaacggcccggaacggaccgacccggtacccttacttaacgttacgtggtaggaccgaaggacgtagtaccgaagggaaccggtaagttaacgagccgaagcgaacgcctcgtgtaaccgtacggccgggggacccaaccggggtaacccgtcggtaaccgtcccgttcccgtacccctacgtaccccgtccctaaacccgaaacccgggtaccgtacccggttaccgtttccccggttacccccgttcccgggttccccgtaccccgttacccctaccccggtaacgaaccgggtaccctaccccggttccgggtaccggggttacccgggaacccaccggggaccccgggttccccgggttacccggttcccggtccggtaccccgttaccgggttaaccgtacccgggttaaaccgttcccggtttaaaccccttaccggtacccttaaacccggttaaccttaacccggttacgggaccggtaaccgggtccgggtacccggtaacggaccggg

SEQ ID NO: 196414 - DNA, 804 bp, Homo sapiens
  misc_feature: GYAE6OF02FPTVO.37.12.B01.1.454.CMB.1.raw
tcagtagtgtagatcacgaccggtgctcgatttagtagtgtagatttgggtcgtgggggaggcctggtgcagcctgggggggtccctgagactctcctgtgcagcctctggattaatgtttagctaactctggctagtgaacgttcgggtccgaccagggcctccgaggcagtggggctgcaggttgggtctacgaaagtactagtcgcttccgtggtaaatagacgcaaggtactacgccaagacctccggtagaacggggtcccgttcaaccgtatacctccgaagagacaattaccaaacgaacaacgtctacgtactacgtgaactaaacgttacgaaacctacgaccgtaggaacgaccgacggaaacggacaccgggaccgttaatattacgtgtaggtacgaacggtcggtaggggtaggtcgggggaactacggacggggtaccgaacggggacccgtacggtaccgtaccgtacgtcctacgacgtccccgtaccgaaccgtaaaccggggccctacgttccggttaccccttccccggtacgtacccgtaacccgttcccgaacccgtaaacgggacgacccgttaccggtaccgggtcgggacctaccggtaccggggcccgtacccggtcggggtacccgttcggacccggtttcggtaaaccggaaaccggttaacccttaaccgttcccgtacttcccggtaaccgtaacccgttacggtaccgggaccggtaccgggttaaccggtcgggttaaccgaaccgggtaccgtaccgttaaggccggtaacg

SEQ ID NO: 196415 - DNA, 629 bp, Homo sapiens
  misc_feature: GYAE6OF01EGRJ1.1.27.C05.1.454.CMB.1.raw
  modified_base (579)..(579): a, c, t, g, unknown or other
  misc_feature (579)..(579): n is a, c, g, or t
tcagacgagtgcgtcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggaccgccaccctctcctgcacagccagtcagtctatcgctgacttggttacgcctaggtacccaggcaagaaatcgtcggccacgggcctccccgtaggtttccctacattcctatcgtccgtcgggtccccacgacgggcccacgtcgggccactcccgagaccgtagggttcagggtggaccgtaggtcggggttcgtaggggactaggtacttcgactctactatctaagttgacgagtacgtaggacggtccttaaggaacgttactttcggcttaacggttgttaacgtttacgtgtaccaggtactaggtagttcggtaacgttcaccgttgtacggtcggttaccggaccgtaaaggggacctaagggtaanaaagtaacggaaacgtaacgtggttaccggactacgtaccactgttaccg

SEQ ID NO: 196416 - DNA, 168 bp, Homo sapiens
  misc_feature: GYAE6OF02I5CH5.1.27.C05.1.454.CMB.1.raw
  modified_base (165)..(168): a, c, t, g, unknown or other
  misc_feature (165)..(168): n is a, c, g, or t
tcagacgagtgcgtcacgaccggtgctcgatttagacgcgatcgaaggtttgggcttccctggcgccctgctccaggagcacctccgagagcacagcggccctgggctgcctggtcaaggactacttccacgcactcgtctgagcgggctggcaaggcgcatagnnnn

SEQ ID NO: 196417 - DNA, 172 bp, Homo sapiens
  misc_feature: GYAE6OF02GVPS2.1.27.C05.1.454.CMB.1.raw
  modified_base (169)..(172): a, c, t, g, unknown or other
  misc_feature (169)..(172): n is a, c, g, or t
tcagacgagtgcgtcacgaccggtgctcgatttagacgcgatcgaagggtttggggaagaggaagactgacggtccccaggagttcaggtgctgggcacagcggccctgggctgcctggtcaaggactacttccacgcactctctgagcgggctggcaaggcgcatagnnnn

SEQ ID NO: 196418 - DNA, 187 bp, Homo sapiens
  misc_feature: GYAE6OF02JJE85.1.27.C05.1.454.CMB.1.raw
  modified_base (187)..(187): a, c, t, g, unknown or other
  misc_feature (187)..(187): n is a, c, g, or t
tcagacgagtgcgtcacgaccggtgctcgatttagacgcgatcgaagggtttgggaggggtcaggctggaagctcgctttcggcgggggaccaaggtggcaatcaaacgaactgtggctgcaccatctgtcttcatcttcccgccatctgaacgcactcgtctgagcgggctggcaaggcgcatagn

SEQ ID NO: 196419 - DNA, 853 bp, Homo sapiens
  misc_feature: GYAE6OF01AF2ZS.51.21.B10.1.454.CMB.1.raw
tcagcgatcgtatacacgaccggtgctcgatttagtgtcgtcgcaagaggagagggggtgggtccaggaggcagaacctctcgggtgtctccaccgattggccttggatccctctacttcctccccttcctacactctcgtcgcaccaggtctcgttggacggtcctacctatggtacgtcttgtaactacagcctaccctggtgtcaggtcgtcccaggacaggacggccaggtacgtccaccgttggcctcgtggagagttcgcagttcgaccaaaccgtagtatcgtactttacgttcggtaccagctaagaacgtccggggaccacggccccctgtacgttagggtgtacgttcggtaacgtaaaacggacgtaccgtacggaagggaacgggtccccttacggaaggggtaccgtccccggtaggaacggtaccgtaacgtttaccgtcgttaggtaccttaccgtagggttaccgaagggggtaacctaaaccggggtaccgaaccgttacggtttacgggacccgtaaacggttcggtaacgggtacgggtaacgtttacccgtaacgggaaccggaagggtaacggggtaaccggtaagggtaccgttaacggtaaacgtttaacgtttaacgtttacggttacctaaacgttaccgaaacgtaacgtaaccgtaaccgtaaggtttaccgggttaacttaaacggttcggtttaaccggttaccgggtaaccgtcggtaccgtaaaccggttaacgggtccgttacccggtacggttaacggggaccgtaacgggaaccccgtaacgggtacccccgtaaaccgtccgtgttacccgtaacccg

SEQ ID NO: 196420 - DNA, 768 bp, Homo sapiens
  misc_feature: GYAE6OF01DAO04.51.21.B10.1.454.CMB.1.raw
tcagcgatcgtatacacgaccggtgctcgatttagtgtcgtcgcaagagaggaggggggtgggtccaggaggcagaactctgggtgtctcaccatggcctggatccctctacttctccccctcctcactctctgcacaggctctgacggcctcctatgtgctgacacacgccctacccgtcggtgtccgtcgtccccaggacacggacggccaggactcacctgcctcgtggagatgactattcgacccaacctacttagtttcttaattcggtaccagacgaagaacgccgaacggccgaacggtcccccttggttggttagttggtaactttaattaaagtaaaacggacaccgtaggaacggtacggtacccttacggaacgggaccttcccgtaggacgtacgtacgtttccgtccgtacgggtccctacccgaccgttacggaacgggaactagtcggtacactacgttacgacctacgtacgaggtcggacgtacgacggacgaagaacgacggtacgtcgtacgttaaccgttacgttttctacggtttacctaacgtttaccttacgaacgttaactaacgttacgtaggtttacggtttacttaacgtttcggttacccggttaacggtaaccggacgggtaaccggtaaaccggttcccgtaacccggttacccgtacgggttacccgaaacccgggtacccccgtaaaaccggtaaccccccgtaacccgttacggtacccgttacccgttaccccg

SEQ ID NO: 196421 - DNA, 776 bp, Homo sapiens
  misc_feature: GYAE6OF01ECNMY.51.21.B10.1.454.CMB.1.raw
  modified_base (228)..(228): a, c, t, g, unknown or other
  misc_feature (228)..(228): n is a, c, g, or t
tcagcgatcgtatacacgaccggtgctcgatttagtgtcgtcgcaagagaggaggggggtgggtccaggaggcagaactctgggtgtctcaccatggcctggatccctctacttctccccctcctcactctctgcacaggctctgaggcctcctatgagctgacacacgccaccctcggtgtcagtcgtccccaggacaggcggccaggactccacctgctcgtgganagtgactagttcgaccctaaaaccgtatagtcgtactttagttacggtaccaggacgaaggaacggccggggaccaccgggtcccccgtggttacggtttgggtaggtagttaggttaaacgttaaaacggacgtaaccgtaggaacgggaccgggtccccgttacggaacgggtacctccccgtaggacgtaccgtacttccgttcgtcggtcctaccggtaggtaccggaacgggaaccgtaacgggtcacgtacgttcgacctatacgagtcggacgtaccgagggcaacgggacggaacggacggtactacgggttaactttagtttaacgtttacgtaacttaacgtaccaaacgtaacgtaacccgtaaccgtaagtttacggttaactttacgttcggtttaacccgttacggttaacgtaccggtacccgtaaacggtacgggttccccgttacccggttaccggtcgggtaaccacccggaaccccggtaacccggtaacccccaacccccgtacgttcccgggtaacccttaccccgg

SEQ ID NO: 196422 - DNA, 664 bp, Homo sapiens
  misc_feature: GYAE6OF01CR3IB.51.21.B10.1.454.CMB.1.raw
  modified_base (226)..(226): a, c, t, g, unknown or other
  misc_feature (226)..(226): n is a, c, g, or t
  modified_base (294)..(294): a, c, t, g, unknown or other
  misc_feature (294)..(294): n is a, c, g, or t
  modified_base (507)..(507): a, c, t, g, unknown or other
  misc_feature (507)..(507): n is a, c, g, or t
  modified_base (653)..(653): a, c, t, g, unknown or other
  misc_feature (653)..(653): n is a, c, g, or t
tcagcgatcgtatacacgaccggtgctcgatttagtgtcgtcgcaagagaggaggggggttggtccaggaggcagaactctgggtgtctcaccatggcctggatccctctacttctccccctctcactctctgcacaggctctgacggcctcctatgagctagacacacgccaccctggtgtcagtcgtccccaggacagacggccaggactcactgctcgtgganatcgctaattcgaccaaacgtatatcgtcttatcggtacagacaggacgccggcacgccctgtgttgngtatgtaataacgaccagtagacgacgtcccgtacgacgggtacctccgtgagtccgtacgttcgtcgtacggcctacggacggtacgaaggaaccttaacggactaacgtacgtcggacctataccgtaaggtcggtacgtaccgaacgggacgaacggaagggtacggaaggtactacggtaacttaagttatagtaacaataccgaaacncgaaacctaaccgtacgtttacgtaaacttttgtaccggtttacgtaccgggtaactcggaacccgtaaccggtaacggtccccgtaaccgttcgtaccgggtaaccgaccgtaccccgaaccggtaccccaacccctaggttacncccgttaaccc

SEQ ID NO: 196423 - DNA, 859 bp, Homo sapiens
  misc_feature: GYAE6OF01EWXMF.51.21.B10.1.454.CMB.1.raw
tcagcgatcgtatacacgaccggtgctcgattttagtgtcgtcgcaagaggaggagggggggtgggtccaggaggcagaactctgggtgtctcaccatggcctggactccctctacttcctcccccctcctcacctctctgcacgaggctcgtggacgtccttcctatgagcctagaccaagaccgcccacccgttggtcgtacgacgtccgtacccgaacggaacgacggaccggtacgaacggtacaccgtaccgttcggccttagtagggaattacgtccgtaacgtacgtaaccgaaccctaaaggttattaacgtagttacgtttaacggttacgtaacacgacgaaacggacgaccggactacggtacccgtggttacggtcgtagtaagtaagttaaacaaacgcgaagtcgaacgggtaccgtaccgtagggtaacgtacccgtacgtaacggacgtaaccgttcttaccgtacggtcggtaccgtacggtttaaacggaacgggtaaccggtaaaaccgttaaccgtaaaccgtaacgtttaccgttacgggaaacctttacgtaacgggaaacggtttaccggaacgttaaccggaacgggaacgtaacggggtaaacggacggtaacggtcgttaaaccgttaatttaacggttaactaaggtaaacctaataaaccctaacggccgtaaaaccgtacgtttaaggttaccttaaacgtttccggttacgtaaccgggtttcgaacgtaccggttacccaaacgggttcgtaacccggtacgttaccggtacgtacccgaaccggaacccgttaacccggacctacctaaccgttgaacccgttaccg

SEQ ID NO: 196424 - DNA, 810 bp, Homo sapiens
  misc_feature: GYAE6OF01BVIYC.51.21.B10.1.454.CMB.1.raw
  modified_base (408)..(408): a, c, t, g, unknown or other
  misc_feature (408)..(408): n is a, c, g, or t
  modified_base (726)..(726): a, c, t, g, unknown or other
  misc_feature (726)..(726): n is a, c, g, or t
tcagcgatcgtatacacgaccggtgctcgatttagtgtcgtcgcaagagaggaggggggtgggtccagggaggcagaactcgtgggtgtctcaccatggcctggatcccctctacttcctccccctctcactctctgacacgaggcctcgtgacggcctctatgagctagacacgacgtccctacccgtggtgtaccgacgttccgacccccgaagggaaccgacggacccggtacgaacggtactcccaccgttgaccgttcgagggacacttcggacttactaccgggaaacccaaaaccgttagtagttacgtaccgtttaggttaaccgaccggacgaacgaacggtaacgggcccgggaccgaccggtcccgttaggtggtttaggtagtagtaaccgtaaanaaccgatacgaaggacgttacggaccgtaggaaccggtaccgtcgacggtacgtaccgttaacgttccgtaccggtgtacccgtacgtagggtaaccggaacgggacgtaaaccgttcgaaacggtccgtacggacctacgtacgggaagtaccgggtacggttacggaacggaacggtaagggaacggaacggtaccgtaggttaaccgtaagttagtttaccgaacggtaactaaagaacaaacgttaccgaaacttccggttaaagttcgtactttaggtaaccgtacggtaaccgacgtagacccgggtaaacncccgggttcgcccgtaacggtacccggttacaacccggtaacccgaaacccaccccgtaaccgtcggttccaacccggttaccc

SEQ ID NO: 196425 - DNA, 818 bp, Homo sapiens
  misc_feature: GYAE6OF02HON0N.51.21.B10.1.454.CMB.1.raw
  modified_base (232)..(232): a, c, t, g, unknown or other
  misc_feature (232)..(232): n is a, c, g, or t
  modified_base (235)..(235): a, c, t, g, unknown or other
  misc_feature (235)..(235): n is a, c, g, or t
  modified_base (253)..(253): a, c, t, g, unknown or other
  misc_feature (253)..(253): n is a, c, g, or t
tcagcgatcgtatacacgaccggtgctcgatttagtgtcgtcgcaagaggagaggggggtgggtccaggaggcagaactctgggtgtctcaccatggcctggatccctctacttctccccctcctcactctctgcacaggctctgaggcctcctatgagctagacacagcccacccgtcggtgtcctagtcgtccccgagaccaggacggccaggatcacctgctcgtgganagngcagttcgaccaaacgtntacgtgtcttattcggtacctagacgaagaacggcccgggaccaccgggtccccttagtcggttggtacgtacttaggtaaacgtaaaggaacctacgtacggaggtaccgggtccccgtagaacgggtaccgttcccgtagggaacgtcgtaacgtttccgtacgtccgggacctccggtaacgggttacggaacgggaccgtaaccgggtacctaaccgttacggttacgggacctaacgtaccgtacgggttacgggtaaccggtccgggtaacgggaccggtaaacggggtaacggggtaaccggggtaacggtaccggttaacggtaaccgttttaacgtttaacgtttacggtaaacttaaacgtaaacctaaaacgaacgtaacccgttaacgtaacggtttacgttaaccggtttagttaaccggtttacgttaacgtaaccgttacggtaccgtaaccggttaaccggtcccgtacccggtaccgggttaccggtaccgtacccgacccggaacccgtaaccccggtaacccccgacgttccgtaccgttacccgg

SEQ ID NO: 196426 - DNA, 802 bp, Homo sapiens
  misc_feature: GYAE6OF02JZVMM.51.21.B10.1.454.CMB.1.raw
  modified_base (165)..(165): a, c, t, g, unknown or other
  misc_feature (165)..(165): n is a, c, g, or t
tcagcgatcgtatacacgaccggtgctcgatttagtgtcgtcgcaagaggagaggggggtgggtccaggaggcagaactctgggtgtcgtcaccatcggcctggactccctcctacttctcccctctccactctctgcacaggctctgacggtcctccttatganctcgacacacgcccacccgtcggtcgtcgacgtcgtacccgaggacacggaccgccgaggactccgactcgctcgtaggatagtcgctattaccgaacctaaacgtattacgttaggtacttagttaccggacgaacgacgacggaacggcccggtaccgaaccggtcccgttaggttcggttacggtaacggtagttaacggttaacgaaaacgaccgtaacgtacggaacggtaccgtaccgtacggaacgggtaccttaccggacgtaagtccggtattaccggtacgtcgtaccgtcggaaggtccggaacggtaacgtacggacctaaaccgtgtaccgtacgtatacgggtacgacgggtaacgtaccggaggaccggaaggtacggaaccgtaggtcccgttaaattaccggtttatttaaggttaccaacgtaaccgtaaaccgaacgtaacggtacctaacggttaagtttaccggttaacgtttcggtaaccgtttacgggtacctaacggttaaccggtacgtaaccggttaaccggttccggttaccggtacgtaccgggtaacctacccggaacccgttaacccgggaaccctaccggtaaaccgttccggttaaccgttcccg

SEQ ID NO: 196427 - DNA, 193 bp, Homo sapiens
  misc_feature: GYAE6OF01APOET.1.54.E10.1.454.CMB.1.raw
  modified_base (183)..(193): a, c, t, g, unknown or other
  misc_feature (183)..(193): n is a, c, g, or t
tcagacgagtgcgtcacgaccggtgctcgatttagatcgtagcagaacacacaaagggcagaactttgttacttaaacaccatcctgtttgcttctttcctcaggaactgtggctgcaccatctgtcttcatcttcccgccatctgaacgcactcgtctgagcgggctggcaaggcgcatagnnnnnnnnnnn

SEQ ID NO: 196428 - DNA, 219 bp, Homo sapiens
  misc_feature: GYAE6OF01DVU9F.1.54.E10.1.454.CMB.1.raw
  modified_base (180)..(180): a, c, t, g, unknown or other
  misc_feature (180)..(180): n is a, c, g, or t
  modified_base (207)..(207): a, c, t, g, unknown or other
  misc_feature (207)..(207): n is a, c, g, or t
  modified_base (213)..(219): a, c, t, g, unknown or other
  misc_feature (213)..(219): n is a, c, g, or t
tcagacgagtgcgtcacgaccggtgctcgatttagatcgtagcagtcgcgggggtgagaagggtttttgttcagcaagacaatggagagctctcactgtggtggacgttcggccaagggaccaaggtggaaatcaaacgactgtggctgcaccatctgtcttcatctccgcatctgaacncactcgtctgagcgggctggcaaggcncatagnnnnnnn

SEQ ID NO: 196429 - DNA, 639 bp, Homo sapiens
  misc_feature: GYAE6OF01DJ4B0.1.54.E10.1.454.CMB.1.raw
  modified_base (415)..(415): a, c, t, g, unknown or other
  misc_feature (415)..(415): n is a, c, g, or t
  modified_base (486)..(486): a, c, t, g, unknown or other
  misc_feature (486)..(486): n is a, c, g, or t
  modified_base (495)..(495): a, c, t, g, unknown or other
  misc_feature (495)..(495): n is a, c, g, or t
tcagacgagtgcgtcacgaccggtgctcgatttagatcgtagcagaacacacaaaggggacccaaaaccacacccctccttgggagaatcccctagatcacagctcctcaccatggacgggacctggagcatccttttcttggtggcagcagcaacaggtgcccactcccaggttcacctggtgcagtctggagctgagctgcagaagccgtggggcctcagtgatggtctcctgcagtgctttctggttactattcttttccaccttacggtatgtaattggtgagtacgacgggtacccccggaggaggggtcttggaggtggaacgtgggagtggatcgacgcccgtttaacggaaacttaaaacgaggtacgtagtaggaagaggaacgttcgagggtcaggagtacagtnactcgaccggacggtacaacgactaccgaacggactacgacgaccgtaacagtacggtaactggacggacncctacgtanactacgtagaccgacgaccggtaccctacgttattaccgtaggaccgtaggtacgaacgttagtttagttccgacttaccggtagggttcccgtagggtacctacggtaaacccgtaccggtcgtttagggtccgggtaaccgg

SEQ ID NO: 196430 - DNA, 243 bp, Homo sapiens
  misc_feature: GYAE6OF01CR9S8.1.54.E10.1.454.CMB.1.raw
  modified_base (209)..(209): a, c, t, g, unknown or other
  misc_feature (209)..(209): n is a, c, g, or t
  modified_base (216)..(243): a, c, t, g, unknown or other
  misc_feature (216)..(243): n is a, c, g, or t
tcagacgagtgcgtcacgaccggtgctcgatttagatcgtagcagtcgcggggtgagaaggttttgtcagcaagacaatggagagctctcactgtggtggacgttcggaccaagggacctaaggtggaaatcaaacgaactgtggctagcaccatctgtcttcagtccttccgcatctgaacgcaactcgtctgagcggctggcaaggnctatagnnnnnnnnnnnnnnnnnnnnnnnnnnnn

SEQ ID NO: 196431 - DNA, 1041 bp, Homo sapiens
  misc_feature: GYAE6OF01AIIQZ.1.54.E10.1.454.CMB.1.raw
tcagacgagtgcgtcacgaccggtgctcgatttagatcgtagcagaacacacaaaggggacccaaaaaccacacccctccttgggagaatcccctagactcacagctcctcaccagtggaccgggacctggagctacttccttttcgttggtggcagccagacaacgacggtcgccccacctcccgaaggtttccaccgttgggcgtaccgacgttccggtgggacgtcgtaggacggtctacggacgtaaacggaaccggtcccgggttacgggggcccccttacggtaacgggttggacggtttccggggttcccttcccggtcggtaaccggttagggttccggttacccgtttttccggtttacgggttttaaccttaccttttttacccccgttttaccccgtaacccggttttaaccgggttagttaacggtttaagggtttttcggggtttacggtaaccgggtaaccccggtacccgggggaccccccccggggttaagggggtaaccgggggttccgggttacggttagggttacgggttagggtagggggtagttacgggtaaccgttacgtacccgggttaaaccccggttaaaacggtaaacccgttaaaaacggaggttaacggttaaggtaggggaaacggtaaacggttaaccggttacccggaagggtacgtaaggtacgttacgaacgttccgaacgtacccgaccggtaaccgaccgtaacctacgtaacccgaacggtaccgggtaaactaacccgggtactaaccggtaaacggttaccgggtaaaaccgggtcggtaaacggggtcccctaaccggtaacccggtaagttaccggtttaaccggaccggtaaacccgaccgggttaaccccggttacccgttaacgtttaacccgttacgggtacggtaccggaacgggttaagtaaacggtttacggttacgtccggtaacgttcggttaccggttccgtacgtccgtttaaccgacccggtcgtttcggttcggggcgggttaccggg

SEQ ID NO: 196432 - DNA, 204 bp, Homo sapiens
  misc_feature: GYAE6OF02G5LPD.1.54.E10.1.454.CMB.1.raw
  modified_base (185)..(204): a, c, t, g, unknown or other
  misc_feature (185)..(204): n is a, c, g, or t
tcagacgagtgcgtcacgaccggtgctcgatttagatcgtagcagaacgacgacaaagggcagaactttgttacttaaacaccatcctgtttgcttctttcctcaggaactgtggctgcaccatctgtcttcatcttcccgccatctgaacgcactcgtctgagcgggctggcaaggcgcatagnnnnnnnnnnnnnnnnnnnn

SEQ ID NO: 196433 - DNA, 195 bp, Homo sapiens
  misc_feature: GYAE6OF02HXAFL.1.54.E10.1.454.CMB.1.raw
  modified_base (184)..(195): a, c, t, g, unknown or other
  misc_feature (184)..(195): n is a, c, g, or t
tcagacgagtgcgtcacgaccggtgctcgatttagatcgtagcagaacacgacaaagggcagaactttgttacttaaacaccatcctgtttgcttctttcctcaggaactgtggctgcaccatctgtcttcatcttcccgccatctgaacgcactcgtctgagcgggctggcaaggcgcatagnnnnnnnnnnnn

SEQ ID NO: 196434 - DNA, 219 bp, Homo sapiens
  misc_feature: GYAE6OF02F1HFV.1.54.E10.1.454.CMB.1.raw
  modified_base (216)..(219): a, c, t, g, unknown or other
  misc_feature (216)..(219): n is a, c, g, or t
tcagacgagtgcgtcacgaccggtgctcgatttagatcgtagcagtcgcgggggtgagaagggttttgttcagcaagacaatggagagctctcactgtggtggacgttcggccaagggaccaaggtggaaatcaaacgaactgtggctgcaccatctgtcttcatcttcccgccatctgaacgcactcgtctgagcgggctggcaaggcgcatagnnnn

SEQ ID NO: 196435 - DNA, 219 bp, Homo sapiens
  misc_feature: GYAE6OF02G6OH4.1.54.E10.1.454.CMB.1.raw
  modified_base (216)..(219): a, c, t, g, unknown or other
  misc_feature (216)..(219): n is a, c, g, or t
tcagacgagtgcgtcacgaccggtgctcgatttagatcgtagcagtcgcgggggtgagaagggttttgttcagcaagacaatggagagctctcactgtggtggacgttcggccaagggaccaaggtggaaatcaaacgaactgtggctgcaccatctgtcttcatcttcccgccctcctcacgcactcgtctgagcgggctggcaaggcgcatagnnnn

SEQ ID NO: 196436 - DNA, 190 bp, Homo sapiens
  misc_feature: GYAE6OF02G0VO2.1.54.E10.1.454.CMB.1.raw
  modified_base (183)..(190): a, c, t, g, unknown or other
  misc_feature (183)..(190): n is a, c, g, or t
tcagacgagtgcgtcacgaccggtgctcgatttagatcgtagcagaacacacaaagggcagaactttgttacttaaacaccatcctgtttgcttctttcctcaggaactgtggctgcaccatctgtcttcatcttcccgccctcctcacgcactcgtctgagcgggctggcaaggcgcatagnnnnnnnn

SEQ ID NO: 196437 - DNA, 183 bp, Homo sapiens
  misc_feature: GYAE6OF01ESMI1.14.36.D03.1.454.CMB.1.raw
  modified_base (180)..(183): a, c, t, g, unknown or other
  misc_feature (180)..(183): n is a, c, g, or t
tcagcgtctagtaccacgaccggtgctcgatttagctgcgtcacgatctctcttgggtttgggggaagaggaagactgacggtcccccaggagttcaggtgctgggcacagcggccctgggctgcctggtcaaggactacttccgtactagacgctgagcgggctggcaaggcgcatagnnnn

SEQ ID NO: 196438 - DNA, 237 bp, Homo sapiens
  misc_feature: GYAE6OF01BJ0XC.14.36.D03.1.454.CMB.1.raw
  modified_base (232)..(237): a, c, t, g, unknown or other
  misc_feature (232)..(237): n is a, c, g, or t
tcagcgtctagtaccacgaccggtgctcgatttagctgcgtcacgatctctcttgggctttgatatctgggccaagggacagtggtcaccgtctcttcagcctccaccaagggcccatcggtcttcccctggcaccctcctccaagagcacctctggggcacagcggccctgggctgcctggtcaaggactacttccgtactagacgctgagcggctggcaaggcgcatagnnnnnn

SEQ ID NO: 196439 - DNA, 188 bp, Homo sapiens
  misc_feature: GYAE6OF01BPUOS.14.36.D03.1.454.CMB.1.raw
  modified_base (180)..(188): a, c, t, g, unknown or other
  misc_feature (180)..(188): n is a, c, g, or t
tcagcgtctagtaccacgaccggtgctcgatttagctgcgtcacgatctctcttgggtttgggggaagaggaagactgacggtcccccaggagttcaggtgctgggcacagcggccctgggctgcctggtcaaggactacttccgtactagacgctgagcgggctggcaaggcgcatagnnnnnnnnn

SEQ ID NO: 196440 - DNA, 493 bp, Homo sapiens
  misc_feature: GYAE6OF01DOFY4.14.36.D03.1.454.CMB.1.raw
  modified_base (227)..(227): a, c, t, g, unknown or other
  misc_feature (227)..(227): n is a, c, g, or t
  modified_base (303)..(303): a, c, t, g, unknown or other
  misc_feature (303)..(303): n is a, c, g, or t
tcagcgtctagtaccacgaccggtgctcgatttagctgcgtcacgatctctcttggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtggttataagtatgtctcctggtaccaacaacacccaggcaaagcccccaaatcatgatttangaggtcagtaatcggcctcagggtttctaatcgcttctctggctccaagtctggcaacacggcctccctgaccatctctggctccaggctgaggacgagtctgattattattgcagctcatatgcacctggcagcaatcatgtggtttggcgggggacagggtgaccgtcgtaggtcagccgaaggtccg

SEQ ID NO: 196441 - DNA, 238 bp, Homo sapiens
  misc_feature: GYAE6OF01DTPYC.14.36.D03.1.454.CMB.1.raw
  modified_base (236)..(238): a, c, t, g, unknown or other
  misc_feature (236)..(238): n is a, c, g, or t
tcagcgtctagtaccacgaccggtgctcgatttagctgcgtcacgatctctctggggcttttgatatctggggccaagggacagtggtcaccgtctcttcagcctccaccaagggcccatcggtcttcccctggcaccctcctccaagagcacctctgggggcacagcggccctgggctgcctggtcaaggactacttccgtactagacgctgagcgggctggcaaggcgcatagnnn

SEQ ID NO: 196442 - DNA, 489 bp, Homo sapiens
  misc_feature: GYAE6OF01CLW31.14.36.D03.1.454.CMB.1.raw
  modified_base (228)..(228): a, c, t, g, unknown or other
  misc_feature (228)..(228): n is a, c, g, or t
  modified_base (416)..(416): a, c, t, g, unknown or other
  misc_feature (416)..(416): n is a, c, g, or t
  modified_base (420)..(420): a, c, t, g, unknown or other
  misc_feature (420)..(420): n is a, c, g, or t
tcagcgtctagtaccacgaccggtgctcgatttagctgcgtcacgatctctcttgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtggttataagtatgtctcctggtaccaacaacacccaggcaaagcccccaaactcatgatttatgaggtcagtaatcggcctcagggtttctaatcgcttctctgctccaagtctggcaacacgcctcctgaccatctctgggctcagctgaggacgagtctgattattattgcngctnatatgcactggcagcaatcatgtggtttcggcggggtcaaggtgaccgtctaggtcagcccgaaggtcc

SEQ ID NO: 196443 - DNA, 244 bp, Homo sapiens
  misc_feature: GYAE6OF01B2R7G.14.36.D03.1.454.CMB.1.raw
  modified_base (238)..(244): a, c, t, g, unknown or other
  misc_feature (238)..(244): n is a, c, g, or t
tcagcgtctagtaccacgaccggtgctcgatttagctgcgtcacgatctctcttggggcttttgatatctggggccaagggacagtggtcaccgtctcttcagcctccaccaagggcccatcggtcttccccctggcaccctcctccaagagcacctctgggggcacagcggccctgggctgcctggtcaaggactacttccgtactagacgctgagcgggctggcaaggcgcatagnnnnnnn

SEQ ID NO: 196444 - DNA, 238 bp, Homo sapiens
  misc_feature: GYAE6OF01DS4KJ.14.36.D03.1.454.CMB.1.raw
  modified_base (235)..(238): a, c, t, g, unknown or other
  misc_feature (235)..(238): n is a, c, g, or t
tcagcgtctagtaccacgaccggtgctcgatttagctgcgtcacgatctctcttggggcttttgatatctggggccaagggacagtggtcaccgtctcttcagcctccaccaagggcccatcggtcttcccctggcacctcctccaagagcacctctggggcacagcggccctgggctgcctggtcaaggactacttccgtactagacgctgagcgggctggcaaggcgcatagnnnn

SEQ ID NO: 196445 - DNA, 604 bp, Homo sapiens
  misc_feature: GYAE6OF01BWH00.14.36.D03.1.454.CMB.1.raw
  modified_base (304)..(304): a, c, t, g, unknown or other
  misc_feature (304)..(304): n is a, c, g, or t
tcagcgtctagtaccacgaccggtgctcgatttagctgcgtcacgatctctcttgggggggtctcaggaggcagcgctctcaggacatctccaccatggcctgggctctgctgctcctcacctcctcactcagggcacagggtcctgggcccagtctgccctgactcagcctgcctccgtgtctgggtctcctggacagtcgatcaccatctcctgcactggaaccagcaagtgacgttggtggttataagtatgtctcctggtaccaacaacaccaggcaaacgccccaaatcatgtatttangagtcaagtaatcggcctcgtagggtttctaagtcgacttctcttggctccaagtctggcaacgacggcctcctgaccatctcgtggctcgaggctgacggacgagtctagtattattattgctagtctagtatatcgactaccgttggaccaggacctaagtacgtaagttcgggtttaggggtttttcccggggacgggggggttaacccgtaaacgggggttaccggtaaccccgggtttacccgttaaccggggttacccggtaaccggtaccccgtaaaacggggttcccccggg

SEQ ID NO: 196446 - DNA, 240 bp, Homo sapiens
  misc_feature: GYAE6OF01ECUUL.14.36.D03.1.454.CMB.1.raw
  modified_base (237)..(240): a, c, t, g, unknown or other
  misc_feature (237)..(240): n is a, c, g, or t
tcagcgtctagtaccacgaccggtgctcgatttagctgcgtcacgatctctcttggggcttttgatatctggggccaagggacagtggtcaccgtctcttcagcctccaccaagggcccatcggtcttcccctggcaccctcctccaagagcacctctgggggcacagcggccctgggctgcctggtcaaggactacttccgtactagacgctgagcgggctggcaaggcgcatagnnnn

SEQ ID NO: 196447 - DNA, 511 bp, Homo sapiens
  misc_feature: GYAE6OF01ER8SZ.14.36.D03.1.454.CMB.1.raw
tcagcgtctagtaccacgaccggtgctcgatttagctgcgtcacgatctctcttgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctcctggtaccaacaacacccaggcaaagcccccaaatcatgatttatgaggtcagtaatcggccctcaggggtttctaatcgcttctctggctccaagtctggcaacacggcctccctgaccatctctgggctccaggctgaggacgagtctgatttattattgcagctcatatgcacctggcagcaatcattggtgggttttcgggcgggggtacaagggtgacccgtcgtaggtacacgcccgaaggtcccg

SEQ ID NO: 196448 - DNA, 496 bp, Homo sapiens
  misc_feature: GYAE6OF01ESUAN.14.36.D03.1.454.CMB.1.raw
  modified_base (322)..(322): a, c, t, g, unknown or other
  misc_feature (322)..(322): n is a, c, g, or t
  modified_base (418)..(418): a, c, t, g, unknown or other
  misc_feature (418)..(418): n is a, c, g, or t
tcagcgtctagtaccacgaccggtgctcgatttagctgcgtcacgatctctcttgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctcctggtaccaacaacacccaggcaaagcccccaaatcatgatttatgagtcagtaatcggcctnagggtttctaatcgcttctctggctccaagtctggcacacgcctcctgaccatctctgggctcaggctgagacgagtctgattattattgcagctnatatgcactggcagcaatcattggttggtttcgggcggggtacagggtgacccgtcgtaggtcacgtcccgaggtccg

SEQ ID NO: 196449 - DNA, 530 bp, Homo sapiens
  misc_feature: GYAE6OF01CSDL4.14.36.D03.1.454.CMB.1.raw
  modified_base (270)..(270): a, c, t, g, unknown or other
  misc_feature (270)..(270): n is a, c, g, or t
  modified_base (346)..(346): a, c, t, g, unknown or other
  misc_feature (346)..(346): n is a, c, g, or t
tcagcgtctagtaccacgaccggtgctcgatttagctgcgtcacgatcgtctcgttgggggggtctcaggaggcagcgctctcaggacatctccaccatggcctgggctctgctgctcctcacctctcactcagggcacagggtcctgggcccagtctgccctgactcagcctgcctccgtgtctgggtctcctggacagtcgatcaccatctcctgcactggaaccagcagtgacgttggtggttataagtatgtctcctggtaccaanaacacccaaggcaaaagcccccaaaatcatgatttatgaggtcagtaatcggcctcagggtttctaaatcgcttcnctggctccaagtctggcaacacggcctcctgaccatctctgggctcagctgagacgagtctgattattattgcagctcatatgcacctggcagcaaatcgaagtggtacgggttttcgggacgggggggtaaccctaaagggtcgaaccggtccctaagggttccacggccccgaaaggtcccg

SEQ ID NO: 196450 - DNA, 238 bp, Homo sapiens
  misc_feature: GYAE6OF01CTDPO.14.36.D03.1.454.CMB.1.raw
  modified_base (237)..(238): a, c, t, g, unknown or other
  misc_feature (237)..(238): n is a, c, g, or t
tcagcgtctagtaccacgaccggtgctcgatttagctgcgtcacgatctctcttggggcttttgatatctggggccaagggacagtggtcaccgtctcttcagcctccaccaagggcccatcggtcttcccctggcaccctcctccaagagcacctctgggggcacagcggccctgggctgcctggtcaaggactacttccgtactagacgctgagcgggctggcaaggcgcatagnn

SEQ ID NO: 196451 - DNA, 239 bp, Homo sapiens
  misc_feature: GYAE6OF01CNX2J.14.36.D03.1.454.CMB.1.raw
  modified_base (237)..(239): a, c, t, g, unknown or other
  misc_feature (237)..(239): n is a, c, g, or t
tcagcgtctagtaccacgaccggtgctcgatttagctgcgtcacgatctctcttggggcttttgatatctggggccaagggacagtggtcaccgtctcttcagcctccaccaagggcccatcggtcttcccctggcaccctcctccaagagcacctctgggggcacagcggccctgggctgcctggtcaaggactacttccgtactagacgctgagcgggctggcaaggcgcatagnnn

SEQ ID NO: 196452 - DNA, 181 bp, Homo sapiens
  misc_feature: GYAE6OF01B504Q.14.36.D03.1.454.CMB.1.raw
  modified_base (181)..(181): a, c, t, g, unknown or other
  misc_feature (181)..(181): n is a, c, g, or t
tcagcgtctagtaccacgaccggtgctcgatttagctgcgtcacgatctctcttgggttttgggggaagaggaagactgacggtcccccaggagttcaggtgctgggcacagcggccctgggctgcctggtcaaggactacttccgtactagacgctgagcgggctggcaaggcgcatagn

SEQ ID NO: 196453 - DNA, 182 bp, Homo sapiens
  misc_feature: GYAE6OF01CF1AH.14.36.D03.1.454.CMB.1.raw
  modified_base (182)..(182): a, c, t, g, unknown or other
  misc_feature (182)..(182): n is a, c, g, or t
tcagcgtctagtaccacgaccggtgctcgatttagctgcgtcacgatctctcttgggttttgggggaagaggaagactgacggtccccccaggagttcaggtgctgggcacagcggccctgggctgcctggtcaaggactacttccgtactagacgctgagcgggctggcaaggcgcatagn

SEQ ID NO: 196454 - DNA, 496 bp, Homo sapiens
  misc_feature: GYAE6OF01B1W52.14.36.D03.1.454.CMB.1.raw
tcagcgtctagtaccacgaccggtgctcgatttagctgcgtcacgatctctcttgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctcctggtaccaacacacccaggcaaagcccccaaatcatgatttatgaggtcagtaatcggccctcaggggtttctaatcgcttctctggctcaagtctggcaacacggcctccctgaccatctctgggctccgaggctgaggacgagtctgattattattgcagctcatatgcactggcagcaatcatgtggtttcgggcgggggccaaggtcgaccgtctaggcacgccgaggtccg

SEQ ID NO: 196455 - DNA, 541 bp, Homo sapiens
  misc_feature: GYAE6OF01EHKSN.14.36.D03.1.454.CMB.1.raw
  modified_base (305)..(305): a, c, t, g, unknown or other
  misc_feature (305)..(305): n is a, c, g, or t
tcagcgtctagtaccacgaccggtgctcgatttagctgcgtcacgatctctcttgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctctggtaccaacaacacccaggacaaagcccccaaactcatgatttangagtcagtaatcggcctgtagggtttctaatcgcttctctggctccaagtctgcaacacggtccctcctgacccatcctcgtcgggcctccacggctggacggacgagtctgtatttattatttgctagctacacttagtcgactacctggacagcaaatcgtattggttcgggttttcgggacgggggtaccaagggtcgacccgttcgtacggtacacggtcccgaaggtcccg

SEQ ID NO: 196456 - DNA, 546 bp, Homo sapiens
  misc_feature: GYAE6OF01BLOY9.14.36.D03.1.454.CMB.1.raw
  modified_base (221)..(221): a, c, t, g, unknown or other
  misc_feature (221)..(221): n is a, c, g, or t
  modified_base (230)..(230): a, c, t, g, unknown or other
  misc_feature (230)..(230): n is a, c, g, or t
  modified_base (250)..(250): a, c, t, g, unknown or other
  misc_feature (250)..(250): n is a, c, g, or t
  modified_base (294)..(294): a, c, t, g, unknown or other
  misc_feature (294)..(294): n is a, c, g, or t
  modified_base (350)..(350): a, c, t, g, unknown or other
  misc_feature (350)..(350): n is a, c, g, or t
  modified_base (392)..(392): a, c, t, g, unknown or other
  misc_feature (392)..(392): n is a, c, g, or t
tcagcgtctagtaccacgaccggtgctcgatttagctgcgtcacgatctcggtcttgggggggtctcgaggaggcagcgcgtctcaggacatctccaccgatggcctgggctctgctgctcctcaccctctcactcgagggcacgacgggtcctgggcccagtctgccctgactcacgcctgcctcgtgtctgggtctcgtggacagtcgatcacatctcngcatgaacngcagtgagttgtgtatagtntgtctctagtaccacacaccagactaacgcccaatcatgattangagtcagtagcggtcctgtaggttcatcgtactctcgtgctcgtagtctgacaacncgcctccgtgaccatctcgtcggctcgagcgtagtagtacgngtctagtattatagtgctagctacgtatagtcgtactaccggtcggacgacgtacgtaacgtacgtacggttcggttacgggtttacgggaccgggggtacgtacggtccggtacccgtaccggtacggtaccgaccggtccgaacggtccccg

SEQ ID NO: 196457 - DNA, 522 bp, Homo sapiens
  misc_feature: GYAE6OF01A72H1.14.36.D03.1.454.CMB.1.raw
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctcctggtaccaacaacacccaggcaaagcccccaaactcatgatttatgaggtcagtaatcggccctcgagggtttctaatcgcttctctggctcaagtctggcaacacgcctccctgaccatctcgtggctccgaggctgaggacgagtctgtattattattgcagtctacatatgctaccgtggacagctaatcgagttggttcgggttttcgggcgggggtacacgggtcgacccgtcgtaggtccacgcccgaaggtccg

SEQ ID NO: 196458 - DNA, 489 bp, Homo sapiens
  misc_feature: GYAE6OF01C7ODG.14.36.D03.1.454.CMB.1.raw
  modified_base (477)..(477): a, c, t, g, unknown or other
  misc_feature (477)..(477): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctctgcactggaaccagcagtgacgttggtggttataagtatgtctcctggtaccaacaacacccaggcaaagcccccaaatcatgatttatgaggtcagtaatcggcctcagggtttctaatcgcttctctggctccaagtctggcaacacggcctccctgaccatctctggctccaggctgaggacgagtctgattattattgcagctcatatgcactgcagcaatcatgtggtttcggcgggggacagggtgacgtctagtnacgccgagtccg

SEQ ID NO: 196459 - DNA, 571 bp, Homo sapiens
  misc_feature: GYAE6OF01ERBL9.14.36.D03.1.454.CMB.1.raw
  modified_base (369)..(369): a, c, t, g, unknown or other
  misc_feature (369)..(369): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatcctctgcactggaaccagcagtgacgttggtgttataagtatgtctcctggtaccaacaacaccaggcaaagcccccaaactcatgatttatgagtcagtaatcggcctgagggttctaatcgtcttctctgctcaagtctggcaacacgcctcccngaccatcctcgtcgggcctccgaggtctgggacggacgagtcctgtatttattattcgctagctacattagtcgcctaccgtgaccagcctaatcgtaagttcgggtttagggttttcccgggggacggggggtacctaacggggttacgtaccccgggttaccgtaagggttacccaccgggaccccgtaagggtccccgg

SEQ ID NO: 196460 - DNA, 493 bp, Homo sapiens
  misc_feature: GYAE6OF01CVXTI.14.36.D03.1.454.CMB.1.raw
tcagcgtctagtaccacgaccggtgctcgatttagctgcgtcacgatctctcttgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctcctggtaccaacaacacccaggcaaagcccccaaatcatgatttatgaggtaagtaatcggccctcaggggtttctaatcgcttctctggctcaagtctggcaacacggcctccctgaccatctctggctccaggctgaggacgagtctgattattattgcagctcatatgcacctgcagcaatcatgtggtttcggcgggggacaggtcgacgtcgtaggtcagccagctcccg

SEQ ID NO: 196461 - DNA, 241 bp, Homo sapiens
  misc_feature: GYAE6OF01BYV24.14.36.D03.1.454.CMB.1.raw
  modified_base (238)..(241): a, c, t, g, unknown or other
  misc_feature (238)..(241): n is a, c, g, or t
tcagcgtctagtaccacgaccggtgctcgatttagctgcgtcacgatctctcttggggcttttgatatctggggccaagggacagtggtcaccgtctcttcagcctccaccaagggcccatcggtcttccccctggcaccctcctccaagagcacctctgggggcacagcggccctgggctgcctggtcaaggactacttccgtactagacgctgagcgggctggcaaggcgcatagnnnn

SEQ ID NO: 196462 - DNA, 553 bp, Homo sapiens
  misc_feature: GYAE6OF01C1TWF.14.36.D03.1.454.CMB.1.raw
  modified_base (229)..(229): a, c, t, g, unknown or other
  misc_feature (229)..(229): n is a, c, g, or t
  modified_base (361)..(361): a, c, t, g, unknown or other
  misc_feature (361)..(361): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtggttataagtatgtctcctggtaccaacaacacccaggcaaacgcccccaaaactcatgatttatgagtcagtaatcggcctcgagggtttctaatcgtcttctctggctccaagtcngcaacacggcctccctgaccatcctcgtcggctccgagctagaggacgagtctgactttattattgcagctacatagtcgctaccgtggctagacctaatctagttggttcgggttttcggggacggggggtaccaaggggttacgtacccggttccgtacgggtccgaaccggtcccgaacgggtccccgg

SEQ ID NO: 196463 - DNA, 519 bp, Homo sapiens
  misc_feature: GYAE6OF01DBANZ.14.36.D03.1.454.CMB.1.raw
tcagcgtctagtaccacgaccggtgctcgatttagctgcgtcacgatctctcttggggggggtctcaggaggcagcgctctcaggacatctccaccatggcctgggctctgctgctcctcacctcctcactcaggcacagggtcctgggcccagtctgccctgactcagcctgcctccgtgtctgggtctcctggacagtcgatcaccatctcctgcactggaaccagcagtgacgttggtggttataagtatgtctctggtaccaacaacaccaggcaaacgcccccaaactcatgatttatgaggtcagtaatccggccctcgtagggtttctaatcgtcttctctggctcaagtctggacaacacggcctccctgaccatctcgtgggcctccgaggctaggaggacgagtctgatttattattgcagctacattatcgcactggcagacaatctagtggttgggtttacgggcggggacctaaggtcgaccgttcgtaggcagcccaaggtcccg

SEQ ID NO: 196464 - DNA, 530 bp, Homo sapiens
  misc_feature: GYAE6OF01CWJMI.14.36.D03.1.454.CMB.1.raw
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctcctggtaccaacaacacccaggcaaacgcccccaaactcatgatttatgagtcagtaatcggccctcgagggtttctaatcgcttctctggctcaagtctggcaacacggcctcctgaccatcctcgtcgggcctccgaggctggaggacgagtctagtatttattattgcagtctctatacgtgcacgtggcagacaatctagttggttcgggtttcggggacgggggtacaagggtcgaccgttccgtaggtcacgcccgaaggtcccg

SEQ ID NO: 196465 - DNA, 522 bp, Homo sapiens
  misc_feature: GYAE6OF01E4YWX.14.36.D03.1.454.CMB.1.raw
  modified_base (368)..(368): a, c, t, g, unknown or other
  misc_feature (368)..(368): n is a, c, g, or t
  modified_base (437)..(437): a, c, t, g, unknown or other
  misc_feature (437)..(437): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctcctggtaccaacaacacccagcaaacgccccaaactcatgatttatgagtcagtaatcggcctcgtagggtttctaatcgtcttctctggctcctaagtctggacaacncggcctccctgaccatctcgtgggcctccgaggctgaggacgtagtctgtaattattattgcagtctanatagtcgcactgacagcaatcagttggttcgggttgggacgggggacagggtcgtaccgtcgtaggccgacgcccgaaggtcccg

SEQ ID NO: 196466 - DNA, 524 bp, Homo sapiens
  misc_feature: GYAE6OF01EDAQN.14.36.D03.1.454.CMB.1.raw
  modified_base (229)..(229): a, c, t, g, unknown or other
  misc_feature (229)..(229): n is a, c, g, or t
  modified_base (299)..(299): a, c, t, g, unknown or other
  misc_feature (299)..(299): n is a, c, g, or t
  modified_base (441)..(441): a, c, t, g, unknown or other
  misc_feature (441)..(441): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtggttataagtatgtctctgtacaacacaccagcaaacgccccaaatcatgatttangaggtcagtaatcggccctcgagggtttctaatcgtcttctctggctccaagtctggcaacgccggccctcccgtgaccattcctcgtgggcctccgaggcctggacggacgtagtctgtatttattattgcagcttacatntgccaccgtggcagcaatcagttggttgggtttcggggcggggtacagggtcgaccgtcgtacggcacggcccgaaggtcccg

SEQ ID NO: 196467 - DNA, 540 bp, Homo sapiens
  misc_feature: GYAE6OF01AW5CP.14.36.D03.1.454.CMB.1.raw
  modified_base (229)..(229): a, c, t, g, unknown or other
  misc_feature (229)..(229): n is a, c, g, or t
  modified_base (360)..(360): a, c, t, g, unknown or other
  misc_feature (360)..(360): n is a, c, g, or t
tcagcgtctagtaccacgaccggtgctcgatttagctgcgtcacgatctctcttggggggggtctcaggaggcagcgctctcaggacatctccaccatggcctaggctctgctgctcctcaccctcctcactcagggcacagggtcctgggcccagtctgccctgactcagcctgcctccgtgtctgggtctcctggacagtcgatcaccatctcctgcactggaaccngcagtgacgttggtgttataagtatgtctcctgtaccaacaacaccaggacaacgcccccaaatcatgatttatgaggtcagtaatcggccctgagggtttctaatcgcttctctgctcaagtctgcaacncgcctcctgaccatctcgtcgggcctcgaggctggacggacgagtctgtattattattgacagctatatatcgctaccgtggaccagacaacgtctagttggtttcgggggtttccgggaccggggggtaccgtaagggtccgtacccggtcgtaggtaccgaccgcccgaacggtcccg

SEQ ID NO: 196468 - DNA, 565 bp, Homo sapiens
  misc_feature: GYAE6OF01DZO5A.14.36.D03.1.454.CMB.1.raw
  modified_base (229)..(229): a, c, t, g, unknown or other
  misc_feature (229)..(229): n is a, c, g, or t
  modified_base (356)..(356): a, c, t, g, unknown or other
  misc_feature (356)..(356): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtgttataagtatgtctcctgtaccaacaacaccaggcaaacgcccccaaatcatgatttatgagtcagtaatcggcctcgtagggtttctaatcgtcttctctggctcaagtcnggcaacgacggcctccctgaccatcctcgtgggctccgaggctggacggacgtagtctagtactttattattgcagtctacattagtcgtaccacgtggcagactaatcgtagttcgggttcgggttttaccggggacggggggtaacctaacggggttcgaacccggttccgtaacgggtaccgaacggtccccgtaacgggtccccg

SEQ ID NO: 196469 - DNA, 242 bp, Homo sapiens
  misc_feature: GYAE6OF01B79EO.14.36.D03.1.454.CMB.1.raw
  modified_base (237)..(242): a, c, t, g, unknown or other
  misc_feature (237)..(242): n is a, c, g, or t
tcagcgtctagtaccacgaccggtgctcgatttagctgcgtcacgatctctcttggggcttttgatatctggggccaagggacagtggtcaccgtctcttcagcctccaccaagggcccatcggtcttcccctggcaccctcctccaagagcacctctgggggcacagcggccctgggctgcctggtcaaggactacttccgtactagacgctgagcgggctggcaaggcgcatagnnnnnn

SEQ ID NO: 196470 - DNA, 573 bp, Homo sapiens
  misc_feature: GYAE6OF01BQ2PD.14.36.D03.1.454.CMB.1.raw
  modified_base (307)..(307): a, c, t, g, unknown or other
  misc_feature (307)..(307): n is a, c, g, or t
  modified_base (362)..(362): a, c, t, g, unknown or other
  misc_feature (362)..(362): n is a, c, g, or t
tcagcgtctagtaccacgaccggtgctcgatttagctgcgtcacgatctctcttgggggggggtctcaggaggcagcgctctcaggacatctccaccatggcctgggctctgctgctcctcaccctcctcactcagggcacagggtcctgggcccagtctgccctgactcagcctgcctccgtgtctgggtctccgtggacagtcgatcaccatctcctgcactggaaccagcagtgacgttggtggttataagtatgtctctgtaccaacaacacccaggcaaacgaccccaaactcatgatttangagtcaagtaatcgcctcgtagggttctaatcgcttctctgctcagtctgacacnccgcctccctcgaccatctcgtcggcctccgaggctaggaggacgagttctagtatttatttagttcgactacgtctactatagtcgacctaccgtggacaacgtctaaattcgagtttgggttcgggtttccgggggacgggggtaaccgtaagggtccggtacccggttccggtacggtaccgaaccggtaccccggaagggtccccgg

SEQ ID NO: 196471 - DNA, 686 bp, Homo sapiens
  misc_feature: GYAE6OF01EA2T5.14.36.D03.1.454.CMB.1.raw
  modified_base (230)..(230): a, c, t, g, unknown or other
  misc_feature (230)..(230): n is a, c, g, or t
tcagcgtctagtaccacgaccggtgctcgatttagctgcgtcacgatctctcgttgggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcaccatctcctgcactggaaccngcagtgacgttggtgttataagtatgtctctgtaaccaacaacaccaggacaaacgcccccaaatcatgtatttagtgagtcaagtaatccggtcctgtagggtttactaatcgtcttctcgtggctcctaagtcgtaggaccaacgacccggtccctacccgtcgaaccctacgtccttcgtcgggtcctccgaaggtcgtagggacggtacgtacgttcgttagtaatttatttacgttgactagtccttacattaacgtccgaccttaaccggtggacctaagtaccgtaaacgtttccgtaaggtttcggggttttacggggtttttacccgggggggaacccgggggggttaaacccgtaaacgggggtttccccgggtaaacccgggtttccccggttaacggggttacccgaacccgggttaacccccggtaaacggggttccccccgg

SEQ ID NO: 196472 - DNA, 739 bp, Homo sapiens
  misc_feature: GYAE6OF01DP2U8.14.36.D03.1.454.CMB.1.raw
  modified_base (183)..(183): a, c, t, g, unknown or other
  misc_feature (183)..(183): n is a, c, g, or t
  modified_base (234)..(234): a, c, t, g, unknown or other
  misc_feature (234)..(234): n is a, c, g, or t
tcagcgtctagtaccacgaccggtgctcgatttagctgcgtcacgatctctcgttggggggggtctcaggaggcagcgctctcaggacatctccaccatggcctgggctctgctgctcctcaccctcctcactcagggcacgagggtcctgggcccagtctgccctgactcagcctgcctcgngtcgtgggtctcgtggacagtcgatcaactgtcctctgcacgtaggaaccngctagtggacgttggtaggttataagtatgtctctacgtaaccaacaccaaccgaggaaccaaaacgaccccaaacttcaatagttatttagtagaggtacgaagtaacgtccggtccgtagtaggggtttactaactcgtctttcgcgttacggctacgtaacgtcgtacggacctaacgacccggtcctacccgtacgtacctacgtctcggtcggtccgtacgtcgggacgtacggaacgggacgtacgttacgttacggttaatttaagtttacgttagtaccgtacggtaccttaacgtacgttaacgtccggtaaccgtacccggttacggaacggtaaccggaaacttaaaccggttagtaacgggttttaccgggtttacgggggtttttacccgggggaacccgggggggtaacgttaaacccggggtaccgggttaaccccggtacccggtaacggtacccggtaacccggtaaccccgggtaaggtacccccgg

SEQ ID NO: 196473 - DNA, 244 bp, Homo sapiens
  misc_feature: GYAE6OF01B9XV1.14.36.D03.1.454.CMB.1.raw
  modified_base (237)..(244): a, c, t, g, unknown or other
  misc_feature (237)..(244): n is a, c, g, or t
tcagcgtctagtaccacgaccggtgctcgatttagctgcgtcacgatctctcttggggcttttgatatctggggccaagggacagtggtcaccgtctcttcagcctccaccaagggcccatcggtcttcccctggcaccctcctccaagagcacctctgggggcacagcggccctgggctgcctggtcaaggactacttccgtactagacgctgagcgggctggcaaggcgcatagnnnnnnnn

SEQ ID NO: 196474 - DNA, 538 bp, Homo sapiens
  misc_feature: GYAE6OF01AS7HZ.14.36.D03.1.454.CMB.1.raw
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctctgtaccaacaacaccaggcaaacgcccccaaactcatgatttatgaggtcagtaatccggcctcgtaggggtttctaatcgtcttctctggctccaagtctgcaacacggcctccctgaccatctcgtcgggctcccgaggctggacggacgtagttctgtattatttattgcagtctactatatcgccaccgtggacagtcaatcagttggttgggtttcggggacgggggtacctaagggtcgacccgtcgtacggtccgacgcccgacggtcccg

SEQ ID NO: 196475 - DNA, 515 bp, Homo sapiens
  misc_feature: GYAE6OF01EC8HV.14.36.D03.1.454.CMB.1.raw
  modified_base (305)..(305): a, c, t, g, unknown or other
  misc_feature (305)..(305): n is a, c, g, or t
  modified_base (373)..(373): a, c, t, g, unknown or other
  misc_feature (373)..(373): n is a, c, g, or t
tcagcgtctagtaccacgaccggtgctcgatttagctgcgtcacgatctctcttgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcacgtggaaccagcagtgacgttggtgttataagtatgtctctggtaccaacaacacccaggcaaacgcccccaaactcatgatttangagtcagtaatcgcctcgagggtttctaatcgcttctctggctccaagtctggcaacacggcctcccngaccatcctcgtggtcctccaggtctaggacgacgagtctgtagttattattgcagctctatatcgctacgtgcagactaatcagttggtcggttttcgggacgggggacaaggtcgaccgtcagtcacgcccgaggtcccg

SEQ ID NO: 196476 - DNA, 506 bp, Homo sapiens
  misc_feature: GYAE6OF01AM29G.14.36.D03.1.454.CMB.1.raw
tcagcgtctagtaccacgaccggtgctcgatttagctgcgtcacgatctctcttgggggggtctcaggaggcagcgctctcaggacatctccaccatggcctgggctctgctgctcctcaccctcctcactcagggcacagggtcctggacccagtctgccctgactcagcctgcctccgtgtctgggtctcctggacagtcgatcaccatctcctgcactggaaccagcagtgacgttggtggtataagtatgtctcctggtaccaacaacacccagcaaacgcccccaaactcatgatttatgagtcagtaatcggccctgagggtttctaatcgcttctctgctcagtctggcaacacggcctcctgaccatctctcgggctccaggctgaggacgagtctgtattattatgctagctcatatgccacgtggcagcatcagttggtggttttcgggcgggggtaccagggtcgaccgtccgtaggtacacgccgaacggtccg

SEQ ID NO: 196477 - DNA, 612 bp, Homo sapiens
  misc_feature: GYAE6OF01BMSYG.14.36.D03.1.454.CMB.1.raw
  modified_base (306)..(306): a, c, t, g, unknown or other
  misc_feature (306)..(306): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctcctgtaccaacacacccaggacaaacgcccccaaactcatgatttangagtcaataatcggcctgaggtatttctaatcgtcttctctcggctaccaagtctcggacaaccgccggtccctcccgtgacgcctagtcctcgtcgggcctccgacggtctaggagggacggaggtcgtagtaatttattaccgtgacgtacgtcgtactaacttagttaaccttagttacgactaacggtaacgttggtttacgggttttcgggacggggtaacgggtaacccggtaagggttaccggtacccggttaccgttacgggtacccacggtaccccgaagggtcccgtacccccggg

SEQ ID NO: 196478 - DNA, 597 bp, Homo sapiens
  misc_feature: GYAE6OF01EVSEF.14.36.D03.1.454.CMB.1.raw
  modified_base (229)..(229): a, c, t, g, unknown or other
  misc_feature (229)..(229): n is a, c, g, or t
  modified_base (307)..(307): a, c, t, g, unknown or other
  misc_feature (307)..(307): n is a, c, g, or t
  modified_base (456)..(456): a, c, t, g, unknown or other
  misc_feature (456)..(456): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtgttataagtatgtctcctggtaccaacaacacccaggacaaacgcccccaaatcatgtatttangagtcagtaatccgcctgtagggttctaatcgtcttctctacggctccaagtctcggacaaccgcgccctaccctgacctactcctcgtgggcctccgacggtctaggacggacgtacgtctagtaactttatttagttgcagtcctanagttacgtcgcctacgtcggacgacgtactaatccgtagttacgggtttcggggttttaccgggggaccgggggtaaccgtaaaggggtccgtaacccggttccggaacggttaccgaccggtaccccgaagggttccccg

SEQ ID NO: 196479 - DNA, 717 bp, Homo sapiens
  misc_feature: GYAE6OF01C4HSL.14.36.D03.1.454.CMB.1.raw
  modified_base (271)..(271): a, c, t, g, unknown or other
  misc_feature (271)..(271): n is a, c, g, or t
tcagcgtctagtaccacgaccggtgctcgatttagctgcgtcacgatctctcgttggggggggtctcaggaggcagcgctctcaggacatctccaccatggcctgggctctgctgctcctcaccctcctcactcagggcacagggtcctgggcccagtctgccctgactcagcctgcctccgtgtcgtgggtctccgtggacagtcgatcaccatcctcctgcactggaaccagcagtgacgttggtgtatagtatgtctctagtaccaanaaccaccaggacaaacgccccaaatcatatatttatgacgtacagtaactccggccgttacggtacgggtttactaagtccgtctttctcgtcggtccctaccaacgttcgtacggaccaaaccggaccggtcccctacccgtacgtaaccctacttcccgttaccggtcgggtcccttacccggtacgggtcgttaacgggaacgggtaccgtaggttaccgttaggttaactttaacggtttacgtacgaccgtacgtaccttacgtaattaacgttaacttaacgtttaacgaccgtaaacggttaaccggtttgggtttaccggggttttaccggggacggggtaaccgggtaaaccggttaaggggtacccgtacccggttaccgtaacggttaccgaacccggtacccgaagggtcccctccccggtccccgttacccgg

SEQ ID NO: 196480 - DNA, 241 bp, Homo sapiens; identical to SEQ ID NO: 196461
  misc_feature: GYAE6OF01BY3A5.14.36.D03.1.454.CMB.1.raw
  modified_base (238)..(241): a, c, t, g, unknown or other
  misc_feature (238)..(241): n is a, c, g, or t

SEQ ID NO: 196481 - DNA, 604 bp, Homo sapiens
  misc_feature: GYAE6OF01A79X7.14.36.D03.1.454.CMB.1.raw
  modified_base (275)..(275): a, c, t, g, unknown or other
  misc_feature (275)..(275): n is a, c, g, or t
  modified_base (308)..(308): a, c, t, g, unknown or other
  misc_feature (308)..(308): n is a, c, g, or t
  modified_base (313)..(313): a, c, t, g, unknown or other
  misc_feature (313)..(313): n is a, c, g, or t
  modified_base (324)..(324): a, c, t, g, unknown or other
  misc_feature (324)..(324): n is a, c, g, or t
  modified_base (340)..(340): a, c, t, g, unknown or other
  misc_feature (340)..(340): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggctacagggtcctgggcccagtctgccctgactcagcctgcctccgtgtctgggtctcctggacagtcgatccacctatcctcctgcacgtggaaccaggtagtgacgttgttattattaattttgtctctgtaccaangcaccaggacaaacgcccccaaatcattattangagtnaatatcgcctnaggtattctaatcgtnttctctgctcagtctgcaacaccggtcctcctgagcattctcgtcgggcctccgaggtctggaacggacgtaggcctagtatttactactgacagtctatattacttaactattacgactagtaaccgttggtttacgggtttaccgggacgggtaacgggtaaccgtaaggggttaccggttacccggttacccgttaagggtacccgtaaccggtaccccggaacgggtccccttccccgggtacccccccggttacccggg

SEQ ID NO: 196482 - DNA, 554 bp, Homo sapiens
  misc_feature: GYAE6OF01A2MF4.14.36.D03.1.454.CMB.1.raw
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctccctccgcgtccgggtctcctggacagtcagtcaccatatcctgcactggaaccagcagtgacgttggtgcttataactttgtctcctggtaccaacagcacccaggcaaacgcccccaaactcatgatttatgacgtcaataagccggcccgtcggggtcctgatcgcttctctgctccaagtctggcaacgacgcctccctgaccgtctcgtcgggctccgaggctgacgatggagtctgtatttattactgcagctcacagtgcagtcaagttaacgttacggtttcggggtttcggcgggtaacgggaaccgaagtcgtacggacccgttaccgtaagtccgacgacccgaagggccctccggcccccgttaccgg

SEQ ID NO: 196483 - DNA, 524 bp, Homo sapiens
  misc_feature: GYAE6OF01A7C80.14.36.D03.1.454.CMB.1.raw
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctcctggtaccaacaacacccaggcaaagcccccaaactcatgatttatgaggtcagtaaatcggccctcaggggtttctaatcgcttctctggctccaagtctggcaacacggcctccctgaccatctcgtgggcctcccgaggctgacggacgagtctgtattatttattgcagctacatatcgacaccgtggcagcaatcagttggtggttttcgggcgggggtaccaagggtgaccgtcgtacggtcacgcccgaaggtcccg

SEQ ID NO: 196484 - DNA, 625 bp, Homo sapiens
  misc_feature: GYAE6OF01DG1OQ.14.36.D03.1.454.CMB.1.raw
  modified_base (231)..(231): a, c, t, g, unknown or other
  misc_feature (231)..(231): n is a, c, g, or t
  modified_base (300)..(300): a, c, t, g, unknown or other
  misc_feature (300)..(300): n is a, c, g, or t
tcagcgtctagtaccacgaccggtgctcgatttagctgcgtcacgatctctcgttggggggggtctcaggaggcagcgctctcaggacatctccaccatggcctgggctctgctgctcctcaccctcctcactcagggcacgagggtcctgggcccagtctgccctgactcagcctgcctccgtgtctgggtctccgtggacagtcgatcaccatctctgcactggaaccngcagtgacgttggtgttatagtatgtctctgtaccaacacaccagacaacgccccaatcatgtatttanagagtactagtaactccggcctgtagggtttctaatcgtcttctcgtgctcagtcgtgacacaccggtccctcccgtcgacctattccgtcgtcggtcctacccgaggctaggaggaccgtagttcgtagtatttagttacttgaccagtcctactattacgtcgaccctacgttacggacaacggtactaaagttccttaagggtttccggggttttccgggggttttccggggaacccgggggggtacccgttaaacggggtacccggttacccgggttacccgtacgggtacccacccgggtacccggacggttacccccgg

SEQ ID NO: 196485 - DNA, 533 bp, Homo sapiens
  misc_feature: GYAE6OF01DM1Y0.14.36.D03.1.454.CMB.1.raw
  modified_base (231)..(231): a, c, t, g, unknown or other
  misc_feature (231)..(231): n is a, c, g, or t
  modified_base (305)..(305): a, c, t, g, unknown or other
  misc_feature (305)..(305): n is a, c, g, or t
  modified_base (396)..(396): a, c, t, g, unknown or other
  misc_feature (396)..(396): n is a, c, g, or t
  modified_base (434)..(434): a, c, t, g, unknown or other
  misc_feature (434)..(434): n is a, c, g, or t
tcagcgtctagtaccacgaccggtgctcgatttagctgcgtcacgatctctcgttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatcctcctgcactggaaccngcagtgacgttggtggttataagtatgtctctggtaccaacaacaccaggcaaagcccccaaatcatgatttangagtcagtaatcgcctcgagggtttcaatcgcttctctggctccaagtctggacaacacggcctccctgaccatcctacgtgggcctccgnggctggacggacgagtctagatttattattgctagctnatatgctacgtggacagctaatcgtagttggttcgggtttcggggccgggggtaactagggtcgtaccggtccgtaggtccacgcccgtaaggtccccg

SEQ ID NO: 196486 - DNA, 715 bp, Homo sapiens
  misc_feature: GYAE6OF01DPS6A.14.36.D03.1.454.CMB.1.raw
  modified_base (686)..(686): a, c, t, g, unknown or other
  misc_feature (686)..(686): n is a, c, g, or t
tcagcgtctagtaccacgaccggtgctcgatttagctgcgtcacgatctctcgttggggggggtctcaggaggcagcgctctcaggacatctccaccatggcctgggctctgctgctcctcaccctcctcactcagggcacgagggtcctgggcccagtctgccctgactcagcctgcctccgtgtcgtgggtctccgtggacagtcatccaccatctcctgcacgtacggaaccagcagtgtacgttggtaggttaataagtatgtcctcgtacggtaaccaacgaaccacccgaaggaacccaaaaccgacccccaaaactccaatagtatttaagtggaagtcaagtaacgtccggcccgtacggtagggtttactaacgtcgtcttcgtcgtcggcctactaaggtctaggaccaacgaccggccctaccgtcgactactccgtcgtcgggtcctacgaggtccgtaggaacggtacgtacgttacgttaggttaactttaagtttagttacggactacggttcctaactaacgttacgtacgtaccctacggtaccggacgtaacgaccgtaaacgttcctaagggttttccgggggtttcggggttttaacccggggggacccgggggtaaaccgttacggggtacccggtaacccggttaccggttaacgggtaacccnccgggttaacccggtaacggtcccccggg

SEQ ID NO: 196487 - DNA, 790 bp, Homo sapiens
  misc_feature: GYAE6OF01D7KCB.14.36.D03.1.454.CMB.1.raw
  modified_base (233)..(233): a, c, t, g, unknown or other
  misc_feature (233)..(233): n is a, c, g, or t
tcagcgtctagtaccacgaccggtgctcgatttagctgcgtcacgatctctcgttggggggggtctcaggaggcagcgctctcaggacatctccaccatggcctgggctctgctgctcctcaccctcctcactcagggcacagggtcctgggcccagtctgccctgactcagcctgcctcgtgtcgtgggtctcctggacagtcgatcacctatctcctgcacgtaggaaccngcgagtgtacggttggtggttaataagtatcgtctcgtacgtaaccaacaaccaccgagacaaaccgaccccaaactcagtgtattatgtagtataagtaacgtccgtccgtagtacggttactaacgtcgtcttcgtcgtgtctacgtaagtcgtacggaccaaccgtaccggtcccctaccgtaccgtaacccgtacttcccgtaccggtcgggtacccttacccgtacgggtaccttaggggaaccgggtaccgttacgttacgtttagttaactttttaacgtttacgttacgtaccgtacggttaccttaacgtaacttaccgttccggtaaccgttacccgtacgggaccgtaacggtaccttaaacgttccgtaagggtttttcgggggtttttaaccggggggttttacccgggggggaacccgggggggttaaaccccgggttaaagggggttacccccggtttaaacccccgggttacccggttttaaaccggggaccccgtaaccccgggggttaaaccccccggaaggggttacccccccccggg

SEQ ID NO: 196488 - DNA, 720 bp, Homo sapiens
  misc_feature: GYAE6OF01AQ9RU.14.36.D03.1.454.CMB.1.raw
  modified_base (213)..(213): a, c, t, g, unknown or other
  misc_feature (213)..(213): n is a, c, g, or t
  modified_base (223)..(223): a, c, t, g, unknown or other
  misc_feature (223)..(223): n is a, c, g, or t
  modified_base (243)..(243): a, c, t, g, unknown or other
  misc_feature (243)..(243): n is a, c, g, or t
  modified_base (276)..(276): a, c, t, g, unknown or other
  misc_feature (276)..(276): n is a, c, g, or t
  modified_base (479)..(479): a, c, t, g, unknown or other
  misc_feature (479)..(479): n is a, c, g, or t
tcagcgtctagtaccacgaccggtgctcgatttagctgcgtcacgattcgttcggtcgttgggggggggtctcaggaggcagcgctctcaggacatctccaccatggcctgggctctgctgctcctccaccctcctcactcagggcacgagggtcctgggtccctagtctagtccctgactcagcctgcctcgtgtcgtggtctcgtggacgngtcgatcacntctcctgcacgtcggaaccngtcgtagtcgtacggttggttcgttaataagtntcgtctccgtaggtaaccaactaaccaccgacgaccaaaccgacccccaaagtcagtacgtatttagcggtacggtacaacggttaacgtcccggtaccgttacggtacgggtttactaacgttcgtacttcgtcgtacgtcttaacgacgttcgtacgaccaacggccgtcctccgtacgactacgtcgtcgtacggtcccncgtacggacgtacgggaacgtacgtaacgttacgtaagttaacttttattacgtacgtaacgcgttacaacgttactacggttccgacccgttacggtcggactacggtaacgtaacttccggtaacgggttttcgggtttaccggggtttaccgggggaacccggggttaacttaccggggtacccggttacccggttacgggtacggaccgaacccggtcccggacgggttacccccgg

SEQ ID NO: 196489 - DNA, 540 bp, Homo sapiens
  misc_feature: GYAE6OF01D0NZI.14.36.D03.1.454.CMB.1.raw
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctcctggtaccaacaacaccagcaaacgccccaaatcatgatttatgagtcagtaactccggcctcgtagggtttctaagtcgtcttctctggctccagtctgcaacgccggcctccctgacctatcctcgtgggcctccgaggctggacggacgtagtctagtatttattattgctagctactattatcgactaccgtggacagactaatcctagttcggttcgggtttcggggacggggtaccaagggtcgaccgtcgtaggtcacgtcccgaaggtcccg

SEQ ID NO: 196490 - DNA, 674 bp, Homo sapiens
  misc_feature: GYAE6OF01D5ROP.14.36.D03.1.454.CMB.1.raw
  modified_base (304)..(304): a, c, t, g, unknown or other
  misc_feature (304)..(304): n is a, c, g, or t
tcagcgtctagtaccacgaccggtgctcgatttagctgcgtcacgatctctcgttggggggggtctcaggaggcagcgctctcaggacatctccaccatggcctgggctctgctgctcctcaccctcctcactcaggcacagggtcctgggcccagtctgccctgactcagcctgcctcgtgtctgggtctcctggacagtcgatccaccatctcctgcactggaaccagcagtgacgttggtgttataagtatgtctcgtgtaccaacaacaccaggacaaacgccccaaatcatgtatttangagtacagtacgtccgcctgtagggtttcatcgtcttctcgtggctcgaagtcgtggacaacgccggtcctaccctgaccctacttccgtcgtcgggaccctcggaggtccgtaggacggtacgagttctagtaatttacttagttcgactagtccttacgattacgtcgtaccgtaaccggttgggaccttaaggaaccgtaaacgttaccggttagggtttaccggggttttacgggggttttaccccggggggaaccgggggggttaaacccgttaaaccgggggttcccggtaaaccccccgggtttcgggttaaacccggggttaccctaaacccgggccccgggttaaacgggtcccccccggg

SEQ ID NO: 196491 - DNA, 609 bp, Homo sapiens
  misc_feature: GYAE6OF01DRL2L.14.36.D03.1.454.CMB.1.raw
  modified_base (211)..(211): a, c, t, g, unknown or other
  misc_feature (211)..(211): n is a, c, g, or t
  modified_base (252)..(252): a, c, t, g, unknown or other
  misc_feature (252)..(252): n is a, c, g, or t
tcagcgtctagtaccacgaccggtgctcgatttagctgcgtcacgatctctcgttggggggggtctcaggaggcagcgctctcaggacatctccaccatggcctgggctctgctgctcctcaccctcctcactcagggcacagggtcctgggcccagtctcgccctgactcagcctgcctcgtgtctgggtctcctggacagtcgatcacntctcctgcactggaaccagcagtgacgttggtgttatagtntgtctctagtaccaacaacaccagacaaacgaccccaatcatgtatttatgagtcagtactccgcctcgtagggttactactcgtcttctcgtcggtctacgtaagtcgtcggaccaaccgtaccggtccctacccgtacgacctacgtccttcgtcgggccctacggaggtaccgtaggtacgggtacgtagtacgtagtatttattacgttgacgagtcctacgtagttacgtacgccgtacgtggccgaactacgtaatcgtaggttcggggtttcgggttaaccggggggacggggtaacgtacgggtaccgtaccggtaccgttacgggacacccggccgtacgggtccccg

SEQ ID NO: 196492 - DNA, 576 bp, Homo sapiens
  misc_feature: GYAE6OF01A4270.14.36.D03.1.454.CMB.1.raw
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctcctggtaccaacaacacccaggcaaacgcccccaaatccatgtatttatgaggtctagtaatcggccctcgtagggtttctaatcgcttctctggctcaagtctgcaacaccggcctccctgaccatctcgtcgggctccgacgctaggacggacgagttctagtatttattagttgactagtctactataatcgacgaccgtggaccagccgaattcgagttcggttcgggttttaccgggggacgggggtaacccgagggttacggtaaccccggttaccgtaacgggtaccaccggcccgtaaacgggtcccgg

SEQ ID NO: 196493 - DNA, 623 bp, Homo sapiens
  misc_feature: GYAE6OF01COD5W.14.36.D03.1.454.CMB.1.raw
  modified_base (211)..(211): a, c, t, g, unknown or other
  misc_feature (211)..(211): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccntcctcctgcactggaaccagcagtgacgttggtggttataagtatgtctcctggtaccaacaacaccaggcaaacgcccccaaatcatgatttatgagtcagtaatcggcctcgagggtttctaatcgtcttctctggctcaagtctgacaacgacgccctcctgaccatctcgtcggctccgaggctggaggacgtagtctagtatttagtttattcgtacagtaccttactaattaacgtcgtacctacccgttgggcctaaggcctaaaattccgtaagtttacggggttttccgggggtttttaccgggggaacccggggggggttaaacccaaacggggttccgggtaaccccggttcccggtaaacggttcccggaacccggtccccggtaaacgggtcccccggg

SEQ ID NO: 196494 - DNA, 605 bp, Homo sapiens
  misc_feature: GYAE6OF01BBI4N.14.36.D03.1.454.CMB.1.raw
  modified_base (202)..(202): a, c, t, g, unknown or other
  misc_feature (202)..(202): n is a, c, g, or t
  modified_base (350)..(350): a, c, t, g, unknown or other
  misc_feature (350)..(350): n is a, c, g, or t
  modified_base (370)..(370): a, c, t, g, unknown or other
  misc_feature (370)..(370): n is a, c, g, or t
  modified_base (390)..(390): a, c, t, g, unknown or other
  misc_feature (390)..(390): n is a, c, g, or t
tcagcgtctagtaccacgaccggtgctcgatttagctgcgtcacgatctctcgttgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacngtcgatcaccatctcctgcactggaaccagcagtgacgttggtgttataagtatgtctctgtaaccaacaaccacccaggcaaagcctacccaaactcatgatttatgagtcagtaactcggccctcgagggttctaatcgtcttctntcggctcaagtctgacaacncgcctcctgacctatctcgngggtcctcgaggctggacggacgtagtcgtagtatttatttatgctagtcctactattacgttcgaccaccggttcggaacctacgaactaacgttaccgtaagtttcgggtttggggttttacccgggggaagggggggtaccccgttaaaggggttcccgtacccgggtttaccggtaacgggttaccgaaccgggaccccggtaaaccgggg

SEQ ID NO: 196495 - DNA, 608 bp, Homo sapiens
  misc_feature: GYAE6OF01DD9IV.14.36.D03.1.454.CMB.1.raw
  modified_base (229)..(229): a, c, t, g, unknown or other
  misc_feature (229)..(229): n is a, c, g, or t
tcagcgtctagtaccacgaccggtgctcgatttagctgcgtcacgatctctcgttggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcaccatctcctgcactggaaccngcagtgacgttggtggttataagtatgtctctgtacaacaacaccaggacaaacgaccccaaatcatgatttatgaggtacagtaactccggcctcgtagggtttactaatcgtcttctctgctcaagtctacggacaacgaccggtccctacccgtgaacctatctaccgtgggcctccgaggcgtaggacggacgtagtctagtatttattattgctagtctactatactcgacctaccgtggtacagtacctaatcctaaggttcgggtttacgggggtttaccggggaccgggggggtaaacctaacggggttaccggtaaccccggttaccggtaaacgggttaccgaacccggacccggtaacgggtcccccg

SEQ ID NO: 196496 - DNA, 628 bp, Homo sapiens
  misc_feature: GYAE6OF01B4EZ6.14.36.D03.1.454.CMB.1.raw
  modified_base (227)..(227): a, c, t, g, unknown or other
  misc_feature (227)..(227): n is a, c, g, or t
  modified_base (295)..(295): a, c, t, g, unknown or other
  misc_feature (295)..(295): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctctgcactgaaccngcagtgacgttgtggttataagtatgtctctgtacaacacaccaggcaacgcccaactcatgatttangagtcagtaatcgcctgtagggttctaagtcgtcttctactgctaccagtcgtgacaacgccggtcctcctacgacctactctccgtacggcttcccgaggtctacggaggtacgacgttcttagtactttagtttagttgtacctaagtccttaccgtaataacgttcggaccttaccgtacgggctacggacctaaagtccgtaagttcgggttcggggttttacccgggggacgggggggtaaccctaaagggggtttaccggaaaccccgggttaccggttaaccgggttaccggtaacccggtacccggtaaccgggttacccccggg

SEQ ID NO: 196497 - DNA, 546 bp, Homo sapiens
  misc_feature: GYAE6OF01DM8R0.14.36.D03.1.454.CMB.1.raw
  modified_base (306)..(306): a, c, t, g, unknown or other
  misc_feature (306)..(306): n is a, c, g, or t
  modified_base (368)..(368): a, c, t, g, unknown or other
  misc_feature (368)..(368): n is a, c, g, or t
  modified_base (380)..(380): a, c, t, g, unknown or other
  misc_feature (380)..(380): n is a, c, g, or t
  modified_base (399)..(399): a, c, t, g, unknown or other
  misc_feature (399)..(399): n is a, c, g, or t
  modified_base (429)..(429): a, c, t, g, unknown or other
  misc_feature (429)..(429): n is a, c, g, or t
  modified_base (453)..(453): a, c, t, g, unknown or other
  misc_feature (453)..(453): n is a, c, g, or t
tcagcgtctagtaccacgaccggtgctcgatttagctgcgtcacgatctctcttgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttaataagtatgtctcctggtaccaacaacaccaggcaaacgccccaaatcatgatttangaggtacagtaatcggccctgagggtttcaatcgtcttctctggctccaagtctcggcaacnccggcctccctnaccatcctcgtggctccgngcgtggagacgagtctgtattattatgacngtctacatatgacctctaggcaanaccaatccgtagttcggtcgggttttacggggcggggggtaaccagggttcggaacccgttccgtaaggtccgaacggtcccgaggtccccgg

SEQ ID NO: 196498 - DNA, 764 bp, Homo sapiens
  misc_feature: GYAE6OF01C4FNI.14.36.D03.1.454.CMB.1.raw
  modified_base (342)..(342): a, c, t, g, unknown or other
  misc_feature (342)..(342): n is a, c, g, or t
tcagcgtctagtaccacgaccggtgctcgatttagctgcgtcacgatctctcgttggggggggtctcaggaggcagcgctctcaggacatctccaccatggcctgggctctgctgctcctcaccctcctcactcagggcacgagggtcctgggcccagtctgccctgactcagcctcgcctcgtgtcgtgggtctccgtggacagtcgatcaccatcctcctgccacgtcggaaaccagtcaggttggacggtttggttaggttaattaaggtatcgttctaccgtacggtaacccaacaaccacccaggaccaaaccgacccccaaatcatagtatttagngacgtacagttaacgtccggaccgttacggtagggtttacctaagttccgtctttccgtcgttcggtcccttaccggtaaagttccgtacggggaaccaaaccggtaccggtccccttaccccgtagaacccgttacttccgttacggttccgggtccctaccggacgggtacgttagggaccgggtaacgtacggttcttaacggtattttaacttttagtacggtactacgtacttacgtaataacgtcgaccgtaccgttagggcctaacggaaccttaagtaccgttaggttacggggttttccgggggtttaccggggggaaccggggggttaaccgaacgggggttacccggtaaccccggttacccgggttaacgggtacccggtaaccgggtacccgaacggggttacccccgg

SEQ ID NO: 196499 - DNA, 569 bp, Homo sapiens
  misc_feature: GYAE6OF01AKDFO.14.36.D03.1.454.CMB.1.raw
  modified_base (375)..(375): a, c, t, g, unknown or other
  misc_feature (375)..(375): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctcctggtaccaacaacaccagcaaacgcccccaaactcatgtatttatgaggtacagtaactcggcccttcgtaggggtttctaagtcgtcttctctggtctcctaagtctgcaacncggtccctccctacgacctatcctcgtcgggctccgaggctaggacggtacgagttctagtatttattattgcagctacattatcgcctaccgtggactacgactaactcgtagttcggtttgggtttccggggacggggggtaccaaggggttcgacccggttcgtacggtaccgacgcccggaacggtcccg

SEQ ID NO: 196500 - DNA, 809 bp, Homo sapiens
  misc_feature: GYAE6OF01CK54J.14.36.D03.1.454.CMB.1.raw
tcagcgtctagtaccacgaccggtgctcgatttagctgcgtcacgatctctcgttggggggggtctcaggaggcagcgctctcaggacatctccaccatggcctgggctctgctgctcctccaccctcctcactcgagggcacgagggtcctgggcccagtctcgccctgactcacgcctcgcctccgtgtcgtcgggtcctccgtggacagtacgactcaacctatccgtcctcgcaccgtacggaaccaggacgtaggttcgtaggtttgggttaggtttaagttaagtattcggttaccgttaccgtacggtaacccaaaccgaaacccgaaccccggaacggaacccaaaacccggaacccccctaaaaactccgtaagttacggttaacttttaacgtacggtaacggttaactaaacggttaaacggtcccggtcccgttacggttaaggggttttacctaaacgtccgttcctttccgttcgtaccggtacctaaccgtaagttccgttacgaccgtaaccgacccggtacccttccgtagaccctacgttccgtccggtcggtaccgtacgacggtctaacgggacgacgtacgttacgttgtaaatttgtaacgttgacgtacgtccaacttacgtaacgtccgtaacccgtcggttagacctaaggaccttagtaccgttaagggtttcggggtttaccggggttaacggggacccgggggtaaccgttaaccggggtacccgggttaccgtacccggttaagggtaccccaacgggttaccccggacgttcccccggg

SEQ ID NO: 196501 - DNA, 574 bp, Homo sapiens
  misc_feature: GYAE6OF01DIXQE.14.36.D03.1.454.CMB.1.raw
  modified_base (309)..(309): a, c, t, g, unknown or other
  misc_feature (309)..(309): n is a, c, g, or t
  modified_base (381)..(381): a, c, t, g, unknown or other
  misc_feature (381)..(381): n is a, c, g, or t
  modified_base (396)..(396): a, c, t, g, unknown or other
  misc_feature (396)..(396): n is a, c, g, or t
tcagcgtctagtaccacgaccggtgctcgatttagctgcgtcacgatctctcgttggggggggtctcaggaggcagcgctctcaggacatctccaccatggcctgggctctgctgctcctcatcctcctcactcagggcacagggtcctgggcccagtctgccctgactcagcctgcctccgtgtctgggtctcctggacagtcgatccaccatcctcctgccactggaaccagcaggtgacgttggtgttataagtatgtctcctgtaaccaacaacaccaggacaaacgaccccaatcatgatttangagtcagtaactccggccctgtaaggggtttctaagtcgtacttctctaggtctacctaagtctggacaacnccggcctcctgaccnttctctgggctccgaggtcgtggacggacgacgttcgtagtattttatattgcgtagtctctatagtcgactaccgtgaccgagacaactcgtaggttggttccggggtttcggggacgggggtaaccgtaacgggtcgtaacccggttccggtaggtacccgcggcccgtaaccggg

SEQ ID NO: 196502 - DNA, 685 bp, Homo sapiens
  misc_feature: GYAE6OF01CTZUY.14.36.D03.1.454.CMB.1.raw
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacgagggtcctgggcccagtctgccctgactcagcctgcctccgtgtctgggtctccgtggacagtcgatcaccatctcctgcacgtggaaccagcagtgacgttggtgttataagtatgtctcctggtaccaacaacaccgaggacaaacgacccccaaatcatcgtatttatgaggtacaagtactccggccctgtagggtttctagtcgtcttctcgtgctaccgaagtctggacaacgccggtccctccctcgaaccctacttcctaccgtcgggtcctccgacggtcgtacggacggaccgtacgttcgttacgttaatttatttacgttcgaccgtacggttcctacgtaacgttaacgtcggtaccctaaccgttcgggacctaacgtaccgtaaattccgttaggtttcggggttttcgggggtttttacccggggggaccgggggggttaaacccgttaacgggggtacccggttaaccccgggttaccggttaaaccgggtccgtaacccggggaccccgtaaagggttccccccgg

SEQ ID NO: 196503 - DNA, 618 bp, Homo sapiens
  misc_feature: GYAE6OF01CFTLF.14.36.D03.1.454.CMB.1.raw
  modified_base (303)..(303): a, c, t, g, unknown or other
  misc_feature (303)..(303): n is a, c, g, or t
  modified_base (310)..(310): a, c, t, g, unknown or other
  misc_feature (310)..(310): n is a, c, g, or t
tcagcgtctagtaccacgaccggtgctcgatttagctgcgtcacgatctctcgttggggggggtctcaggaggcagcgctctcaggacatctccaccatggcctgggctctgctgctcctcaccctcctcactcagggcacagggtcctgggcccagtctgccctgactcagcctgcctccgtgtcgtgggtcctcctggacagtcgatcacctatctcctgcactggaaccagcagtgtacgttggtaggttataagtatgtctctagtaccaacaccaccagacaaacgcccaaactcatntattagngagtcagtagtcgtacctgtacgggttctagtcgtcttctcgtagcctacgtaagtcgtacggacaaccgccggtcccttacccgcgacctacttccgtcgtcggtccgtaccgacggtcgtaggaggtacggtacgttaccgtagttatttagttattcgacgtacgtacctacgtactacgtcgaccgtactacggacaacgtataacgtctaggttcgggtttacgggttaccggggacggggtaaccgagggttaccggtaccgttaccggtacggtaccggaccggtcccgtaaaggtccccg

SEQ ID NO: 196504 - DNA, 553 bp, Homo sapiens
  misc_feature: GYAE6OF01EEVBL.14.36.D03.1.454.CMB.1.raw
  modified_base (229)..(229): a, c, t, g, unknown or other
  misc_feature (229)..(229): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtgttataagtatgtctcctggtaccaacaacacccaggacaaacgcccccaaactcatgtatttatgagtcagtaatcggcctcgtagggtttctaatcgtcttctcgtgctaccgaagtctggacaacgccggtccctccctgaccattcctcgtcgggcctcccgaggtctaggacgtagtggaggtctagtatttattactgcagctcatatgactagtactaagtaacgtaggtttcggggttcggacgggtacgggacacggtctacgtaccgtacgtaagccacggcccaaggtccctaccccgg

SEQ ID NO: 196505 - DNA, 526 bp, Homo sapiens
  misc_feature: GYAE6OF01AKWDT.14.36.D03.1.454.CMB.1.raw
  modified_base (371)..(371): a, c, t, g, unknown or other
  misc_feature (371)..(371): n is a, c, g, or t
  modified_base (447)..(447): a, c, t, g, unknown or other
  misc_feature (447)..(447): n is a, c, g, or t
  modified_base (511)..(511): a, c, t, g, unknown or other
  misc_feature (511)..(511): n is a, c, g, or t
tcagcgtctagtaccacgaccggtgctcgatttagctgcgtcacgatctctcttgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctcctgtaccaacaacacccaggcaaacgcccccaaactcatgatttatgaggtcagtaactcggccctcgtaggggtttctaagtcgcttctctggcctccgagtctgccaacncggtcctccctcgacctactctcgtcgggctcccgaggctagaggacgtagttctgtattattatgcagctacatntgcacgtgcagcatcagtgttcggtttcgggcggggtacagggtcgtaccgtccgtaggacccncgcccgtaggtcccg

SEQ ID NO: 196506 - DNA, 562 bp, Homo sapiens
  misc_feature: GYAE6OF01C72B6.14.36.D03.1.454.CMB.1.raw
  modified_base (362)..(362): a, c, t, g, unknown or other
  misc_feature (362)..(362): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctggacccagtctgccctgactcagcctgcctccgtgtctgggtctcctggacagtcgatcaccatctcctgcactggaaccagcagtgacgttggtggttataagtatgtctctagtaccaacaacaccagacaaacgccccaaatcatgatttatgagtacagtaactccggcctgtagggtttactaagtcgtcttctctcgctaccaagtcncggacaacgcggccctccctgacctatcctcgtggcctcgaggctaggaggacgagtcgtgtatttatttagtgtcagtcttacattagtcgacctacggtcggcaaggtactaactcgtaaggttcgggtttcggggtttcggggacgggggtacctaagggtcgtacccgtcgtacgtaccgacgcccgaggtccccg

SEQ ID NO: 196507 - DNA, 746 bp, Homo sapiens
  misc_feature: GYAE6OF01DN8FD.14.36.D03.1.454.CMB.1.raw
  modified_base (212)..(212): a, c, t, g, unknown or other
  misc_feature (212)..(212): n is a, c, g, or t
  modified_base (225)..(225): a, c, t, g, unknown or other
  misc_feature (225)..(225): n is a, c, g, or t
  modified_base (248)..(248): a, c, t, g, unknown or other
  misc_feature (248)..(248): n is a, c, g, or t
  modified_base (277)..(277): a, c, t, g, unknown or other
  misc_feature (277)..(277): n is a, c, g, or t
  modified_base (350)..(350): a, c, t, g, unknown or other
  misc_feature (350)..(350): n is a, c, g, or t
tcagcgtctagtaccacgaccggtgctcgatttagctgcgtcacgatctctcgttggggggggtctcaggaggcagcgctctcaggacatctccaccatggcctgggctctgctgcctcctccaccctcctcactcgagggcacgagggtccgtgggcccagtcctcgccctgacctcacgcctcgcctccgtgtcgtcggtctcgtggacngtcgataccactntcctcgcgactacgtacgaaccngcgagtggtacgttggtagttaagtagtntcgtctaccgtacgtaaccaacaccaccgaaggaccctaaaccgacccctaactgtactagttagtttacggngtaacgtacgtaagttaccgtccggtaccgttcggtaaggtttacacgttcttacttcgtacgtcggtctacggtacgtcggtacgacctaaccggtacccgtcccttaccgacgtaaccctcttccgtccggtaacgggcccttacggacggtcgtaaacggtacggtacgtacgttcgttagttaacttttagtacgtactcgaactccgttaatacgttcgaccggtccgtaacggttgaaccctagaccgttaagttcccggtttaaggggttccggggttttaccggggttaacccgggggacggggtttaaaccccgtagggtaccccgggttacccgttaacgggttaccggaacccggtaccgggtaccccgtacgggttcccccggg

SEQ ID NO: 196508 - DNA, 791 bp, Homo sapiens
  misc_feature: GYAE6OF01AC97G.14.36.D03.1.454.CMB.1.raw
  modified_base (241)..(241): a, c, t, g, unknown or other
  misc_feature (241)..(241): n is a, c, g, or t
  modified_base (269)..(269): a, c, t, g, unknown or other
  misc_feature (269)..(269): n is a, c, g, or t
  modified_base (285)..(285): a, c, t, g, unknown or other
  misc_feature (285)..(285): n is a, c, g, or t
tcagcgtctagtaccacgaccggtgctcgatttagctgcgtcacgatctctcttggggggtcgtcaggaggcagcgctctcaggacatctccaccatggcctgggctctgctgctcctcacctcctcgacctcgagggcacacgggtcctgggcccagtctcgccctagactcacgcctgccctccgtgtctgggtctcctggaacagtccgatccaccatcctctcgacacgtggaaccnggccagtgaccgttggtggtataaggtntgtctcgtgtaccaanaccaccgtagaccaaacggccccctaaaactcaactggtaacttttacagggacggttacaaggttaactcccgggtcccctaggtacggggtttacaaacgtcgtccttcgtaccgtggtacctaccgaaggttcgtacggacaaaacccgccgggtcccctaccccgttaagtaaccccgtagttcccgttaccgtacgggtcccgtacccgtaacgggttccaacggggttaacggaccgtacggttacccgtagtttaaaccgtttaacggttttctttacggtaccggaacggttcccttaaccgttacggttaaattacccgggtcttaaacccgggttccgtaaccggaacggttaaccaaacctttcgtaaacggtttcgggttttaaacgggtttttcccggggggaaccgggggtacggtaaacccgggtttacgttacccggggtaaccccttaggggttacccggtaacccggaacccggtcccgggtacccgg

SEQ ID NO: 196509 - DNA, 563 bp, Homo sapiens
  misc_feature: GYAE6OF01CEM6Q.14.36.D03.1.454.CMB.1.raw
  modified_base (229)..(229): a, c, t, g, unknown or other
  misc_feature (229)..(229): n is a, c, g, or t
  modified_base (304)..(304): a, c, t, g, unknown or other
  misc_feature (304)..(304): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtggttataagtatgtctcctggtacaacaacaccaggacaacgccccaaactcatgatttangagtcagtaatccggcctcgtagggtttactaatccgtcttctctggctccaagtctggacaacgaccgcctccctgacctatcctcgtgggcctccgaggctggacggacgacgtctagtatttatttagtcgatacgtctacattatcgactccgtggacaggactaatcgtagttcggttcgggtttcggggaccgggggtaaccgtaagggtccgtacccgttccgtacggttaccacggtacccgaggtccccg

SEQ ID NO: 196510 - DNA, 613 bp, Homo sapiens
  misc_feature: GYAE6OF01D3S8X.14.36.D03.1.454.CMB.1.raw
  modified_base (199)..(199): a, c, t, g, unknown or other
  misc_feature (199)..(199): n is a, c, g, or t
  modified_base (251)..(251): a, c, t, g, unknown or other
  misc_feature (251)..(251): n is a, c, g, or t
  modified_base (294)..(294): a, c, t, g, unknown or other
  misc_feature (294)..(294): n is a, c, g, or t
tcagcgtctagtaccacgaccggtgctcgatttagctgcgtcacgatctctcttgggggggggtctcaggaggcagcgctctcaggacatctccaccatggcctgggctctgctgctcctcaccctcctcactcagggcacagggtcctgggcccagtctgccctgactcagcctgcctcgtgtctgggtctctggacngtcgatcaccatctctgcacgtggaccagcagtgacgttgtgttatagtatntctctgtacaacacaccagacaacgccccaatcatgtatttangagtcagtactcgcctcgtagggttactatcgtctctcgtggctacgtagtctcggacacgcggccctaccctgactactctcgtcggcctcgagtcgaggtacggacgtagtctagtagtttattacgtcgacacgtcttactacgttacgtacgaccgtccggtaggacctagtaacctaattacgtacggtttcggggttttcgggggtttaccgggggacccggggggttaaccgtaaacggggtttaccgggtaaccccgggttacccggttacgggtaccgtacccgggtaccccggtaacgggtccccccgg

SEQ ID NO: 196511 - DNA, 244 bp, Homo sapiens
  misc_feature: GYAE6OF01DUC6X.14.36.D03.1.454.CMB.1.raw
  modified_base (237)..(244): a, c, t, g, unknown or other
  misc_feature (237)..(244): n is a, c, g, or t
tcagcgtctagtaccacgaccggtgctcgatttagctgcgtcacgatctctcttgggcttttgatatctggggccaagggacagtggtcaccgtctcttcagcctccaccaagggcccatcggtcttccccctggcaccctcctccaagagcacctctgggggcacagcggccctgggctgcctggtcaaggactacttccgtactagacgctgagcgggctggcaaggcgcatagnnnnnnnn

SEQ ID NO: 196512 - DNA, 844 bp, Homo sapiens
  misc_feature: GYAE6OF01D9RAS.14.36.D03.1.454.CMB.1.raw
tcagcgtctagtaccacgaccggtgctcgatttagctgcgtcacgatctctcgttggggggggtctcaggaggcagcgctctcaggacatctccaccatggcctgggctctgctgctcctcaccctcctcactcagggcacgagggtcctgggcccagtctcgccctgactcacgcctgcctccgtgtcgtcgggtctcgtggacagtcgatcaccatcctcctgaccacgtcggaaccagcgtaggtggtacggtttgggttaggttaattaagtagtgttccttacgtacggtaaccaacaaccaccgacggaaccaaaccgaccccgaaactcacgttagttaactttagtacggtacgtacgtaagttaaccgttccgggtcccttacgggttacggggtttacctaacgttccgttactttcgtacgttcggtacctaccgtaacggtcgtacgggacctaaccggtacccggtcccttcccgtacgacccttacgttccgtccggtacgggtccctacggtaggccgttacgggaacggtacgtaacggttccgttaagtttacgtttaactttacggttacgtaccgttagtccctttacgttaacgttaccggttactccccgttaacggttccgggaacccgttagtaaacccgtaacggttttaccgttaggggttttacccgggggttttttacccgggggggttaccggggggggtaacccgggggttaaacccggtttaaacccgggggttccccgggttaacccggggttaccggttaaccgggtaccccgggtaacccgggaacccggggttaaccggttccccccggg

SEQ ID NO: 196513 - DNA, 848 bp, Homo sapiens
  misc_feature: GYAE6OF01AYS2E.14.36.D03.1.454.CMB.1.raw
tcagcgtctagtaccacgaccggtgctcgatttagctgcgtcacgatctctcgttgggggggggtctcaggaggcagcgctctcaggacatctccaccatggcctgggctctgctgctcctcaccctcctcactcgagggcacgagggtcctgggcccagtctgccctgactcagcctgcctcgtgtcgtgggtctcgtggacagtcgatcactatcctctgactacgtacggaaccagcgtaggtcggtacggtttgggtaggtttaataaggttacgtcgttaccgttccgtaacgggtaacccaaaaccaacccgtaaccccgaacgggaacccaaaaccggaccccccctaaaatccgtaaagttacggttaacttttacggtagggtaacggttaacgtaacggttaaccgtcccggttccccgttaacgggttaaccggggttttaccttaacgtccggttactttccggtacggtacggtcccttaaccggtacggtcctacggacctaaccggcccgttccctaccgtacaccgtacgttccgtcggtacggtcctaccggtacggtcggtacgggtaacggtaccgtaccggtttacgtagtttaaacgttttacgtacgtttacgacgtacgtacccttaggtacttaccggtaccgtaccgtacgtaccgggaactacgttaaaccgtaacggttcggttaaacgggttttcgggggtttaacccggggggttcgggggaaacccgggggtacggttaacggggtccccggttaacccgggttaccggtaacccggttaccggacccggttaaccccggtccgggttaccccccggg

SEQ ID NO: 196514 - DNA, 661 bp, Homo sapiens
  misc_feature: GYAE6OF01DS72D.14.36.D03.1.454.CMB.1.raw
  modified_base (232)..(232): a, c, t, g, unknown or other
  misc_feature (232)..(232): n is a, c, g, or t
  modified_base (296)..(296): a, c, t, g, unknown or other
  misc_feature (296)..(296): n is a, c, g, or t
tcagcgtctagtaccacgaccggtgctcgatttagctgcgtcacgatctctcgttggggggggtctcaggaggcagcgctctcaggacatctccaccatggcctgggctctgctgctcctcaccctcctcactcagggcacagggtcctgggcccagtctcgccctgactcagcctgcctccgtgtctgggtctcctggacagtcgatcaccatcctcctgcactggaaccngcagtgacgttggtgttatagtatgtctctgtaccaacaacaccagcaaacgccccaaatcatntatttatgagtacagtaatccggccctgtacgggtttctaagtcgtcttctcgtacggtctacctaagtcctggaccaaaccgccggtaccctcctacgacctactcgtcgtcgggacttaccgacggtacgtacgggtaacggaccggtacgttccgttaaggttaatttacgtttacggtttacgacctacggtcttaccgaatttacgtcgaccgtaaccgtcggactaggacctaagttccgtaagtttcggggtttacggggttttaccggggggacggggttaaacccggtaacggggttcgttaaccccggttccggttaacgggtacccaaccgggccccggttaaggacccccggg

SEQ ID NO: 196515 - DNA, 512 bp, Homo sapiens
  misc_feature: GYAE6OF01BUM9Z.14.36.D03.1.454.CMB.1.raw
  modified_base (376)..(376): a, c, t, g, unknown or other
  misc_feature (376)..(376): n is a, c, g, or t
  modified_base (439)..(439): a, c, t, g, unknown or other
  misc_feature (439)..(439): n is a, c, g, or t
  modified_base (447)..(447): a, c, t, g, unknown or other
  misc_feature (447)..(447): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctcctggtaccaacaacaccaggcaaacgccccaaatcactgtatttatgaggtcagtaactcgccctgagggtttctaatcgtcttctctggctcaagtctgacaacacggccctccngaccatctcgtggcctccgaggctggaggacgagtcgtagtattattatgcagctcatagtcncactgcancaatcagtggttggttcgggcggggactacggtgtaccgtcgtcgtacgacgcccgaaggtcccg

SEQ ID NO: 196516 - DNA, 711 bp, Homo sapiens
  misc_feature: GYAE6OF01BAGJ2.14.36.D03.1.454.CMB.1.raw
  modified_base (201)..(201): a, c, t, g, unknown or other
  misc_feature (201)..(201): n is a, c, g, or t
  modified_base (213)..(213): a, c, t, g, unknown or other
  misc_feature (213)..(213): n is a, c, g, or t
  modified_base (236)..(236): a, c, t, g, unknown or other
  misc_feature (236)..(236): n is a, c, g, or t
tcagcgtctagtaccacgaccggtgctcgatttagctgcgtcacgatctctcgttggggggggtctcaggaggcagcgctctcaggacatctccaccatggcctgggctctgctgctcctcacctcctcactcagggcacgagggtcctgggcccagtctgccctgactcagcctcgcctcgtgtcgtggtctcgtggacngtcgatccactntcctctgaccacgtacggaaccngcgtaggtcggtacggttggtagttaatagtatcgtctccgtacgtaaccaacaaccaccgacgaccgaaaccaccccaaatctactagtatttagaggtacgtacgtaagtacgtccggtaccgttaggtacgggtttactaacgtccgttaccttgtcgtcggtacctacgtaacggtcgtacgaccgtaacgcccggtccctactacgacctactcgtacggtcggacctcggacggtcgtacggacgtacgtacgtacgttagttaatttacgttactcgacctagtcctaacgtactcgttacccggaccgttaccggacgacgtacggtaacttaacgttcgttaacggggtttccgggggtttaaccggggttacggggggaaccgggttaaacggaccgggttaccggtacccggttaccggtacgggtaacccgtacccgggtaaacccggtcggttaccccccgg

SEQ ID NO: 196517 - DNA, 497 bp, Homo sapiens
  misc_feature: GYAE6OF01DPO1M.14.36.D03.1.454.CMB.1.raw
  modified_base (302)..(302): a, c, t, g, unknown or other
  misc_feature (302)..(302): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctctggtaccaacaacaccaggcaaagccccaaatcatgatttangaggtcagtaatcggcctgagggtttctaatcgcttctctggctcaagtctggcaacacggcctcctgaccatctcgtgggctcgaggctaggaggacgagtctgtatttattattgcagctcatatgcactggcagcaatcatggttggtttcgggcggggtacaaggtcgaccgtcgtaggcagccgaggtcc

SEQ ID NO: 196518 - DNA, 650 bp, Homo sapiens
  misc_feature: GYAE6OF01C6SGF.14.36.D03.1.454.CMB.1.raw
tcagcgtctagtaccacgaccggtgctcgatttagctgcgtcacgatctctcgttgggggggggtctcaggaggcagcgctctcaggacatctccaccatggcctgggctctgctgctcctcaccctcctcactcagggcacagggtcctgggcccagtctgccctgactcacgcctcgcctccgtgtcgtgggtctccgtggacagtcgatcacctatcctctcgacacgtacggaaccagctagtggtacggtttggtaggttataagtattcgtcttccgtacgtaaccaaaccaaccgaccgaggaccaaaaccgacccccaaaatcaatagtaattagtagtaggtaactaagtaaccgtcggacccctagtaggttacgtttactaagttccgtcgtttctcgtacgtacctaccgtaagtcgtacggacctaaccggtaccgtccctcgtgaacgtctactcgtcgtcggctcgagcgtaggacggtcgagtcttacgtatttacgcgtacgcgtagtcctataatagttacttaacggacgtaacgtaggttaccgtgggtttcgggttacgggaccggtaagggtaaccgtgggtaccgtaccgtacgggtacggacacggacccgtggcctacccccggg

SEQ ID NO: 196519 - DNA, 651 bp, Homo sapiens
  misc_feature: GYAE6OF01A43B3.14.36.D03.1.454.CMB.1.raw
  modified_base (230)..(230): a, c, t, g, unknown or other
  misc_feature (230)..(230): n is a, c, g, or t
  modified_base (389)..(389): a, c, t, g, unknown or other
  misc_feature (389)..(389): n is a, c, g, or t
tcagcgtctagtaccacgaccggtgctcgatttagctgcgtcacgatctctcgttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctacactggaaccngcagtgacgttggtgttataagtatgtctctgtaccaacaacaccaggacaaacgcccccaactcatgtatttatgagttacagtaactcggccctcgtagggtttactaatccgtcttctcgtcgctaccgaagtctggacaaccaccggccctcccngacccatctcgtgggtcctccgaggcgtaggacggacgtagtctgtatttattattgcagtctacgatacgtcgacctaccgtggccacggtacctaagttaccgtagtttcgggggtttacgggggtttttacccggggggaccgggggggttaacccgtaaacgggggttaccggtaacccccgggtttaccggttaaaccggggttaccgaaccccgggtaacccccggtaaacggggttccccggttcccccccgggg

SEQ ID NO: 196520 - DNA, 574 bp, Homo sapiens
  misc_feature: GYAE6OF01EQEPX.14.36.D03.1.454.CMB.1.raw
  modified_base (360)..(360): a, c, t, g, unknown or other
  misc_feature (360)..(360): n is a, c, g, or t
  modified_base (369)..(369): a, c, t, g, unknown or other
  misc_feature (369)..(369): n is a, c, g, or t
  modified_base (377)..(377): a, c, t, g, unknown or other
  misc_feature (377)..(377): n is a, c, g, or t
  modified_base (387)..(387): a, c, t, g, unknown or other
  misc_feature (387)..(387): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctcctggtaccaacaacacccaggcaaagcccccaaaactcatgattatgagtcagtaatcgcctcagggtttctaatcgcttctctgctcaagtctgcaacncgcctcctnacatctcnggctcaggcngaggacgagtctgtatttattattcgacagtctacgattacgtcgccaccgttgggacctaggtacctaaagttcctaaagttcgggtttcggggtttttaccggggggaaccgggggggtaacccgtaagggtaccggtacccggtaccggttacgggaccgtaccggaccccgtaaagggtcccg

SEQ ID NO: 196521 - DNA, 752 bp, Homo sapiens
  misc_feature: GYAE6OF01COTYE.14.36.D03.1.454.CMB.1.raw
tcagcgtctagtaccacgaccggtgctcgatttagctgcgtcacgatctctcttggggggggtctcaggaggcagcgctctcaggacatctccaccatggcctgggctctgctgctcctcaccctctcactcagggcacagggtcctggcccagtctgcctgactcagcctgcctccgtgtcgtggtctccgtggacagtcgatcaccatctcctgcactggaccagcagtcgagttggtagtataagtatgtctctgtaccaacaccaccgaggactaaaccgacccccaaatcaactagtactttagtggacggtactaacgtaacgtccggaccgtacgtagggtttactaacgtcgtacttcgtacgtcggtctaccgaagttcgtacgggtaccaaccgtcccggtcccttacccgtacgaacccttaacgtcccttaaccgggtcgggtacccttacccgagggtaccgtacgggaacggtaaccggacggtttaccgttaggttaacttttaacgtttagttacgtaccgtacgtcccttacgtaacgtcgtaccgtaccgttaaccgtcgggtaccgaaggtaacctaacttaccggtaggttttacggggtttacccgggggtttttacccggggggaacccgggggggttaacccgttaaacgggggtacccgttaccccgggtttaaccggttaacccgggtccggtaaaccccggtcccgggtaaacgggttccccccgg

SEQ ID NO: 196522 - DNA, 659 bp, Homo sapiens
  misc_feature: GYAE6OF01B55BB.14.36.D03.1.454.CMB.1.raw
  modified_base (193)..(193): a, c, t, g, unknown or other
  misc_feature (193)..(193): n is a, c, g, or t
  modified_base (232)..(232): a, c, t, g, unknown or other
  misc_feature (232)..(232): n is a, c, g, or t
  modified_base (261)..(261): a, c, t, g, unknown or other
  misc_feature (261)..(261): n is a, c, g, or t
tcagcgtctagtaccacgaccggtgctcgatttagctgcgtcacgatctctcgttggggggggtctcaggaggcagcgctctcaggacatctccaccatggcctgggctctgctgctcctcaccctcctcactcaggcacgagggtcctgggcccagtctgccctgactcagcctgccctcgtgtctgggtcncgtggacagtcgatccaccatctcctgcacgtggaaccngcagtgtacgttggtagttataagtagtntctccgtgtaccaacaccaccgagaccaaaccgaccccaactcatgtatttagtgtaggtactagtaacgtccggtacccgttcggtacgggtttactaacgtcgtacttcgtccgtggtcctacctaaggtcctaggacctaaccgtacccggtccccttacccgtacgtaccctacgttcccgttaccggtcgggtacctcccggtacggcgttagggacggtaccgtagttcgttagttactttaatttacgttgacctagtcttacagttacgtcgtacccgtacgtcggactacgactaacttgtaggtttacgggttcggggtttacgggaccgggggtaaccgtacggtccggtaccgttcgtacggtaccgacggtacccgacggtcccg

SEQ ID NO: 196523 - DNA, 668 bp, Homo sapiens
  misc_feature: GYAE6OF01CLANN.14.36.D03.1.454.CMB.1.raw
  modified_base (270)..(270): a, c, t, g, unknown or other
  misc_feature (270)..(270): n is a, c, g, or t
  modified_base (319)..(319): a, c, t, g, unknown or other
  misc_feature (319)..(319): n is a, c, g, or t
  modified_base (448)..(448): a, c, t, g, unknown or other
  misc_feature (448)..(448): n is a, c, g, or t
tcagcgtctagtaccacgaccggtgctcgatttagctgcgtcacgatctctcgttgggggggggtctcaggaggcagcgctctcaggacatctccaccatggcctgggctctgctgctcctcaccctcctcactcagggcacgagggtcctgggcccagtctcgccctgactcagcctcgccctccgtgtctcgggtctccgtggacagtcgactccaccatcctcctgcacgtcggaaccagcaggtgtacggttggtggttataagtntgtctccgtgtaaccaaccaaccaccacggaccaaccgaccccctaaancactagtatttagagacgtacaagtacgtccgtcctaggtacggttactagtccgtcttctcgtcgtactccgaagtcgtcgaccaaccgccggtcctaccgtcactactcgtcgtcggtcctaccggngacgtacggaacggtacgtacgttcgtagtatttaactttagtgtaccgtagtcttaacgtagttactcgtaaccgtacccggaggtaccacgtaacgtaacttcgttaacggtttcgggggttaccggggtttaccggggggaccggggtaaaccgtagggttacccggtaacccggtacggtaaccggtaccgacccggtacccggaccggttccccg

SEQ ID NO: 196524 - DNA, 543 bp, Homo sapiens
  misc_feature: GYAE6OF01EJJBA.14.36.D03.1.454.CMB.1.raw
  modified_base (228)..(228): a, c, t, g, unknown or other
  misc_feature (228)..(228): n is a, c, g, or t
  modified_base (459)..(459): a, c, t, g, unknown or other
  misc_feature (459)..(459): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcaccatctcctgcactggaaccngcagtgacgttggtggttataagtatgtctcctggtaccaacaacaccaggacaaacgcccccaaatcatgtatttatgagtcagtaatcggcctcgtagggtttctaatcgtacttctctggctcaagtctgcaacacggcctccctgaccatctcgtcggctcccgaggctaggacacggggggggattcgtatattatttattagtaagctctaatatgcgacctggnagacaatatagtggttggtttcgggacgggggacgaacggtcggaccgtaccggtacggtacgtagcccgaaggccgtacccgg

SEQ ID NO: 196525 - DNA, 556 bp, Homo sapiens
  misc_feature: GYAE6OF01C563X.14.36.D03.1.454.CMB.1.raw
  modified_base (232)..(232): a, c, t, g, unknown or other
  misc_feature (232)..(232): n is a, c, g, or t
  modified_base (303)..(303): a, c, t, g, unknown or other
  misc_feature (303)..(303): n is a, c, g, or t
  modified_base (434)..(434): a, c, t, g, unknown or other
  misc_feature (434)..(434): n is a, c, g, or t
tcagcgtctagtaccacgaccggtgctcgatttagctgcgtcacgatctctcttgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatcctcctgcactcggaaccngcagtgacgttggtgtatagtatgtctcctgtaccaacaacaccaggacaacgccccaaatcatgtattangagtcagtaactcggacctcgtagggtttctaagtccgtcttcgtctggctaccgaagtcgtggacaccacggtccctcctcgacctatcctcgtcgggtccacgtaggctaggacggacggtagtcgttntactttattattcgctagctatatatcgctaccgtggacagcaatcgtagttcgggttcgggtttcggggacggggtacgtacgggtcggacccgtacgtaggtccgacgcccgaggtcccg

SEQ ID NO: 196526 - DNA, 549 bp, Homo sapiens
  misc_feature: GYAE6OF01B9IVM.14.36.D03.1.454.CMB.1.raw
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctctggtaccaacacacccaggacaaacgcccccaaactcatgatttatgaggtcaagtaatcggccctgtagggtttactaatcgtcttctcgtggctcaagtctggacaacacggcctccctgacctatctcgtggctccgaggctaggaggacgtagtctagtatttattattgctagtctacgtatagtagccaccttggacacgactaatctaagttggttcgggtttcggggaccgggggtactaagggtcgacccgttcgtacggtaccacgcccgtaggtcccg

SEQ ID NO: 196527 - DNA, 735 bp, Homo sapiens
  misc_feature: GYAE6OF01EZSB2.14.36.D03.1.454.CMB.1.raw
  modified_base (226)..(226): a, c, t, g, unknown or other
  misc_feature (226)..(226): n is a, c, g, or t
tcagcgtctagtaccacgaccggtgctcgatttagctgcgtcacgatctctcttgggggggtctcaggaggcagcgctctcaggacatctccaccatggcctgggctctgctgctcctcaccctcctcactcagggcacagggtcctgggcccagtctgccctgactcagcctgcctccgtgtctggtctcctggacagtcgatcaccatctcctgcactgaaccngcagtgacgttggtgttataagtatgtcctcgtcgtaaccaacaaccaccgaggaccaaccgaccccaaactctatacgttatttagtacggtaggtactaaggttaacgtcccgtaccgtacggttaggtttactaacgtccgttcttaccgtcgtcgtacctaaccgtaacgtcgtacgaccgaaccgacccggtcccttaccgtcgtaacctacgttccgtcggtccggtcctaccgtacgggtcgtacgggaacggacggttactaccggtttatacgttttactttacgttacgaccgttacgacgttacctaagtcgtacgtacccgtacggttcgaccgtaacgtacgttacttacggttacggttttccggggtttaccgggggttttaccggggggaaccggggttaaacccgggttaaccgggtcccgggttaaaccccggttaccgggttaaccggtaacccggacccgggttaaccccggtaaccgggttcccccgg

SEQ ID NO: 196528 - DNA, 745 bp, Homo sapiens
  misc_feature: GYAE6OF01CU4JE.14.36.D03.1.454.CMB.1.raw
  modified_base (234)..(234): a, c, t, g, unknown or other
  misc_feature (234)..(234): n is a, c, g, or t
tcagcgtctagtaccacgaccggtgctcgatttagctgcgtcacgatctctcgttggggggggtctcagggaggcagcgctctcaggacatctccaccatggcctgggctctgctgctcctcacctcctcactcagggcacagggtcctgggcccagtctgccctgactcagcctgcctccgtgtctgggtctccgtggacagtcgatcacctatcgtcctgacactggaaccnggtcagtgtacggttaggtgttaataagtatgttctcctaggtaccaaacgaacacccaggaccaaaacgacccccaaaacgtcaacgttgtatttactaggacggtcaagtaactccggacctcgtacggggtttactaagtcggtcttcgtcttcggaccttaccgaaagttccgtagggtacccaaaccggtaccggtacccctaccccgttacggaacccttaactccgttaccggtccgggtaccttaacccggacggtaccgttacgggaacgggtacgtaacggtacgttcggtaaattttaactttaacgtttaggtacctacggtacgtttacctaagtttaacgttcgacctaccgttacgggacctaacgtaacgtaaccgtacttaacggttgggtttacggggtttaccggggtaccggggggggtaaacctaacggggtaccgtaaccggttacccgttaacggtacggtaacccgacccggtaacgggttaccccg

SEQ ID NO: 196529 - DNA, 632 bp, Homo sapiens
  misc_feature: GYAE6OF01CU96D.14.36.D03.1.454.CMB.1.raw
  modified_base (175)..(175): a, c, t, g, unknown or other
  misc_feature (175)..(175): n is a, c, g, or t
  modified_base (217)..(217): a, c, t, g, unknown or other
  misc_feature (217)..(217): n is a, c, g, or t
  modified_base (223)..(223): a, c, t, g, unknown or other
  misc_feature (223)..(223): n is a, c, g, or t
  modified_base (235)..(235): a, c, t, g, unknown or other
  misc_feature (235)..(235): n is a, c, g, or t
  modified_base (258)..(258): a, c, t, g, unknown or other
  misc_feature (258)..(258): n is a, c, g, or t
  modified_base (321)..(321): a, c, t, g, unknown or other
  misc_feature (321)..(321): n is a, c, g, or t
  modified_base (458)..(458): a, c, t, g, unknown or other
  misc_feature (458)..(458): n is a, c, g, or t
  modified_base (559)..(559): a, c, t, g, unknown or other
  misc_feature (559)..(559): n is a, c, g, or t
  modified_base (617)..(617): a, c, t, g, unknown or other
  misc_feature (617)..(617): n is a, c, g, or t
tcagcgtctagtaccacgaccggtgctcgatttagctgcgtcacgatctctcgttggggggggtctcaggaggcagcgctctcaggacatctccaccatggcctgggctctgctgctcctcaccctcctcactcgagggcacgacgggtccgtcggccagtctcgccctgactcncgtcctcgcctcgtgtcgtcggtctcgtgacagtcatcaacntctacngactacacgacngcagtgtcgttgtgtaatacgtntcgtctcgtacgtaaccaacaccgaccaggaccaaaccgaccctaatcattacgtatttacgngtacgtactagtaacgtcgtaccgttacggtaggtttacaagttccgtcttacgtcgtcgtaacctcgtaacgttcggacgacctaaaccggtcgtcccttacgtacgacttacgtcgttccgagggcccttacggnggttaccgaaggcggtaacctgttacgttaagtaacgtttagttacgtcgacttacgacgtttaacagtttaccgcgtacccgtgtaccgactaccgtaanaaccgtcgttagtttcggtacgggtacgggtacggacgtaagtcgacgttagaacgtnaccgcggtctaccgg

SEQ ID NO: 196530 - DNA, 820 bp, Homo sapiens
  misc_feature: GYAE6OF01BCSLJ.14.36.D03.1.454.CMB.1.raw
tcagcgtctagtaccacgaccggtgctcgatttagctgcgtcacgatctctcgttgggggggggtctcaggaggcagcgctctcaggacatctccaccatggcctgggctctgctgctcctcaccctcctcactcgagggcacgagggtccgtcgggcccagtctcgccctgactcagcctgcctcgtgtcgtggtcctcctggacagtcgatcaccatctcctgcactcggaccagcagtgtacggttggttaggttaagtaagttatcgttcgttccgtacggtaaccaacttaaccgacccacggaccaaaccgaccccaactacatagtatttagtgtacgtacgaagtacgtcggtcccgtacggtacgggttactaacgtcgtcttctcgtcgtacctaccgtaacgtcgtacggtaaccgaaccgtacccggtcccctcccgtaccgaaccctaccgttccgtccggttccgggtacccgttacccggacgggtcggtaacgggtaacgggtaaccggtacggttaccgttacgtttaacgttttaacgttttacgtttacggtaccgtaacggttcccgttaaccgttaacgttaacggttacccgttaaccggtacccggttaccgggacctaaccgggtactaaccgttaccggttaacgggtttcggggttttaccggggggtttacccggggggtacccggggggggtaaacccggttaaccgggggttaaccgggttaaccccgggttaccgggttaacgggttacccgggtaacccgggtaaccccgggtaaccgggtcccccggg

SEQ ID NO: 196531 - DNA, 641 bp, Homo sapiens
  misc_feature: GYAE6OF01D8M5R.14.36.D03.1.454.CMB.1.raw
  modified_base (262)..(262): a, c, t, g, unknown or other
  misc_feature (262)..(262): n is a, c, g, or t
  modified_base (315)..(315): a, c, t, g, unknown or other
  misc_feature (315)..(315): n is a, c, g, or t
tcagcgtctagtaccacgaccggtgctcgattttagctgcgtcacgatctctcgttggggggggtctcaggaggcagcgctctcaggacatctccacatggcctgggctctgctgctcctcaccctcctcactcgagggcacgagggtcctgggcccagtctgccctgactcagcctgcctccgtgtctcgggtctccgtggacagtcatccacctatctcctgcacgtggaaccagcagtggtacgttggtgttataagtntgtctctgaacaacacaccgagacaacgaccccaatcatgtacttatgagtanacgtactcgaccgttgtagggttactatcgtcttctcgtgctcgagtctacgaccaacgccgacctccacgacctagtctcgtcggtcctcggacgtcgtagacggtacgtagtcttagtatttacgttagtcgactactcgtactagtagacgtacgaccgtaggaccaagtaccgtaatttccgtaaggtttcggggtttaccgggggttttaccggggggaaccggggtaccgggttaaaaccgggttcccgggttaaaccccgggttaacggttaacccgggacccgttaaccgggtacccccggtaaccgggttcccccgg

SEQ ID NO: 196532 - DNA, 640 bp, Homo sapiens
  misc_feature: GYAE6OF01CABEU.14.36.D03.1.454.CMB.1.raw
  modified_base (234)..(234): a, c, t, g, unknown or other
  misc_feature (234)..(234): n is a, c, g, or t
  modified_base (529)..(529): a, c, t, g, unknown or other
  misc_feature (529)..(529): n is a, c, g, or t
  modified_base (534)..(534): a, c, t, g, unknown or other
  misc_feature (534)..(534): n is a, c, g, or t
  modified_base (622)..(622): a, c, t, g, unknown or other
  misc_feature (622)..(622): n is a, c, g, or t
tcagcgtctagtaccacgaccggtgctcgatttagctgcgtcacgatctctcgttggggggggtctcaggaggcagcgctctcaggacatctccaccatggcctgggctctgctgctcctcaccctcctcactcaggcacgagggtcctgggcccagtctcgccctgactcagcctgccctccgtgtctggtctcctggacagtcgatcacctatcctcctgccactggaaccngcagtgtacgttggttgttaagtaagttatcgtcttaccgtggtaacccaacaaccacccgaaggacaaaccgacccccaaatcagtacgtatttagtgacggtacaagttaacgtcccggtccctacggttaggggtttacctaacgttcggtctttccgtcgtcggtacccttccgaaagttcccgtaggacccgaaacccgtaccggtacccccttaccctacgtaccctacttccgttcgtcgggtccctacgacggtcgtaggacggacgtgtcttagtatttattgtancgtanctacattgtcgcctacgtgacagacaacttcgtagttgggttcggttaccggggacgggtacacgggtcgtacccgtacgtacggtanccggtccgaacgtccccg

SEQ ID NO: 196533 - DNA, 743 bp, Homo sapiens
  misc_feature: GYAE6OF01CWL6B.14.36.D03.1.454.CMB.1.raw
  modified_base (360)..(360): a, c, t, g, unknown or other
  misc_feature (360)..(360): n is a, c, g, or t
  modified_base (626)..(626): a, c, t, g, unknown or other
  misc_feature (626)..(626): n is a, c, g, or t
tcagcgtctagtaccacgaccggtgctcgatttagctgcgtcacgatctctcttgggggggggtctcaggaggcagcgctctcaggacatctccaccatggcctgggctctgctgctcctcaccctcctcactcagggcacgagggtcctgggcccagtctcgccctgactcagcctgcctccgtgtcgtgggtctcgtggacagtcgatccaccatcctcctgccacgtacggaaccagcagtggtacggttggtaggttaataagtatcgtccttaccgtacggtaacccaaacaacccaccccgtaaggaacccaaaccgaccccccctaaaatacctaagttacgtaattttaagngggtaacggttacgtaacgttaacgtccggtaccccttaagggttacggggttttacctaacgttccgtactttcgtcgtacgtccgtaccaaggttcgtcggtaacaaccgtcccggtaccctcccgtacgtaccctacgtccgtcggaccgtccgtaccgtacggtacgttaacggacggtacttagtacgtttaacgtttagttacgtcgacgttctaaccgttagtaacttgtacccggtacgtacggtacaaccggtaacnctaaccgttaggttcgggttaccggggtttcgggggttaccgggggacccggggtaagtaccgggtcccgtaaccggtcggtaaccgtacgaccgtaaccgccggtcctacccccgg

SEQ ID NO: 196534 - DNA, 679 bp, Homo sapiens
  misc_feature: GYAE6OF01CNX7S.14.36.D03.1.454.CMB.1.raw
  modified_base (340)..(340): a, c, t, g, unknown or other
  misc_feature (340)..(340): n is a, c, g, or t
tcagcgtctagtaccacgaccggtgctcgatttagctgcgtcacgatctctcgttggggggggtctcaggaggcagcgctctcaggacatctccaccatggcctgggctctgctgctcctccaccctcctcactcgagggcacgagggtcctgggcccagtctgccctgactcacgcctgccctccgtgtcgtgggtcctccgtggacagtcgatcaccatcctcctgccacgtaggaacccagacagtggtacggtttggttagttataagtatcgtctccgtagtaacccaaacaaccaccgacggacaaaccgacccccaaatcaactgtaatttanaggacgtactaacgtacgtccggtcccgtagtacgggtttacctagtccgtacttctacgtcgtctaccgagtcgcggacaaccgccgtccctacctagacctatccgtcgtcggctaccgagtcgagacggagtacgtactcgtttaattatttaacgttcgaccgtacgttaccttactaagttacgcgaaccctaccggttaggaccaacgtaccgtacttacggttaaggttcggggttttaccgggggttgggggaaccccgggggttaactacggggttcccgtaacccggttcggtaaccgtggtaaccccgacccggttaccggtcccccg

SEQ ID NO: 196535 - DNA, 643 bp, Homo sapiens
  misc_feature: GYAE6OF01BLX2S.14.36.D03.1.454.CMB.1.raw
  modified_base (195)..(195): a, c, t, g, unknown or other
  misc_feature (195)..(195): n is a, c, g, or t
  modified_base (200)..(200): a, c, t, g, unknown or other
  misc_feature (200)..(200): n is a, c, g, or t
  modified_base (271)..(271): a, c, t, g, unknown or other
  misc_feature (271)..(271): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctccnggacngtcgatcaccatctcctgccactggaaccaggcagtgacgttggtggttataagtatgtctctgtaccaanaccaccaggcaaacgccccaactcatgtatttagtgagtcagtaatccggcctcgtacgggtttctaatcgtcttctctcggtcctcctaaggtctacggacctaaaccgccggtccctccctacgtaccctattcctcgttcgggccttcccgaggcgtacggaacgggtaccgagttccgtagttactttagttacttcgaccagtccttactaacttacgttacgtacctaccgtacggactagacctaagtccttaaggttgggttacggggttttaccggggacccggggggttaaccgtaacggggttacccgtacccggttaccggtacggtacccggtaaccgtccccggtaacgggtaccccg

SEQ ID NO: 196536 - DNA, 190 bp, Homo sapiens
  misc_feature: GYAE6OF01B0M79.14.36.D03.1.454.CMB.1.raw
  modified_base (186)..(190): a, c, t, g, unknown or other
  misc_feature (186)..(190): n is a, c, g, or t
tcagcgtctagtaccacgaccggtgctcgatttagctgcgtcacgatctctcttggggttttggggggaagaggaagactgaccggtccccccaggagttcaggtgctgggcacagcggccctgggctgcctggtcaaggactacttccgtactagacgctgagcgggctggcgaaggcgcatagnnnnn

SEQ ID NO: 196537 - DNA, 670 bp, Homo sapiens
  misc_feature: GYAE6OF01DOAXT.14.36.D03.1.454.CMB.1.raw
  modified_base (224)..(224): a, c, t, g, unknown or other
  misc_feature (224)..(224): n is a, c, g, or t
  modified_base (245)..(245): a, c, t, g, unknown or other
  misc_feature (245)..(245): n is a, c, g, or t
  modified_base (518)..(518): a, c, t, g, unknown or other
  misc_feature (518)..(518): n is a, c, g, or t
  modified_base (544)..(544): a, c, t, g, unknown or other
  misc_feature (544)..(544): n is a, c, g, or t
tcagcgtctagtaccacgaccggtgctcgatttagctgcgtcacgatctctcgttggggggggtctcaggaggcagcgctctcaggacatctccaccatggcctgggctctgctgctcctcaccctcctcactcgaggcacgacgggtcctgggcccagtctcgccctgactcacgcctgccctccgtgtccgtgggtcctccgtggacagtcgatccaacctntcctctgccacgtcgaaaccngcgagtcggtagttggttagttaataagtatcgtcctcctagtaaccaacaaccgaccaggaccaaaccgaccccctaaatcagttagtatttagacggagtactaaggtacgtccggacccgttagttagggtttacctacgttcgtaccgttcttcgtacggtaccttacgaagtcgtacgaacctaaccgaccggtccctaccacgtacctactccgtccgcggtcctaccgacggtactggaaccggatcgttcgtagtaattttagtnttacggactacgcttacagtttaccncgacctaccgtcggacacgtacgtaacgtccgttaggttcgggttttcggggttaccggggacggggttaaccgtacgggtaccgtaccgttacggtaaccgtcggtaaccgcccgtacggtcccg

SEQ ID NO: 196538 - DNA, 717 bp, Homo sapiens
  misc_feature: GYAE6OF01B8E8R.14.36.D03.1.454.CMB.1.raw
tcagcgtctagtaccacgaccggtgctcgatttagctgcgtcacgatctctcttggggggggtctcaggaggcagcgctctcaggacatctccaccatggcctgggctctgctgctcctccaccctcctcactcagggcacgagggtcctgggcccagtctgccctgactcagcctgcctccgtgtcgtcgggtctccgtggacagtcgatccacctactcctcctgccacgtaggaaccagcaggtgtacggttggtagttataagtattcgtcctccgtacggtaacccaaaccaaccacccgaacggaccaaaccgaccccccaaatcatagtattatggagtcagtacgtccggcctagtacgggtttactacgtcgtcttctcgtcgtcctccgagtccgtacggacctaaccgcccgtccctccctacgaccctattcccgtcggtccggcctaccggacggtcgtacggacgggtaccgtacggttcttagttactttagttacgttcgaccgtagtacctacctaattacgtaccggtacccgtacggttaccggaccggttacaacccgttaatccggttaggttttacggggtttcggggtttaccccggggggacccgggggttaaccggtaaccgggttcccggttaaccccggtacggttaaccggaccccgtacccggtacccccgtaaccgggtccccccgg

SEQ ID NO: 196539 - DNA, 601 bp, Homo sapiens
  misc_feature: GYAE6OF01BS9UY.14.36.D03.1.454.CMB.1.raw
  modified_base (297)..(297): a, c, t, g, unknown or other
  misc_feature (297)..(297): n is a, c, g, or t
  modified_base (368)..(368): a, c, t, g, unknown or other
  misc_feature (368)..(368): n is a, c, g, or t
  modified_base (464)..(464): a, c, t, g, unknown or other
  misc_feature (464)..(464): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctggtctccgtgacagtcgatcaccatctcctgcacgtggaaccagcagtgtacgttggtgttataagtatgtctcctgtaccaacacaccaggcaaacgccccaaactcatnatttagtgagtcagtaactcggcctgagggtttctaactcgtcttctcgtgctcaacgtctacggacaacnccggtcctcctcgacctactcctcgtcgggtctccgaggtctaggacggtacgtaggtaccttaggtactttaatttagttacgtctacgtacctntaacttagtacgtacctaccgtgacgacgactaagttccgtagtttcgggtttacgggtttccggggacgggggttaccgtaacgggtccggtacccggttacgtacgggtaccaccggtacccgaagggttccccg

SEQ ID NO: 196540 - DNA, 706 bp, Homo sapiens
  misc_feature: GYAE6OF01D4CLP.14.36.D03.1.454.CMB.1.raw
  modified_base (316)..(316): a, c, t, g, unknown or other
  misc_feature (316)..(316): n is a, c, g, or t
tcagcgtctagtaccacgaccggtgctcgatttagctgcgtcacgatctctcgttggggggggtctcaggaggcagcgctctcaggacatctccaccatggcctgggctctgctgctcctcaccctcctcactcagggcacgagggtcctgggcccagtctgccctgactcagcctgcctcgtgtctgggtctcctggacagtcgatcaccactctcctgccacgtcggaaccagcgagtgacgttggtaggttataagtatgtctcctggtaaccaacgaacaccagacaaacgcccccaaatcatgtactttangagtcagtacgtcgccctagtagggtttctaagtccgtctttctcgtcggtctacctaaggttcgtagggaccctaaaccgacccgggtccccttacccctcgtaaccctaattcccgttcgtcgggtccctaccggaggtaccgtagggacgggacgtagttccttaggttaattttactttacgttacgccgtaacgtccttaactacttaacgtcgtaccctacgtaccgggactaccggactaaacgttccgtaaggttcggggttttaccgggggttttcggggggaaccccgggggttaaccgttaaacgggggtcccgtaacccccgggtttaccgtaacgggttaccgaacccccgggtcccgtaaacggggttccccccgg

SEQ ID NO: 196541 - DNA, 614 bp, Homo sapiens
  misc_feature: GYAE6OF01D1PEJ.14.36.D03.1.454.CMB.1.raw
tcagcgtctagtaccacgaccggtgctcgatttagctgcgtcacgatctctcgttggggggggtctcaggaggcagcgctctcaggacatctccaccatggcctgggctctgctgctcctcaccctcctcactcagggcacagggtcctgggcccagtctgccctgactcagcctgcctccgtgtctgggtctccgtggacagtcatcacatctcctgcacgtgaaccagcagtgtacgttggtagttataagtatgtctccttcggtaaccaacaaccaccaggaccaaacgccccaaactcatgtattagtagagtcagtaactcggtcctagtacgggttactagtcgtcttctctgtctacagtctggacaacgaccgcctcccgtacgacctatcctcgtcggcctacgaggcgcgacggacgtagttctagtatttattagttcgagtacgctagtatacgtcgacctcgtacgacgtagaccttaagtccgtaggtttcgggtttacggggtttacgggggacccggggggtaacggtaaccgggttaccggtacccggttacccgggtaacggtaccggacccggacccggtaacgggtcccccgg

SEQ ID NO: 196542 - DNA, 704 bp, Homo sapiens
  misc_feature: GYAE6OF01AEQJ5.14.36.D03.1.454.CMB.1.raw
  modified_base (229)..(229): a, c, t, g, unknown or other
  misc_feature (229)..(229): n is a, c, g, or t
tcagcgtctagtaccacgaccggtgctcgatttagctgcgtcacgatctctcgttggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcgccatctctgcactcggaaccngcagtgtacgttggtagttataagtatgtctcgtggtaccaacaccaccagaccaacgaccccaactcatgtatttacgtgacggtactagtaacgtccggtacccgttacgtaacgggggttttactaacgttccggtcttttcgtccttggacccttaccgtaacggttctacgggtacctaaccggaccggtccccttacccgtacgtacctacttcccgtccgttaccgggtcccttaccggacgggtaccgtacgggtaacggtacggtacgtttaccgtaaggttactttaagttttacgttaggcctaaggtcctatacgtattcgaccgtaaccgttggacctaggtaaccaagttacgttacggtacggggtttcgggtttaccggggggaccggggtacggtaacggggtcggttaaccggtccggttaacggtacggacccgtacccggtaaccggttccccgg

SEQ ID NO: 196543 - DNA, 709 bp, Homo sapiens
  misc_feature: GYAE6OF01DL4ZV.14.36.D03.1.454.CMB.1.raw
  modified_base (182)..(182): a, c, t, g, unknown or other
  misc_feature (182)..(182): n is a, c, g, or t
  modified_base (210)..(210): a, c, t, g, unknown or other
  misc_feature (210)..(210): n is a, c, g, or t
  modified_base (214)..(214): a, c, t, g, unknown or other
  misc_feature (214)..(214): n is a, c, g, or t
  modified_base (228)..(228): a, c, t, g, unknown or other
  misc_feature (228)..(228): n is a, c, g, or t
  modified_base (279)..(279): a, c, t, g, unknown or other
  misc_feature (279)..(279): n is a, c, g, or t
  modified_base (327)..(327): a, c, t, g, unknown or other
  misc_feature (327)..(327): n is a, c, g, or t
tcagcgtctagtaccacgaccggtgctcgatttagctgcgtcacgatctctcgttggggggggtctcgaggaggcagcgctctcgaggacatctccaccatcggccgtgggctctgctgcctcctccaccctcctcactcgacggcgacgcgggtccgtcgggcccagtctcgcctgactcncgcctcgtcctcgtgtcgtcggtctcgngacngtcgatcactctcnctcgccacgtacgaaccgagcgtaggtcgttaggttaggttagtaatagtntcgtactctacgaacaacaccgaccgacgaaccaaccgaccctaactntattcgtattagagtaacgtacgtagaccgtcggtaccttaggtaggttactacgtcgttcttcgacgtcgtactcgtaacgcgtacgaccgtaccgtccgtacctccgtacgaccctctacggtccgacgtccgttaccgcggtacgacggtacggacttcgttacttagttactttcgtaacgtcgactacgtaccgtacttaacggtacctacgtaccggtaccgtagaccgtaatcgttacgttaccggtagggttttccgggtttaacccgggggaccggggttaaacgggggtacccgttaaccggggtacccgggtttaacccgttacgggaacgtaccccggtaaacgggtacccgggttccccgtaccccggg

SEQ ID NO: 196544 - DNA, 730 bp, Homo sapiens
  misc_feature: GYAE6OF01B5X9V.14.36.D03.1.454.CMB.1.raw
  modified_base (221)..(221): a, c, t, g, unknown or other
  misc_feature (221)..(221): n is a, c, g, or t
  modified_base (234)..(234): a, c, t, g, unknown or other
  misc_feature (234)..(234): n is a, c, g, or t
tcagcgtctagtaccacgaccggtgctcgatttagctgcgtcacgatctctcttgggggggggtctcaggaggcagcgctctcaggacatctccaccatggcctgggctctgctgctcctcaccctcctcactcagggcacagggtcctgggcccagtctcgccctgactcagcctgcctccgtgtcgtgggtctccgtggacagtcgatcaccatctccngcactaggaaccngcagtgtacggttggttaggttaataagttatcgttcctccgtacggtaacccaaccaaccgaccccgaaggaccaaaccgacccccaaactcatgtaatttagtggtaacgtacaacgttaacgtccggacccgttacggtacgggttttacctaacgttccgtctttccgtaccgttcggtaccgtaccgtaacgttccgtacggacctaacccgtcccggtccccttacccgtaccgacctacgttcccgtcggtcgggtcccgtaccggacggtcggtagggaacggtaccgtagttcgtacgttagttttaacttagttacgccgtacgtcctaactacttacgtccgtaacccgtcggtacgacctacgaccgttaactcgtaacgggtttggggtttccggggtttaccggggggaaccggggttaacgtacgggttacccgtacccggttacggtacggacccgacgggtcccgtacggtacccccgg

SEQ ID NO: 196545 - DNA, 635 bp, Homo sapiens
  misc_feature: GYAE6OF01CN1KD.14.36.D03.1.454.CMB.1.raw
  modified_base (233)..(233): a, c, t, g, unknown or other
  misc_feature (233)..(233): n is a, c, g, or t
  modified_base (275)..(275): a, c, t, g, unknown or other
  misc_feature (275)..(275): n is a, c, g, or t
  modified_base (305)..(305): a, c, t, g, unknown or other
  misc_feature (305)..(305): n is a, c, g, or t
tcagcgtctagtaccacgaccggtgctcgatttagctgcgtcacgatctctcgttggggggggtctcaggaggcagcgctctcaggacatctccaccatggcctgggctctgctgctcctcaccctcctcactcagggcacgagggtcctgggcccagtctgccctgactcagcctgcctccgtgtctgggtctccgtggacagtcgatcaccatcctcctgcactggaaccngcagtgtagttggtaggttatagtatgtctcctgacaacacnccagacaacgccccaaatcatagtattagngagtacagtaactcggccctacgtagggtttactacgtcgtccttcgtcgtcggtacctccgaaagttctacgggtaccaaccgtcccgggtccctacccgtacggacctacgttccgttccgtcgggtcctaccgaggtcctagggacggtacgtacgttcgtacgtatttaagttacgttcgactacgtctactatacgtacgaccgtacctcgggacaacggtactaacgtccgtagttcggggtttcgggtttaccggggaccggggggtacctaacgggttccgaccggttacggttacgaccgaccgacccgtacggtccccgg

SEQ ID NO: 196546 - DNA, 752 bp, Homo sapiens
  misc_feature: GYAE6OF01DA99N.14.36.D03.1.454.CMB.1.raw
  modified_base (171)..(171): a, c, t, g, unknown or other
  misc_feature (171)..(171): n is a, c, g, or t
  modified_base (213)..(213): a, c, t, g, unknown or other
  misc_feature (213)..(213): n is a, c, g, or t
  modified_base (216)..(216): a, c, t, g, unknown or other
  misc_feature (216)..(216): n is a, c, g, or t
  modified_base (229)..(229): a, c, t, g, unknown or other
  misc_feature (229)..(229): n is a, c, g, or t
  modified_base (572)..(572): a, c, t, g, unknown or other
  misc_feature (572)..(572): n is a, c, g, or t
tcagcgtctagtaccacgaccggtgctcgatttagctgcgtcacgatctctcgttggggggggtctcaggaggcagcgctctcaggacatctccaccatggcctgggctctgctgctcctcaccctcctcactcagggcacagggtcctgggcccagttctgccctgactnacgcctgcctcgtgtcgtggtctcgtggacagtcgatcaccntcnctgcatcggaccngctagtgtacgttggtgttaataagtattggtctctacggtaccaacaaccgaccgaggacaaaaccgacccccaaataccagtgtaatttacgtaggtacggtactaggtaaccgtccggaccccgttgttaacgggtttctaacgttccgttcttactcgttcgactacgtaagtcgcggtacaaccgcggtcccttcccgtcgaccgacttccgtcgttacgggcctcggtacggtcgtacgggacggtactacgttacgttacgtaagttttaacttcgttacgacgtcggttaccttacgtaaacgtttccgtacgacccttacccggtttaacgggngtaaacccgggttaacctaacgtttaccggttaaggtttcccgggggttttaaacggggttttacccgggggggaaaccgggggttaacccggttaaaccgggttcccggttaacccggtttaaccgggttaccgggttacccggaaacccgtccccgggttaaaggggttcccccccgg

SEQ ID NO: 196547 - DNA, 704 bp, Homo sapiens
  misc_feature: GYAE6OF01BX007.14.36.D03.1.454.CMB.1.raw
  modified_base (176)..(176): a, c, t, g, unknown or other
  misc_feature (176)..(176): n is a, c, g, or t
  modified_base (235)..(235): a, c, t, g, unknown or other
  misc_feature (235)..(235): n is a, c, g, or t
tcagcgtctagtaccacgaccggtgctcgatttagctgcgtcacgatctctcttgggggggggtctcaggaggcagcgctctcaggacatctccaccatggcctgggctctgctgctcctccaccctcctcactcgagggcacgagggtcctcgggcccagtctcgccctgactcngctcgcctcgtgtcgtggtcctcgtggacagtcgatcacactctctgcacgtacggacngctagtgtagtttgttaattattatttctcctacgtacggaccaacgacgccaccgtacggaccaaaccgaccccctaatctaatttcgttagcggtagtaactaacgtacgtcccgtaccgtagtaacggttatttacctacgtaccgtcctttctccgtcggtaccctactagttccgtacggaacctaaccggtccggtaccccttaccggtagaccgtacttacccgttccggttacgtacggtaccctacgggtacgggttacggtacggggaacggtaccggtacgggtacttaggttaactttcggttacgtcgatccgttaacctatacgttactaacgtatacggaattacgtcgtttaggggttaccggttcggaaccggtacggggtaccgttaggtcccggttccgtacgttccgggacctaccggccgtaaccggttcccgtaccggtacccccgg

SEQ ID NO: 196548 - DNA, 678 bp, Homo sapiens
  misc_feature: GYAE6OF01CTJV3.14.36.D03.1.454.CMB.1.raw
tcagcgtctagtaccacgaccggtgctcgatttagctgcgtcacgatctctcgttggggggggtctcaggaggcagcgctctcaggacatctccaccatggcctgggctctgctgctcctcaccctcctcactcaggcacagggtcctgggcccagtctcgccctgactcagcctcgcctccgtgtctcgggtctccgtggacagtcgatcaccatcctcctgccactcggaaccagcaggtgacgttggtagttataagtatcgtctccgtagtaccaacaaccacccgaggaccaaaccgacccccaaactcatagtaatttagtggagtacaagttaacgtccggtcccgttacggtagggtttactaacgtccgtctttcgtcgtcggtcctaccgtaagttccgtacggacctaaccgcccggtccctacccgtacgtaaccctacgttccgtacggtcgggtccctaccggcggtacgtagggacggtacgtacgttcttaggtaatttatttacgtacgactacgtacctactattacgtcgtaccgtacgttcggactacgactagtacgttaggttcgggttcggggtttaccgggggaccggggttaaccgaacggggttccgtacccggttaccgttacggaccgtaccggacccgtacggtccccg

SEQ ID NO: 196549 - DNA, 725 bp, Homo sapiens
  misc_feature: GYAE6OF01EDS0N.14.36.D03.1.454.CMB.1.raw
  modified_base (181)..(181): a, c, t, g, unknown or other
  misc_feature (181)..(181): n is a, c, g, or t
  modified_base (217)..(217): a, c, t, g, unknown or other
  misc_feature (217)..(217): n is a, c, g, or t
  modified_base (260)..(260): a, c, t, g, unknown or other
  misc_feature (260)..(260): n is a, c, g, or t
  modified_base (528)..(528): a, c, t, g, unknown or other
  misc_feature (528)..(528): n is a, c, g, or t
  modified_base (571)..(571): a, c, t, g, unknown or other
  misc_feature (571)..(571): n is a, c, g, or t
  modified_base (595)..(595): a, c, t, g, unknown or other
  misc_feature (595)..(595): n is a, c, g, or t
tcagcgtctagtaccacgaccggtgctcgatttagctgcgtcacgatctctcgttggggggggtctcaggaggcagcgctctcaggacatctccacatggccgtgggctctgctgcctcctccaccctcctcactcgaggcacggtacgggtccgtcggacccagtctcgaccctgactcncgcctcgtccttcgtgtcgtcggtcctcgtaggacncgtcgactccacctactcctctacgccgtaacgtacggaaccngtcgtaggttacggttacggtttggttagttaataagttcgttccgttcctaccgtacgtaaaacccaaccaaacccgaccgaacggtaacccaaaccccgacccctaaatcgtaagttacgttaagttagtacgggattaacgtaacgtacgtccggtacgttaggtacggttactacgtcgttcttacgtcgtcgtactaccgtacgtacgtacgaccacccgtccggtcccttaccgagtaccttgtccgtcggtacgctacggngcgtaggacggtattcggtctagtttattaagtcgtacgcgtntactatacgacgttcgaccgtcgngaactccgtagtaccgtgttcgggtttacgggttacccgggggttgggggtaaaccgtacgttaccggggtaccttacccgggttacgggtaacgtacccggtacgtaaccccgggtgttaccccccggg

SEQ ID NO: 196550 - DNA, 703 bp, Homo sapiens
  misc_feature: GYAE6OF01EQ2RE.14.36.D03.1.454.CMB.1.raw
tcagcgtctagtaccacgaccggtgctcgatttagctgcgtcacgatctctcttgggggggggtctcaggaggcagcgctctcaggacatctccaccatggcctgggctctgctgctcctcaccctcctcactcagggcacagggtcctgggcccagtctcgccctgactcagcctcgcctccgtgtcgtgggtctccgtggacagtcgatcaccatctcctgcactacggaaccagcagtgtacggttggttaggttaataagtatcgtctccgtacggtaaccaaaccaaccacccgacggacccaaaccgacccccaaactacaattagtaatttagtggtaggtactaagttaacgtcccggtacccgttacgtacggggtttacttaacgtcgtactttcttaccgtcggtacctaccgtaacgtcgtacggaccaaaccgtcccgggtaccccttacccgtaccgtaccctacgttcccgttccggtcgggtcccttacccggacggtacgtacgggaccggacgtacgttacgttagttaagttttacgttagtttcgactacgtaccgtactaacgtacgttacgaccgtaccgtggaccagactagtacgttagttcgggtttcggggttacggggacggggtaaccgtacgggtcggtaccgtacgtacggtaccgacggtccgacggtcccg

SEQ ID NO: 196551 - DNA, 758 bp, Homo sapiens
  misc_feature: GYAE6OF01BBHJB.14.36.D03.1.454.CMB.1.raw
  modified_base (232)..(232): a, c, t, g, unknown or other
  misc_feature (232)..(232): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacgagggtcctgggcccagtctcgccctgactcagcctgcctcgtgtcgtgggtctcctggacagtcgatcaccatctcctgcacgtggaaccngcagtgacggttggtaggttataagttatgtctccgtacggtaaccaacaaccaccaggaccaaaccgaccccaaactcatagtatttagtgacgtacaagtactccggtccttaggtacgggtttactaagttctctttcgtcgtcgtctacgtacgtcgtacggaccaacgtacccgtccctccgtacgacctacttccgtacgtcggtcctacggacggtcgtagggaacggtacgtagttcgttattaacgtttatttacgttcgacgttacgtaccttactaacgttacgtaccgtaccgtaccggttacggaccgaacgtaacccgttaacgttaaggttaccgggtttttaacgggggggttttcccggggggttttaacccggggggggtaacccggggggttaaacccgggttaaccggggttaccccggggtttaacccccgggttaccgggttaacccggggttaaacccggtcccccggggtaaacccggttaaccccgggttcccccccgggg

SEQ ID NO: 196552 - DNA, 747 bp, Homo sapiens
  misc_feature: GYAE6OF01CAIZK.14.36.D03.1.454.CMB.1.raw
tcagcgtctagtaccacgaccggtgctcgatttagctgcgtcacgatctctcttgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactacggaaccagcaggtgtacggttggtaggttaataagtattcgtcctaccgttacggtaacccaaaccaaaccgaaccccgaacggaacccaaaaacccgaccccccctaaaacgtcctaattaggttaactttagtagggaacggttactaaaggttaaccgtcccggtacccgttacggttaacggggttttacctaagttccgtactttccgtccgttcggtacccttaccgtaacggtccgtacggaaccaacccgtacccgggtccctacccgtacgaccctacgttccgtccgtacgggtaccctccggacggtcggtaggaacgggacgtacgttcgtagttactttattagtcgacgtagtctacagttacgtcgccgtacgtcggtacaacggtactaacgttcgaggtttcggggtttccgggtttccggggggaacccggggttacgaaccgggttacgggtaccccgttacggtaacggaccgaacccggtacccggtaaccgggtccccgg

SEQ ID NO: 196553 - DNA, 1089 bp, Homo sapiens
  misc_feature: GYAE6OF01DSF22.14.36.D03.1.454.CMB.1.raw
  modified_base (884)..(884): a, c, t, g, unknown or other
  misc_feature (884)..(884): n is a, c, g, or t
  modified_base (896)..(896): a, c, t, g, unknown or other
  misc_feature (896)..(896): n is a, c, g, or t
tcagcgtctagtaccacgaccggtgctcgatttagctgcgtcacgatctctcgttggggggggtctcgaggaggcagcgctctcaggacatctccaccagtcggccgtgggctcgtgctcgtcctccctcctaccctcctcactcgacgggccacggacgggttcccgtcgggaccctagtcctcgcctcgactccgcgtcctccgtccgtccggtcgttccggttcgggtccttcgtcggacgtcgtacgactaccgaacttctcctccgtagactaaccggtacgaaccgagacggtaggttcgggttaacggttggttaagttaagtaacggttacttccggttaccgttaccggttaaaccgtaaaacccaaaccgaaccccgaaccggtaacggaaacccccgaaaaccccgttaaacccccgtaaattaccgttaaacgtttacgtttaaacgttaaacggttacgggtaaccgtttaacgtaaacccgggttccccggtttaccccgggttaacccgggtttaaaccggggtttacggggttttaaccctaaaccggtttccggtttacccgtttacccggtttaccgggtaccgtttacccgtaaaaccggggtaccgtttccgggtaaaaacccgggacccttaaccccggtcccccgggttaccccttaccgttaaacccgtccgttaacccgggtttcccttccggggaacccggggtttcccagggggttaaaacccccgggtgggttaaccggggggtaaactttaccccgggttacgttgggtttttaaaaccgtttaccggttttaattcggggaacctttaccgggtactttaaccgtaaggtttcccgtaacgcccgggtttaaacncccgggttaaanaccggttaataccggtttccgggttacgggttttaacggggggtttttacccggggggttaaccggggggtaaacccggtaaaccccggggttcgggtaaacccgggttaccccggtttaacccgggtttcccgggaaacccggttaaccgggaaccccccggtttacccggttcccccggggttacccccgg

SEQ ID NO: 196554 - DNA, 619 bp, Homo sapiens
  misc_feature: GYAE6OF01DYWL9.14.36.D03.1.454.CMB.1.raw
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
  modified_base (224)..(224): a, c, t, g, unknown or other
  misc_feature (224)..(224): n is a, c, g, or t
  modified_base (314)..(314): a, c, t, g, unknown or other
  misc_feature (314)..(314): n is a, c, g, or t
tcagcgtctagtaccacgaccggtgctcgatttagctgcgtcacgatctctcgttggggggggtctcagggaggcagcgctctcaggacatctccaccatggcctgggctctgctgctcctcaccctcctcactcgagggcacagggtcctgggcccagtctcgccctgactcagcctgcctccgtgtctgggtctcgtggacngtcatcaccntctctgcacnggaaccagcagtgacggtttggtaggttataagtatgtctcctagtacaacacaccagacaaacgacccaactcatgtattagtgagtanaacgtaagtccgtccgtgtacgggttactaactcgtactctcgtcgcctacagtcgtcgaccaacgaccgccctaccgtcacctactccgtcgtcggtcctaccgacggcgtagacgggacgtagttcgtagttagtttacttgttacgctacgtctatacgtagtccgtctaccgtggacacgactaagttccgtaagggttcgggtttccgggggtttagggggacccgggggtaaacgaacggggttccgggtaacccggttccggtaaccggtccggaaccggacccgtaggtacccccgg

SEQ ID NO: 196555 - DNA, 833 bp, Homo sapiens
  misc_feature: GYAE6OF01CT60P.14.36.D03.1.454.CMB.1.raw
  modified_base (175)..(175): a, c, t, g, unknown or other
  misc_feature (175)..(175): n is a, c, g, or t
  modified_base (225)..(225): a, c, t, g, unknown or other
  misc_feature (225)..(225): n is a, c, g, or t
  modified_base (248)..(248): a, c, t, g, unknown or other
  misc_feature (248)..(248): n is a, c, g, or t
tcagcgtctagtaccacgaccggtgctcgatttagctgcgtcacgatctctcgttggggggggtctcaggaggcagcgctctcaggacatctccaccatggcctgggctctgctgcctccctcaccctcctcactcgaggcacgacgggtcctggcccagtctcgccctgactcngcctcgccttcgtgtcgtcggtactccgtggactagtcgactccaccgtntcctcctcgacacgtcggaaccngcaggttcgtacggttggtagttaagtacgtagttcgtccgtccgttacgtaaccaaccaaccgaccgaagaacccgaacccgtacccctaactcgtaactagttactttaggtacggtacgtacgtaagtaccgtccggtaccgttaggttacggttctacgttcgtctttcgtcgtcgtactacgacgtccgtacgggaacctaccggtcccgtaccctacctcggtaacctaccgttcgtccgggtccggtaccctacccggtaggtccgtaacggtacggtacgtcgttacgttaacgttacgtttacgtttaacggtacgtacgttaacgttaccgtacgttaacgtttaccggaccgtacccggttacgtacggtaccgtaacggttaaacctacggggttaccttttaacggggggtttcccggggttttacgggggggtttaacccccggggggtaacccggggttaaaacccggggttcccgggtttaaaccccggtaacccccgggtttccgggtttaaacccgggacccgggtttaacccccgggtaaacccgggttccccggttacccccggg

SEQ ID NO: 196556 - DNA, 742 bp, Homo sapiens
  misc_feature: GYAE6OF01AG3FX.14.36.D03.1.454.CMB.1.raw
  modified_base (215)..(215): a, c, t, g, unknown or other
  misc_feature (215)..(215): n is a, c, g, or t
  modified_base (235)..(235): a, c, t, g, unknown or other
  misc_feature (235)..(235): n is a, c, g, or t
  modified_base (334)..(334): a, c, t, g, unknown or other
  misc_feature (334)..(334): n is a, c, g, or t
tcagcgtctagtaccacgaccggtgctcgatttagctgcgtcacgatctctccgtggggggggtctcaggaggcagcgctctcaggacatctccaccatggcctgggctctgctgctcctcaccctcctcactcagggcacgagggtcctgggcccagtctgccctgactcagcctgcctccgtgtcgtgggtctccgtggacagtcgatcaccntctcctgccacgtggaaccngcagtggtacgttggtaggttataagttatcgtcctccgtacggtaacccaaacaccacccgaggaccaaaacccgccccaaactcaattgtattttanggtaagtacaggttaactccggtcccgttggtaacgggtttctaactcgtcttacgtcgcgtcctacgaacgttcgacggaccaacgcccgtccctacccgtacgaccttactccgttcggtaccggccttaccggacggtcgtaggaacggtaccgggttacgttacgtgtttaattttacgtttacgttgaccgttacctcgttacctagttacgtaccgtaccccgtaccgttacgggacctaacggtacttaaaccggttccggttaacgggtttcgggggttttaccggggggtttcccgggggggaaaacggggttcccgggttaaacggggttccccgttaacccgggttacggtaccggttaacccggccccggtaaccccgggtaccgggttcccccgg

SEQ ID NO: 196557 - DNA, 713 bp, Homo sapiens
  misc_feature: GYAE6OF01AFRAV.14.36.D03.1.454.CMB.1.raw
  modified_base (202)..(202): a, c, t, g, unknown or other
  misc_feature (202)..(202): n is a, c, g, or t
  modified_base (292)..(292): a, c, t, g, unknown or other
  misc_feature (292)..(292): n is a, c, g, or t
  modified_base (529)..(529): a, c, t, g, unknown or other
  misc_feature (529)..(529): n is a, c, g, or t
  modified_base (606)..(606): a, c, t, g, unknown or other
  misc_feature (606)..(606): n is a, c, g, or t
tcagcgtctagtaccacgaccggtgctcgatttagctgcgtcacgatctctcgttgggggggggtctcaggaggcagcgctctcaggacatcctccaccatggcctgggctctgctgctcctcaccctcctcactcagggcacgagggtcctcgggcccaggtctgccctgactcacgcctcgcctccgtgtcgtgggtccnccgtggacctagtccgatccgccacgtcctcctggccacgtacggaaccaggcctaggtaggtaccggttgggttagttaattaaaggtntcgttaccgtcgtacggtaacccaaactaacccacccgaaggaccaaaacccggtcccctaaaagcgtaactagtatttaaccggaggtacggtactaacggtaacgtcccggtacccgtaaggtacgggttttaccaacgttccgtaactttccgtagtccggtacctaccgtagttccgaggacctaaccggtccggaccctccgtacgaccctatccgtacgcggtctacccgnggactgggacgtacgtacgttcgtaagtatttatacggtcactagtcctaactagtaacgtcaccgtcgacgggtanaacgtacgtacttacggagtttcggggtaccgggtttcggggacggggttaacgaccggttacgacccggtccggtagtaccgacccggaacccgtagggtccccgg

SEQ ID NO: 196558 - DNA, 579 bp, Homo sapiens
  misc_feature: GYAE6OF01D7I9C.14.36.D03.1.454.CMB.1.raw
  modified_base (230)..(230): a, c, t, g, unknown or other
  misc_feature (230)..(230): n is a, c, g, or t
  modified_base (304)..(304): a, c, t, g, unknown or other
  misc_feature (304)..(304): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatccaccatctcctgcactggaaccngcagtgacgttggtgttataagtatgtctctgtaccaacaacaccagacaaacgccccaaactcatgtatttangagtacaagtatcggcctcgtagggttctaagtcgcttctcgtgctacatcgtgcaacgaccgcctccctagacctatcctcgtcgggcctccgaggtctggacgacgtagtctagtatttattattcgactacgcttacattagtcgactacccgtggacaacgtactaagttctagttcggggtttcggggtttaccgggggccggggtaaaccgtaacgggttccgtaacccggttccgttaggtacccgacggaccccggaacggtccccg

SEQ ID NO: 196559 - DNA, 741 bp, Homo sapiens
  misc_feature: GYAE6OF01D5RI7.14.36.D03.1.454.CMB.1.raw
  modified_base (240)..(240): a, c, t, g, unknown or other
  misc_feature (240)..(240): n is a, c, g, or t
  modified_base (423)..(423): a, c, t, g, unknown or other
  misc_feature (423)..(423): n is a, c, g, or t
tcagcgtctagtaccacgaccggtgctcgatttagctgcgtcacgatctctcgttggggggggtctcaggaggcagcgctctcaggacatctccaccatggcctgggctctgctgctcctcaccctcctcactcgagggcacgacgggtcctgggcccagtctgccctgactcagcctgcctcggtgtctgggtcctcgtgacagtcgatccacctatcctcctgactactacggaaccngcgaggttcgtacggtttggtagttaataagttatcgttcctccgtacggtaacccaacaaccacccgaggaaccaaaccgacccccaaactctatagtatttagtaggtacgtagtaacgtaacgtccgtacccgttcgtaggggtttactactccgtcttcgtcgtcgtctacacggttcncggacaccgtaccgtccctaccgctaccagttccgtacgtcgggtccaccggtaggtaccgttagggaacggtacgttagtttacgtagtttatttaacgtttagtacgctaaggtccttaagtacgtaaccgtcgtaccgtaaccggtcgaaccgtacgtaacgtaacgttcggttaacggggttttcggggtttaccggggggtttaccgggggtaacccgggggtaaccggttaaacggggttcccggtaaccccgggtttacccggttaacgggtcccggaaacccgggtcccggtaacccgggttccccccgg

SEQ ID NO: 196560 - DNA, 680 bp, Homo sapiens
  misc_feature: GYAE6OF01AGNYP.14.36.D03.1.454.CMB.1.raw
  modified_base (178)..(178): a, c, t, g, unknown or other
  misc_feature (178)..(178): n is a, c, g, or t
tcagcgtctagtaccacgaccggtgctcgatttagctgcgtcacgatctcgtcttggggggggtctcaggaggcagcgctctcaggacatctccaccatggcctgggctctgctgctcctcaccctcctcacgtcagggcacgagggtcctcgggcccagtcctcgccctgactcacncctcgcctccgtgtcgtcgggttcctccgtggacagtcgatcaccactcctctcgcactaggaaccagcagtgtacgttggtggttatagtatgtctcgtacgtaccaacaaccgaccgacgaccaaccgacccctaaactcattagtactttagtacgtacggtactaacggtacgtccggtccgttacggtacgggtttacctaacgtcgtcttcgtacgtcgtctaccgtacggtccgacggaccaaaccgtcccgtaccctcccgtacgtacctactccgtccggtacggtcaccggacggttacgacggtacggtacgttacgttgttacgtatttaacgttcgaagtccagttcctacgtactactccgacgttaccgcgactaaccgactagtaccggttagtttaccggggttacgggttacgggggtaccgggtaacgtacggggtaccgtaccgttacggtaacggtcctaacggcccgtacgtcccccggg

SEQ ID NO: 196561 - DNA, 846 bp, Homo sapiens
  misc_feature: GYAE6OF01DCC31.14.36.D03.1.454.CMB.1.raw
tcagcgtctagtaccacgaccggtgctcgatttagctgcgtcacgatctctcttggggggggtctcaggaggcagcgctctcaggacatctccaccatggcctgggctctgctgctcctcaccctcctcactcgaggcacgagggtcctgggcccagtctcgccctgacctcacgcctcgtcctccgtgtcgtcgggtcctccgtaggactacgtcgactccacctacttccgtcctcgtaccacgtacggaaaccagtaccgaggttgggacggttttgggttacgttaattaagtacttcgtccttaccggtacggtaacccaaaaccgtaaaccaaccccgggaacggaacccaaaacccgtaacccccccgtaaaatactaacgttacgttaattttaacggtgggtaacggtacgtaacggtaaacgttccccggtaccccgttcgggttaacgggttttacttaacggtccttcgtttacgtcgtaccgggtacctaccgtacgtccgtacggacctaaacgtccggtaccgtaccccttcccgtaagtaccctaccgttcggttaccgtccgggtacgtaccggacgggtaccggtaggaacggggtacgttacgttacgttaggtttaacttttacgttacgtttcgaacgtacggttacctacgtacgttacgtcgacccggttaccgtacgacgtacgtacgtacgttacggttggtttaccggggtttaccgggggggtttacccgggggtcgggggtaaacccggttaaccggggacccgggttacccggtttaacggtaccgggtaaccggacccgggtacccggtacccggg

SEQ ID NO: 196562 - DNA, 715 bp, Homo sapiens
  misc_feature: GYAE6OF01ER9YT.14.36.D03.1.454.CMB.1.raw
  modified_base (219)..(219): a, c, t, g, unknown or other
  misc_feature (219)..(219): n is a, c, g, or t
  modified_base (240)..(240): a, c, t, g, unknown or other
  misc_feature (240)..(240): n is a, c, g, or t
tcagcgtctagtaccacgaccggtgctcgatttagctgcgtcacgatctctcttggggggggtctcaggaggcagcgctctcgaggacatctccaccatggcctgggctctgctgctcctcaccctctcactcgagggcacgagggtcctgggcccagtctgccctgactcagccctgcccttcgtgtcgtgggtcctaccgtggacaggtcatccacntctcctgcctatcggaaaccngctagtgtacgttggtaggttaataagtagtcgtcctccgtacggtaaccaaacaaccacccaggaccaaacgaccccaaactacgactagtaatttatagtaagttacctacgttaacgccggtacccgtacgtaaggggttacttacgttaacgtcgtcgtttacctccgtacggtaccctaccgttaacgtaccgtacggaaccgtaaaccgtacccggtaacccttccccgtaccgtaacccgttccgtccgtccggtcccttaccgaacgtaaccgtacggaacggacggacgggtaccttaggtaactttaacgttactaccggtaccctaactacctaataacgtaaaggtaacgttaacgttaacctacgttaccgtggtttacgggtttcgggacggtacggaacgtacgtacgacgtacccgcgtaacgtacgacgaccgtacgcccgtcccgccccgttaccgg

SEQ ID NO: 196563 - DNA, 781 bp, Homo sapiens
  misc_feature: GYAE6OF01E2HC2.14.36.D03.1.454.CMB.1.raw
  modified_base (212)..(212): a, c, t, g, unknown or other
  misc_feature (212)..(212): n is a, c, g, or t
tcagcgtctagtaccacgaccggtgctcgatttagctgcgtcacgatctctcgttgggggggggtctcagggaggcagcgctctcaggacatctccaccatggcctgggctctgctgctcctcaccctcctcactcgagggcacgagggtcctgggcccagtctcgccctgactcagcctcgccctccgtgtcgtgggtcctccgtggaccngtcgatccaccattcctcctgcctaccgtaggaacccagctaggtcgtacggttggtagttaataagttatcgtctccgtacggtaacccaaacaaccgaccccgaaggaaccaaacccgaccccctaaaactactacgttagttaatttaacgtggacggttacgtaagtaacgtcccggtccgttaggtacgggtttactaacgtcgtcttcgtcgtacggcctacgtacgtcgtacggaccaaccgtcccggtccctacccggtacgtaccctagttcccgttcggtacgggtccctccggtaacgggtccgttagggaaccggtaccggtacgttacgttagttactttagtttacgttcgaccgttacgtccttaacgttactaacggttccgtaccgttaccggtcggtaacctacgtaacttacgtcggttaacggtttacgggggtttccggggtttaacgggggacccgggggtaaacggttaccggggtacccggttaacccggttaccgggtaccggttaaccggaccccgggttaaccgtaacccggttcccccggg

SEQ ID NO: 196564 - DNA, 692 bp, Homo sapiens
  misc_feature: GYAE6OF01DX7Q1.14.36.D03.1.454.CMB.1.raw
  modified_base (243)..(243): a, c, t, g, unknown or other
  misc_feature (243)..(243): n is a, c, g, or t
  modified_base (322)..(322): a, c, t, g, unknown or other
  misc_feature (322)..(322): n is a, c, g, or t
tcagcgtctagtaccacgaccggtgctcgatttagctgcgtcacgatctctcgttggggggggtctcagggaggcgagcgctctcaggacatctccaccatggcctgggctctgctgctcctcacctcctcactcgagggcacgagggtcctgggcccagtctgcctgactcagcctgcctccgtagtcgtgggtctccgtggacagtcgatccgacctatcctcctagcacgtacggaaccngcgagtcgacgttggtagttatagtatgtactcgtagtaccaacaacaccagcaaacgaccccaactcatagtattagngagtcaagtacgtcggacctggtacgggttactaagtcgtctcgtcgacggtacacgtagtcgtcggtacaaccgaccggtcctacccgtagaaccctacttacccgtcggtccggtaccgttcccgtacggtacgtaacggtacggacccgttaggttcccgttaaggttactttaacggtttacgtacggacctaagtaccgttacttaagtaacggttcgtaacccgtaccgttagggactaaccgggaacttaaaggtccttagggttacggttcgggggttttaccggggaccggggtaaaccgtacggggttcggaaacccggttcggtaaccggtctaaaccggcccggtaacgggtaccccg

SEQ ID NO: 196565 - DNA, 802 bp, Homo sapiens
  misc_feature: GYAE6OF01EFUFZ.14.36.D03.1.454.CMB.1.raw
tcagcgtctagtaccacgaccggtgctcgatttagctgcgtcacgatctctcgttggggggggtctcaggaggcagcgctctcaggacatctccaccatggcctgggctctgctgcctcctcaccctcctcactcgagggcacgagggtcctgggcccagtctcgccctgactcagcctgccctcgtgtcgtggtctcgtggacagtcgatcaccatcctcctgaccacgtacggaaccagcgtagtcggtacggtttgggttagttaataagttattcgttcctccgtacggtaacccaaccaaccacccgaacggaccaaaaccgacccccaaactcagtagtatttagagtacggtacagtaacgtccggtacccgtacgtacgggtttactaacgtccgtcttcgtcgtcgtacctacgtacgtcgtacgacccgaaaccgtccggtcccctacccgtaccgtaccctacgttccgttccggtcgggtccctacccggtaacgggtaccgtacgggaacgggtaccgtaggtttccgttaaggtttaacttttaacgttttacgttacggaccgtaacggttaccgttacgtaacgtttacgtaccgtacccgttacccggttacggaaccgtaacggtaacttaaccggttaccgttaacgggtttcgggggttttacgggggtttacccggggggaacccgggggttaaaccgtacgggggttaacccggttaaccccgggttaacgggtacccggggtaaccctacccgggtaacccggtaccgggtacccccgg

SEQ ID NO: 196566 - DNA, 770 bp, Homo sapiens
  misc_feature: GYAE6OF01BY2JF.14.36.D03.1.454.CMB.1.raw
  modified_base (135)..(135): a, c, t, g, unknown or other
  misc_feature (135)..(135): n is a, c, g, or t
  modified_base (222)..(222): a, c, t, g, unknown or other
  misc_feature (222)..(222): n is a, c, g, or t
  modified_base (511)..(511): a, c, t, g, unknown or other
  misc_feature (511)..(511): n is a, c, g, or t
tcagcgtctagtaccacgaccggtgctcgatttagctgcgtcacgatctctcgttgggggggggtctcaggaggcagcgctctcaggacatctccaccatggcctgggctctgctgctcctcacctcctcactcngggcacgagggtcctgggccagtctcgccctgactcacgcctcgcctccggtgtcgtcgggtctcctggactagtcgatccaacctntcctcctgacctaacgtcgggaacctagcgaagttcggtacggttggttagttaacttaacgttactcgtccttccgtaacggtaacccaaactaacccgacccgtaacgggaaccctaaaaccggaccccctaaacgttacctaaacgttaggttaatttaacgtggtaacgtacgtaacggttaacggtccggtaccgttcggttaacgggtttactacgttcgtacttcgtaccgtcgtaccttacgtacgtctacggactaaccgccgtcctaccgcgtaacctntccgtacgtcggcctaccgggtagcggtaaggacggtaacgtacgtttcgtagtttaacttaacgtttatcggtactacggtccttactaagtcttacgtaccgtacggtacgaacggtactaactaacgttcgttacgggtttacgggtttccgggggttaaccgggggaccggggttaaacgaccgggggttccggtaaacccgggttccgtttaaccggggaccctaaccgggttacccggtaacggtcccccggg

SEQ ID NO: 196567 - DNA, 759 bp, Homo sapiens
  misc_feature: GYAE6OF01BU2BX.14.36.D03.1.454.CMB.1.raw
  modified_base (614)..(614): a, c, t, g, unknown or other
  misc_feature (614)..(614): n is a, c, g, or t
tcagcgtctagtaccacgaccggtgctcgatttagctgcgtcacgatctctcgttggggggggtctcaggaggcagcgctctcaggacatctccaccatggcctgggctctgctgctcctccaccctcctcactcagggccacgagggtcctgggcccagtctgccctgactcagcctgcctcgtgtctgggtctctggactagtcgatcaccatcctcctcgactacgtcggaaccagcctagtcggtacggtttgggttaggttaattaaggttatcgttccgtccgttacggtaacccaaaacgaacccaaccccgaggaaccaaaccgacccccaaactccgattagtaatttagaggtaacgtacgtaacgttaacgtcccggtcccgttacggttacggggtttacttaacgtccgttcctttactccgtcgtcctaccgtaagtccgtacgacctaaaccgtcccggtacccctccgaccgtaccgtacttaccgtcggtccggtccgtacccgaggtaccggtaaggtacggaacgttacgttacttagttaatttaggtttactacggtctacgtacgttactagttaccgtacaccgttaccgngtaccgacgtacctagttaccggttaagggtttccggggtttcggggttacccgggggtaaccggggtaccgttaccgggtaccggttaaccccgttgggtaaccccgggtaaccggaccggttaacccggtccggtacccccgg

SEQ ID NO: 196568 - DNA, 720 bp, Homo sapiens
  misc_feature: GYAE6OF01C3L43.14.36.D03.1.454.CMB.1.raw
  modified_base (282)..(282): a, c, t, g, unknown or other
  misc_feature (282)..(282): n is a, c, g, or t
tcagcgtctagtaccacgaccggtgctcgatttagctgcgtcacgatctctcgttgggggggggtctcagggaggcagcgctctcaggacatctccaccatggcctgggctctgctgctcctccaccctcctcactcagggcacgagggtccgtcgggcccagtcctcgcccctgacctcacgcctcgcctccgtgtcgtcgggtctccgtggacagtcgatcaccgtatctcctgcacgtaggaaccagcgaggtcgtaacgttgggtaggttataacgtntacggtctccgtacggtaccaacaccaaccgaggacccaaaaccgccccctaaaattccaagtacgtaatttagtggtaacggtataacggttaacgtcccggtaccgtacggtagggtttcctaacgttcgtaccttcgtcgtgccgtccctaaggttcgtacgactaacgcccggtccctaccgtgtaccctatcccgtacggtcggacccgtaccgtacggtccgtacggggaacgtcggtacgttccttagtttaactttaattaggttaccgataggtccttaatagtacgttacgcccgttaagcgaccgtagactaagtcgttaagggttcggttacggggttacccgggggaaccgggggtaaccacggggttaccgtaccccgggtaccgtacggtaaccggacccctccgggaaccggttccccccgg

SEQ ID NO: 196569 - DNA, 795 bp, Homo sapiens
  misc_feature: GYAE6OF01CLERR.14.36.D03.1.454.CMB.1.raw
  modified_base (251)..(251): a, c, t, g, unknown or other
  misc_feature (251)..(251): n is a, c, g, or t
tcagcgtctagtaccacgaccggtgctcgatttagctgcgtcacgatctctcgttggggggggtctcaggaggcagcgctctcaggacatctccaccatggcctgggctctgctgctcctcaccctcctcactcagggcacacgggtcctcgggcccagtctgccctgactcacgcctgccctcgtgtcgtcgggtcctcctggacaggtccgatccaacctatcccgtcctgacctacgtacggaacccnggcctaggtcggtacggtttggttagttaataagtattcgtcttaccgtacgtaacccaaactaccaccgacggaccaaacccgtaccccccaaaatcctaagttcgtaattttagacggtaggttactaacgtaacgtcccggtacccgtttacgggtaacgggttttacctacgttccgtactttccgtcgtacggtccttaccgtaacggttcacggaccaaccgtcccggtcccctaccgtcgaaccctcgttccgtcggtcccgggtccctaccggacggtaccggtaaggtaggaaccgtcgtttacgtaacgtttagtttaaacgtttcgtagaccgtcgttaccctaggtacgttaccgtaccgccttaacccgtggtacctacgtaaaccctattaccggtagggtttccggggttttaccggggggtttacggggggaaacccgggggtaacccggttaaacgggggtccccgtacccggttaaccgggttaccgggtaccccaacgggttcccccggaaccgggttcccccgg

SEQ ID NO: 196570 - DNA, 309 bp, Homo sapiens
  misc_feature: GYAE6OF01AUH4R.14.36.D03.1.454.CMB.1.raw
  modified_base (270)..(309): a, c, t, g, unknown or other
  misc_feature (270)..(309): n is a, c, g, or t
tcagcgtctagtaccacgaccggtgctcgatttagctgcgtcacgatctctcttgggggctttttgatatcgtgggggccaagggacagtggtcaccgtctcttcagcctccaccgaagggcccagtccggtccttcccccgtggccaccctccctaccaagacgccacctcgtgggggcacgaggccggccgtgggctcgccgtggtacaaggtacctacttccgtaactagacgtcgtggcggcgggtctggacaagggcgctatagnnnnnnnnnnnnnnnnnnnnnnnnnnnnnnnnnnnnnnnn

SEQ ID NO: 196571 - DNA, 790 bp, Homo sapiens
  misc_feature: GYAE6OF01EMEUB.14.36.D03.1.454.CMB.1.raw
tcagcgtctagtaccacgaccggtgctcgatttagctgcgtcacgatctctcgttggggggggggtctcaggaggcagcgctctcaggacatctccaccatggcctgggctctgctgctcctccaccctcctcactcgagggcacgaggggtccgtcgggcccagttcgtcgccctgacctcacgtcctcgcctccggtgtcgtcgggtcctccgtggactaggtcataccacctactcctcctggccacgtacggaaccagcgtaggttaggtcggtttgggttaggtttaataagttacttcggttccttaccggtaacgtaacccaaaccaacccgaacccggtacggaacccaaaccccgaaccccctaaactaccgtaagttacgttaatttaaggtacgggtacggttaacgtaacggttacgtccccgggtacccggttacggttaaccggggtttaacctaacgtccgtttaccgtttccgtaccgtccggttaccgtaacccgtacggttaccggtaccgaacccggtaacccggtaccccggttccccgttaacccgtacgtaacccgtacttcccggttcgtccggggtccctacggacgggtcggtacggacggtaccgtattcggttaattacgtttattgacgtcgactctagtacgtctccgacgtcgagtacctaggactagtcgtagggtttcggggttccggggtacggggccgggtaacggtcggtaccggtacggtacgtacggaccgaccggtccggtaccggtcccgg

SEQ ID NO: 196572 - DNA, 654 bp, Homo sapiens
  misc_feature: GYAE6OF01C1Q6C.14.36.D03.1.454.CMB.1.raw
  modified_base (238)..(238): a, c, t, g, unknown or other
  misc_feature (238)..(238): n is a, c, g, or t
  modified_base (282)..(282): a, c, t, g, unknown or other
  misc_feature (282)..(282): n is a, c, g, or t
  modified_base (304)..(304): a, c, t, g, unknown or other
  misc_feature (304)..(304): n is a, c, g, or t
  modified_base (308)..(308): a, c, t, g, unknown or other
  misc_feature (308)..(308): n is a, c, g, or t
  modified_base (313)..(313): a, c, t, g, unknown or other
  misc_feature (313)..(313): n is a, c, g, or t
tcagcgtctagtaccacgaccggtgctcgatttagctgcgtcacgatctctcgttggggggggtctcaggaggcagcgctctcaggacatctccaccatggcctgggctctgctgctcctccaccctcctcactcagggcacagggtccgtgggcccagtctgccctgactcagcctgcctccgtgtcgtgggtctcctggacagtcgatcacctatctcctgcacgtacggaaaccngcgtagtggtacgttggtgttataagtatgtctcgtagaccaanacaccagaccaaaccgcccaancatntattngatacagtatccgcctacgtaggtttacaactcgtctttctacgtcggtacctaccgtagtcctaggaccaaccgtaccgtccctaccgtacgaactactcgtcgtcggctacgacggcgtcggaaggacgtacgttataacgttatttaacttacgtcggacctacggaccttaatacttaacgtcaccgtaccgtcgggactaacgactaaacgttccggtaatttccgggggttttcggggtttaccgggggtaacccggggggtaaacccgtaggggttaccccgttaccggttaccggtaacgggttcaaccgggttacccggaaccggtccccgg

SEQ ID NO: 196573 - DNA, 644 bp, Homo sapiens
  misc_feature: GYAE6OF01C74LB.14.36.D03.1.454.CMB.1.raw
  modified_base (236)..(236): a, c, t, g, unknown or other
  misc_feature (236)..(236): n is a, c, g, or t
  modified_base (324)..(324): a, c, t, g, unknown or other
  misc_feature (324)..(324): n is a, c, g, or t
  modified_base (440)..(440): a, c, t, g, unknown or other
  misc_feature (440)..(440): n is a, c, g, or t
tcagcgtctagtaccacgaccggtgctcgatttagctgcgtcacgatctctcgttgggggggggtctcaggaggcagcgctctcaggacatctccaccatggcctgggctctgctgctcctcaccctcctcactcagggcacgagggtcctgggcccagtctcgccctgactcagcctgcctccgtgtcgtgggtctcctggacagtcgatcacctatcctcctgcactggaaccngcagtgacggttggtggttaataagtatgtcctcgtacgtaccaacaaccacccgaggaccaaaccgacccccaaatcatgtactttntacgtacgtagtagtacgtccggacccttggtacgggtttactatccgtcttctctcgctacagtctcggaccacgacgtccctccgtgaacctctccgtcgtcgggtaccctcgnggactggacggcgtacgtcttagtattttagttacgtgtaccgattacctatagttactggtaccctcggttacggcctaagccgttaatcggttaaggttcgggttttcggggttacccgggggacccggggggtaaacgtaacgggttccggtaacccggttaccggttaggacccgtaccggacccggacggttcccccgg

SEQ ID NO: 196574 - DNA, 682 bp, Homo sapiens
  misc_feature: GYAE6OF01DP981.14.36.D03.1.454.CMB.1.raw
  modified_base (234)..(234): a, c, t, g, unknown or other
  misc_feature (234)..(234): n is a, c, g, or t
tcagcgtctagtaccacgaccggtgctcgatttagctgcgtcacgatctctcgttggggggggtctcaggaggcagcgctctcaggacatctccaccatggcctgggctctgctgctcctcaccctcctcactcagggcacgagggtcctgggcccagtctgccctgactcagctgcctcgtgtctggtctccgtggacagtcgatccaccatcctcgtgcacgtacggaaccngcgagtgacggttggtagttatagtatcgtctccgtagtaccaacaaccaccgacggaccaaaccgacccccaaatcgatagtattatagtagtactaagtacgtcgccgtagtagggtttacaatccgactttcgtcgtcggtcctacgtagtcctgaccgaacgcccggtacctccctacggtaacctacgtccgtcggtcggcctaccgtagggtctaacggtaccggtacggtacgttacgttaagtacttttattacgttctaccgtagtcttacgatacgtccgtacgtacccggtgggaacctaggtaactaacgtttaccgtagggtttcggggtttaccggggtttccgggggaaccggggttaaccgaaccggggttaccgtacccggttaccgggttaccgaccggtaacccggtacccgggtacggttacccccgg

SEQ ID NO: 196575 - DNA, 752 bp, Homo sapiens
  misc_feature: GYAE6OF01C3KA9.14.36.D03.1.454.CMB.1.raw
  modified_base (201)..(201): a, c, t, g, unknown or other
  misc_feature (201)..(201): n is a, c, g, or t
tcagcgtctagtaccacgaccggtgctcgatttagctgcgtcacgatctctcgttggggggggtctcaggaggcagcgctctcaggacatctccaccatggcctgggctctgctgctcctcaccctcctcactcagggcacgagggtcctgggcccagtctgccctgactcagcctgcctcgtgtcgtggtctcctggacngtcgatccacctatcctcctcgctacgtacggaaccagcaggttcgacggtttggtagttaataaggtattcgtcctcctaggtaaccaaaccaaccgaccgacggaaccaaacccgtacccccaaaatctattaggtatttacgtagtacggtactaacgtaacgtcccggacccgtttagtacgggtttacctagttccgttctttccgtcgtcggtactaccgtaacggttcgtaccgggaacccaaaccggtccccggtaccccttcccgtacgtaaccctacgttcccgtccggttcgggtaccctccggtacggcggtaaccgggacggaccggttacgttacgttagtacgttttaagtttcttacggacctacggtccttagtaaacttcgtaccgtccctacggttccggacgtacgtaaacctacgttccgttgggttaccgggtttcgggggtttaccgggggaaccggggtaaccggtaagggtcccgtaccggttcccggtacgggtacccgtaacggcccggttaacgggtcccccg

SEQ ID NO: 196576 - DNA, 663 bp, Homo sapiens
  misc_feature: GYAE6OF01DOU2X.14.36.D03.1.454.CMB.1.raw
  modified_base (245)..(245): a, c, t, g, unknown or other
  misc_feature (245)..(245): n is a, c, g, or t
tcagcgtctagtaccacgaccggtgctcgatttagctgcgtcacgatctctcgttgggggggggtctcaggaggcagcgctctcaggacatctccaccatggcctgggctctgctgcctcctcaccctcctcactcagggcacgcgggtcctgggcccagtcctcgccctgactcagcctcgcctccgtgtcgtggtcctcctggacagtcgactcaccatcctcctgaccacgtcggaaccagngagtggaacgtttgggtagttaacgtaagtagtcgtactccgttacggtaaaccaacgaaccaaccaaggacccaaaacgaccccaaagtcactagtacttagtgagtacagtacgtccggaccttacggttacggttactaactcgtacttcgccgttacggctaaccgtagtcgtacgacgaacgtacccgtcctacctacgacctcgtacgtccgtcggtccgtaccgacgggtcgtacgggacgacgttagtacttaacgtatttagttacgttgccgtaagtcctagtactagtaccgtatacgttgggacacgtactatccgtagtttaccgggttacgggttacggggaccgggtaggtaacgggtcgtacccggttacgtacgggacctaaccggtccggtaacgtcccg

SEQ ID NO: 196577 - DNA, 792 bp, Homo sapiens
  misc_feature: GYAE6OF01AJBX8.14.36.D03.1.454.CMB.1.raw
  modified_base (116)..(116): a, c, t, g, unknown or other
  misc_feature (116)..(116): n is a, c, g, or t
  modified_base (261)..(261): a, c, t, g, unknown or other
  misc_feature (261)..(261): n is a, c, g, or t
  modified_base (672)..(672): a, c, t, g, unknown or other
  misc_feature (672)..(672): n is a, c, g, or t
  modified_base (694)..(694): a, c, t, g, unknown or other
  misc_feature (694)..(694): n is a, c, g, or t
  modified_base (703)..(703): a, c, t, g, unknown or other
  misc_feature (703)..(703): n is a, c, g, or t
tcagcgtctagtaccacgaccggtgctcgatttagctgcgtcacgatctctcgttgggggggggtctcaggaggcagcgctctcaggacatctccaccatggcctgggctctgctnctcctccaccctcctcactcgagggcacgacgggtccgtcgggcccagtctcgcccttgacctcacgtcctcgtccctcgtgtcgtgggtcctccgtggacacgtcgactaccacctactcctcctcgacctacgtacggaaccncggacgtacggtaggtacgggtttgggttaggttaaattaacggttctcgttaccttaccggtacggtaaacccaaacgaacccaccccgaacggaacccaaaaccccgtaaccccccaaattacctagttacgtaacgttttacggacggtaacggttactaacggtaaccgttaccgggtccccgttagggttaacgggtttaccttaacgtccgtttccgtttccgtcggtcggtacctaccgtaagtcccgtagacccgtaccgtcccgtacccttccgtagacccctagtcccgttacggtccggtacccgttaccggaacggttacgtaggggaacccggacggtttacttacggttaactttaagttttacgtacgttagaccctacggttctaagttaacgtnaccgtacccgtaatcggtaacncgttaaccngttacgtggtttcggggttacggggttccggggacgggaacgtacggtcggttacccgtcggacggtaccgactccggggtactccccg

SEQ ID NO: 196578 - DNA, 875 bp, Homo sapiens
  misc_feature: GYAE6OF01EAAW5.14.36.D03.1.454.CMB.1.raw
tcagcgtctagtaccacgaccggtgctcgattttagctgcgtcacgatctctcgttgggggggggtctcaggaggcagcgctctcaggacatctccaccatcggcctgggctctgctgcctcctccaccctcctcactcgagggcacgacgggtcctcgggcccagtctcgccctgactcgacgcctcgcctcgtgtcgtcgggtcctcgtcggactacgtcgactccactacttccgtccgtcgcctaacgtcggaaccaggtacgtaaggttcggttacgggttttagggtttaaggtttaaagttaaacggtttacgttccggtttaccgttacccgttaacgggtaaaaccccaaaccgtaaacccgaaccccggaaacgggaacccctaaaaacccggtaccccctaaaaccgttactaacgtttaggttaattttacggcgggtaacggttactaacggtaacggtcccggtacccgttacgggtacgggttttactaacgttccgttacttcgtaccgtcggccttaacggtaacggtccgtacgggaccctaaaccggcccggtacccttaccgacgtacctactccggtccggtcggtacccgtcggtacggtcgtacgggaccggtacgttacgttcgttagttaacgtttactttacggtactacgacgttacgtaatacgtacgtccgaacctacggtacgggtacaacggtaaccttaacgttaccgggttacggtttacgggggtttccgggggtttaaccggggggacccgggggtttaacgggtaaccgggtacccggttacccgggttaccgtaccgggtacccggtaacccgggtaacccgtcccggggttaccccg

SEQ ID NO: 196579 - DNA, 708 bp, Homo sapiens
  misc_feature: GYAE6OF01BQHXP.14.36.D03.1.454.CMB.1.raw
  modified_base (331)..(331): a, c, t, g, unknown or other
  misc_feature (331)..(331): n is a, c, g, or t
tcagcgtctagtaccacgaccggtgctcgatttagctgcgtcacgatctctcgttgggggggggtctcaggaggcagcgctctcaggacatctccaccatggcctgggctctgctgctcctcaccctcctcactcagggcacgagggtcctgggcccagtctcgccctgactcagcctgcctcgtgtctggtctcctggacagtcgatcaccatcctcctgcacgtaggaaccagcgagtgacgttggtagttagtaagtatgtccgttccgtacggtaaccaaaccaaccacccgaggaccaaaccgacccccaaactctatgtattagngtagtactagtacgtccggtccctacggtagggtttactaacgtcgtcttcgtcgtcgtcctacgtacgtcgtcggactaaccgccggtccctcccgtacgtaccctacttccgttccgtcgggtcccttaccggacgggtacgtacgggtaacgggtacccgttaagtttccgtaagtttaacgttttaagtttacgtttcggaccgttacgtaccgttaacctaagtttaaccttaacgtttaacgtttaaccgacgttaacggtacgtttcgggtttacgggtttaccgggaacgggtaaccggtaacggttacgggtcggtacccgttacggtacgtaccgacggacccgtagtccgcccgtccccgtaccgg

SEQ ID NO: 196580 - DNA, 854 bp, Homo sapiens
  misc_feature: GYAE6OF01DGHI5.14.36.D03.1.454.CMB.1.raw
  modified_base (124)..(124): a, c, t, g, unknown or other
  misc_feature (124)..(124): n is a, c, g, or t
  modified_base (233)..(233): a, c, t, g, unknown or other
  misc_feature (233)..(233): n is a, c, g, or t
  modified_base (252)..(252): a, c, t, g, unknown or other
  misc_feature (252)..(252): n is a, c, g, or t
  modified_base (284)..(284): a, c, t, g, unknown or other
  misc_feature (284)..(284): n is a, c, g, or t
  modified_base (355)..(355): a, c, t, g, unknown or other
  misc_feature (355)..(355): n is a, c, g, or t
tcagcgtctagtaccacgaccggtgctcgatttagctgcgtcacgatctctcgttggggggggtctcgaggaggcagcgctctcaggacatctccaccatggcctgggctctgctgcctcctcnccctcctcactcgagggcacgagggtcctcgggcccagtctcgccctgactcgacgcctcgcccgttcgtgtccgttcgggtcctccgtaggacagtcgactccacctntctcctgctacgtcgaacngcgtagtgtggttaggttacgttaataacgtntcgtacctcgtacgtaaccaacaaccgaaccgagaaccaaaccgtaccccaaatcaagttgtactttacgnggtacgtactaaggtacgtccgtaccggtaggttaacggtttactaacggttcctacctttcgtccgttacgccgttaaccgtagttccggacggacctaacccggtacccgttcccctaccgttacggaccgtttacctccggtttaccgggtccgtaaccttccggtacggtacgtaacggggacggttaaccggttgttacgtttaacgttaacgttttaggttacgttacggacgttacgtacctttaacgaaacgttccggggtcaacccggtttaccggaggtttaccccgaaacgttaacgtttaacccggtacgggttttagggggtttccggggggtttttaaacccgggggggacggggggtaaccggggttaaaaacccgggggtttttacccggaacccgggttttccccggggtttaaaccccgtaacgggggtaccccccttaaaaccgggggggccccgggttacccggtttaacccccccggg

SEQ ID NO: 196581 - DNA, 787 bp, Homo sapiens
  misc_feature: GYAE6OF01CGXH9.14.36.D03.1.454.CMB.1.raw
  modified_base (240)..(240): a, c, t, g, unknown or other
  misc_feature (240)..(240): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcgaggcacgagggtccgtcgggccctagttcctcgccctagactcgacgtcctcgccttccgtgtcgtcggttcctccgtagactagtcgctacgaccacttctaccngccacgtacggaaccagctaggtcggtacggttaggttagttaagtaagttctcgtaccgtcgtacgtaaacccaaccaaccgaccgaacgtaacccaacccaccctaatctaagttacgttaactaggtacgtaacgtacgtaacggtaccgtcccggtaccgttagggttacggtttaacctacgttccgtcgtttcgtacgtaccgtaccgtacggtaacgttcccgtacggaacccgtacccggacccggttaccctaccgttaacgtaccgtacgttccggttccggttaccggtaccggtaccggtaccggtacggtacgggtaccggtaacggttacgttacggtttacgtttaagtttacgttacgtcgtacgtacgtacgttaacgtacgtaccgtaccgtaccgtaccgtcgacgaacgtacgttacgtagttacgggttcgggtttaccggggttaccggggtaccgggtacggtaaccgggtcggttaccggtaccggtaccgtaaccggtacccggtacccggtaccggtcccg

SEQ ID NO: 196582 - DNA, 620 bp, Homo sapiens
  misc_feature: GYAE6OF01CS7WM.14.36.D03.1.454.CMB.1.raw
  modified_base (390)..(390): a, c, t, g, unknown or other
  misc_feature (390)..(390): n is a, c, g, or t
tcagcgtctagtaccacgaccggtgctcgatttagctgcgtcacgatctctcgttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggttagttataagtatgtctcgtagtaccaacaacaccagacaacgccccaaactcatgtatttagtgagtacagtaacgtccggcctcgtaggtttactaactcgtcttctctcgctacagtcgtgacaaccgaccggtccctcccgngacctactccgtcgtcgggtcctcgacgtcgtacggacggtacgtagttcgttagtaatttattagttcgactacgtcgtaccaagttctacgacccgttaccggtgactacgactaacgttccgtagggtttcggtttaccggggtttccggggggacgggggtaaacctaggggttacccgttaccggtaccgggtacggttacccgacgtacccggacggtccccgg

SEQ ID NO: 196583 - DNA, 814 bp, Homo sapiens
  misc_feature: GYAE6OF01C2M89.14.36.D03.1.454.CMB.1.raw
  modified_base (252)..(252): a, c, t, g, unknown or other
  misc_feature (252)..(252): n is a, c, g, or t
tcagcgtctagtaccacgaccggtgctcgatttagctgcgtcacgatctctcgttggggggggtctcgaggaggcagcgctctcaggacatctccaccatcggcctgggctctgctgctcctcacctcctcacgtcgagggcacgacgggttcctcgggcccagtctcgcctagactcagcctcgcctccgtgtcgtgggtctccgtaggactagtcgactcaacctgtccttccgagactacgtacgaacncgcgtagtcggtacggttggttagttatttacgtttcgtaccgtacgtacggtaaccaacgcgacccgaccgaaggaccgtaaaccacccctaattacctaatttacgttagtacggtaacggtaactaactaaccggttccggtaacctggttaacgttagtttaacctaacgttccgtaacgtttcgacgttcggtacctaccgtaagtccggttacgaaccgtaccgtccggtcctcccgtaagcgtaactcgtccgtcggtcggtcccgtacggtaccggacgttacgggaaccggtaaccgggtcgtacggttaacgtttaacgttttaacgaaccggttcgaccgttaacggttacccgttaagttaacctttaaccggttaacctaacggttaaggtaacccggttaagttcccggggtttagttaccgggggtttaccggaacggggtttaaccgggtaacccggttaaacgggtccccggttaacgttaaacccggtcgggttaacccggaccgtaacccgggtaacgtcccggttaccggttaacccccggg

SEQ ID NO: 196584 - DNA, 895 bp, Homo sapiens
  misc_feature: GYAE6OF01CWMV2.14.36.D03.1.454.CMB.1.raw
  modified_base (220)..(220): a, c, t, g, unknown or other
  misc_feature (220)..(220): n is a, c, g, or t
  modified_base (745)..(745): a, c, t, g, unknown or other
  misc_feature (745)..(745): n is a, c, g, or t
tcagcgtctagtaccacgaccggtgctcgatttagctgcgtcacgatctctcgttggggggggtctcaggaggcagcgctctcaggacatctccaccatggcctgggctctgctgcctcctccaccctcctcactcgagggccacgtacgggtccgtcgggcccagtctgccctgactcacgcctgcctccgtgtcgtgggtcctccgtggacagtcganaccaacctcttcctcctgacctacgtacggaacccagctaggttacggtacggttttaggtacgggtttaattaaagtccgttacgttcccgttccgttaaccggtaaacccaaaaccccgaaacccgacccggaaccggaaacccaaaaaccccggtaaccccccctaaaaagttcctaaagtttacgttaaacgttttaggtaggttaaccttaccgtaaagttaaccggtccccggttacccgttaacgggtttacggtttaacctacgttccgttcgttcgttaccgtcggtacctacgtaacggttaccgtcgaaaccgtaacccggtacccgttcccctcccgtaacgtaaccccttacggttcccgtaccggggttcccgggacccttaccggacgggtttaccgggaaacggggttaccggtaacggtaccgttttaggttaaacgtttagttttacgttacgttcggactacgttaccgtacttaagccttaaccgtcccgacgttaaccgggacncgttaaacccgtagtccggtttaacgggttcggggttttaaccgggggtacccgggggggtaacccggtcgggtttaacccggggtaccgtaccccggttttcgggaaccgttcccggaaacccggttccgaaccccgggttcccccggg

SEQ ID NO: 196585 - DNA, 660 bp, Homo sapiens
  misc_feature: GYAE6OF01BCTJ4.14.36.D03.1.454.CMB.1.raw
  modified_base (120)..(120): a, c, t, g, unknown or other
  misc_feature (120)..(120): n is a, c, g, or t
  modified_base (323)..(323): a, c, t, g, unknown or other
  misc_feature (323)..(323): n is a, c, g, or t
  modified_base (358)..(358): a, c, t, g, unknown or other
  misc_feature (358)..(358): n is a, c, g, or t
  modified_base (485)..(485): a, c, t, g, unknown or other
  misc_feature (485)..(485): n is a, c, g, or t
tcagcgtctagtaccacgaccggtgctcgatttagctgcgtcacgatctctcgttggggggggtctcaggaggcagcgctctcaggacatctccaccatggcctgggctctgctgctccncaccctcctcactcagggcacagggtcctgggcccagtctcgccctgactcagcctcgcctccgtgtctgggtctccgtggacagtcgatccacatcctcctgcacgtcggaaccagcagtgtacgttggtaggttaataagtatggtctcgtggtaaccaacaacctacccgagacaaaaccgccccaaatcatatatttangaggtcagtatccggcctggtacgggtttctaacncgtcttctcgtgctaccaagtcgtacgaccaacgtccggtccctcccgacgtacccgtactccgttcgtacggcccgttaccgacggtcgtaggacggacgagttacgtgtaactttagttattcgngtacgtctacagttaccgtgtacctaccgtagggaccaaggtacctaacgttatacgggtttcggggttttacggggttttaccggggggacccggggggtaaaccgttaccggggtacgtaaccccgggttaccgtacgggtacccgaccgtaaccccggtaaggttcccccgg

SEQ ID NO: 196586 - DNA, 757 bp, Homo sapiens
  misc_feature: GYAE6OF01ADHYB.14.36.D03.1.454.CMB.1.raw
  modified_base (228)..(228): a, c, t, g, unknown or other
  misc_feature (228)..(228): n is a, c, g, or t
tcagcgtctagtaccacgaccggtgctcgatttagctgcgtcacgatctctcttgggggggtctcaggaggcagcgctctcgaggacatctccaccatggcctgggctctgctgctcctcaccctcctcactcagggcacagggtcctgggcccagtctgccctgactcagcctgcctcgtgtctgggtctcctggacagtcgatcaccatctctgcacgtggaaccngcagtgacgttggtgttataagtatgtctccgtggtaaccaacaaccaccgaggacaaaccgcccccaaactcatgtatttagtgtagtcagtaacgtccggacccgttcgtacggggtttctaactcgtcctttcgtcgtcgcctacctaagttcgtacggaccaaacccgaccggtccccttaccccgtacggaaccctacgttccgttaccggtcggggtacccttacccgagggtcccggtacggaacggggtacccggtaggttacgttacgttaagttttaagtttacgtttacggacccgtacggtacccttaacgtacgttacgtccggtacccttaaccggtcgggacctaccgggaacctaacgtttacgtaacggttttgggttttccgggggttttacccggggggaaccgggggggttaaccccgtaaacgggggtttacccgtaacccccgggtttacccggtaacggggttaaccccgtaacccgggcccccgggtaaacgggttaccccccgg

SEQ ID NO: 196587 - DNA, 748 bp, Homo sapiens
  misc_feature: GYAE6OF01CH3AM.14.36.D03.1.454.CMB.1.raw
  modified_base (219)..(219): a, c, t, g, unknown or other
  misc_feature (219)..(219): n is a, c, g, or t
  modified_base (238)..(238): a, c, t, g, unknown or other
  misc_feature (238)..(238): n is a, c, g, or t
  modified_base (245)..(245): a, c, t, g, unknown or other
  misc_feature (245)..(245): n is a, c, g, or t
  modified_base (358)..(358): a, c, t, g, unknown or other
  misc_feature (358)..(358): n is a, c, g, or t
  modified_base (625)..(625): a, c, t, g, unknown or other
  misc_feature (625)..(625): n is a, c, g, or t
tcagcgtctagtaccacgaccggtgctcgatttagctgcgtcacgatctctcgttggggggggtctcaggaggcagcgctctcaggacatcctccaccatggccgtgggctctgctgcctccctccaccctcctcacgcgacgggaccacgacggggtccgtcgggacccagtctcgccctgacctcagcccgtcgcctccgtgtcgtcgggtcctcgnggactagcactacaacgtntcctcgngaccaacgacggaaaccagacgtaaggttggtacggtttaggttaggtaaattaagtctgtacctacgtaacgaaccaaacgaccaaccgagaaccctaaacccacccctaanacgtattaatacgtttaagcggaacggttacaaaggtaaccgtcccggttaccgtccggttaaagggttttacaacttccgtctttacgacgttcgaacctaccggtaaagtccgttaacgaccaaaccggtcccgtcctacccggtacgaccctaacgtccgttcggaccgggttactacccgagggttacctagggaaccgaacgggtagttacttaagtaatttactaacgtcgatacgcgttaacctctaagtaccgacccgnggtaaccgagaaacgtaagtacgtacgttagttacgggttacggggttaccgggaaaccggggggactaacggggttacccaacccgtacggtaacgccaaccgggacccgaaggtcccccgg

SEQ ID NO: 196588 - DNA, 763 bp, Homo sapiens
  misc_feature: GYAE6OF01A22AZ.14.36.D03.1.454.CMB.1.raw
  modified_base (651)..(651): a, c, t, g, unknown or other
  misc_feature (651)..(651): n is a, c, g, or t
tcagcgtctagtaccacgaccggtgctcgatttagctgcgtcacgatctctcttggggggggtctcaggaggcagctctctcaggacatctccaccagtggccgtgggctctgctgcctcctcaccctcctcactcgagggcacgagggtcctcggcccagtctcgcctgactcgacgcctcgccgtcgtgtcgtcggtctccgtaggacagtcgtactccacctacttcctccgtgcctaccgtaccggaaccgacggtcgtaaggttcggtacggtttagggttaagttaagttaagtattcgttcgtccgtacggtaaccaacaacccctaccgaacggaacccaaacccgacccccaaactacgattagttacttacgtggtaacggtacgtaagttacccggtaccggttaccggttacgttaacggggtttacctaacgtccgttcttaccgttcgtcggtcctaccggtaagtccgtacgaccgtaaccggacccgtccctaccgtactacctagtcccgttacggtccggacccgtccggtaacgggtactacgggtaaccgacggtacgttaagtttacgttaagtttaacctttacggctactcgtcttaactcgtacttaccgtacgttaacgcgtaacncgtaacgtcttagggtcggtttcggggttacggggttccggggaacggggttacgtacccgggtacgttaccggttcggtaacggccccggtaagtccccgtggtcccccgg

SEQ ID NO: 196589 - DNA, 799 bp, Homo sapiens
  misc_feature: GYAE6OF01CIF0Q.14.36.D03.1.454.CMB.1.raw
  modified_base (176)..(176): a, c, t, g, unknown or other
  misc_feature (176)..(176): n is a, c, g, or t
  modified_base (221)..(221): a, c, t, g, unknown or other
  misc_feature (221)..(221): n is a, c, g, or t
  modified_base (240)..(240): a, c, t, g, unknown or other
  misc_feature (240)..(240): n is a, c, g, or t
  modified_base (248)..(248): a, c, t, g, unknown or other
  misc_feature (248)..(248): n is a, c, g, or t
  modified_base (499)..(499): a, c, t, g, unknown or other
  misc_feature (499)..(499): n is a, c, g, or t
  modified_base (512)..(512): a, c, t, g, unknown or other
  misc_feature (512)..(512): n is a, c, g, or t
  modified_base (585)..(585): a, c, t, g, unknown or other
  misc_feature (585)..(585): n is a, c, g, or t
  modified_base (638)..(638): a, c, t, g, unknown or other
  misc_feature (638)..(638): n is a, c, g, or t
tcagcgtctagtaccacgaccggtgctcgatttagctgcgtcacgatctctcgttggggggggtctcaggaggcagcgctctcaggacatctccaccagtcggccgtgggctctgctgcctcctaccaccctcctcaccgtcgacgggctacgacgggtccgtcggccctagtccncgtccctgacctcacgcctcgtccgtcgtcgtcgtcggtctccgngacgtagtcactacacctntccgtacngaccgtacgacggaacctgacgtaggttcggtaggtttgggttaagttaacgttaagttcgttcgtccgttacccgtaacggaaacccaaacgtaaaccccgaccggaaacgtaaaccccgaaaacccctaacccctaaatctaagttaagttactttaaggcggtaacgtactaacggtacgtcccgtacgttacgggtacggttactacgtcgttctcgcgtcgacctcgatcgacgactacccgtccncctacgcgacctntcggaccgtccgctaccggtaggtcgtaacggtcgtaacggttcgtaagtttaaccgttaatttagggttacncctaaccggattccgttactaacgttcgtacccgaccgttagcccggttaaanacgttaaccgtggttaccgggttttacgggtttaccgggggtttacccggggggtaaaccggggtaacccggggttaccggaaacccgggtttacggaaccccgggttaacggtacccggaacccggttacccggtaacccccggggtcccgttacccccg

SEQ ID NO: 196590 - DNA, 619 bp, Homo sapiens
  misc_feature: GYAE6OF01DZRUZ.14.36.D03.1.454.CMB.1.raw
  modified_base (220)..(220): a, c, t, g, unknown or other
  misc_feature (220)..(220): n is a, c, g, or t
  modified_base (315)..(315): a, c, t, g, unknown or other
  misc_feature (315)..(315): n is a, c, g, or t
  modified_base (328)..(328): a, c, t, g, unknown or other
  misc_feature (328)..(328): n is a, c, g, or t
  modified_base (394)..(394): a, c, t, g, unknown or other
  misc_feature (394)..(394): n is a, c, g, or t
tcagcgtctagtaccacgaccggtgctcgattttagctgcgtcacgatctctcgttggggggggtctcaggaggcagcgctctcaggacatctccaccatggcctgggctctgctgctcctcaccctcctcactcagggcacgagggtcctgggcccagtctcgccctgactcacgcctgcctccgtgtctcgggtctccgtgacagtcgatccaacctnttcctcctgcacgtacggaaccagcagtgtaggttggttgttataagtatgtctctacgtaccaacaccaccagaccaaacgaccccaactcatntattatagagtanagtacgtccgcctcgtacgggttactatcgtctctctcgtctcagtcgtcgacacgaccgcctccncgacctactctccggtacgtccgtaccgacggtcgtacggacgggtacgtacggtctttaggttactttaagtttacgttacgtacgtacgtcgtacgtatacgtcgtcctacggtcgacgacgtactacgtacgttacgttgggtttccgggtttaccgggggacggggtaccgtaacgggtcgtacccgttcgtacgtacggaccgaccggtacggtccccgg

SEQ ID NO: 196591 - DNA, 794 bp, Homo sapiens
  misc_feature: GYAE6OF01AHI9R.14.36.D03.1.454.CMB.1.raw
  modified_base (217)..(217): a, c, t, g, unknown or other
  misc_feature (217)..(217): n is a, c, g, or t
  modified_base (228)..(228): a, c, t, g, unknown or other
  misc_feature (228)..(228): n is a, c, g, or t
  modified_base (236)..(236): a, c, t, g, unknown or other
  misc_feature (236)..(236): n is a, c, g, or t
  modified_base (251)..(251): a, c, t, g, unknown or other
  misc_feature (251)..(251): n is a, c, g, or t
  modified_base (548)..(548): a, c, t, g, unknown or other
  misc_feature (548)..(548): n is a, c, g, or t
  modified_base (556)..(556): a, c, t, g, unknown or other
  misc_feature (556)..(556): n is a, c, g, or t
  modified_base (577)..(577): a, c, t, g, unknown or other
  misc_feature (577)..(577): n is a, c, g, or t
tcagcgtctagtaccacgaccggtgctcgatttagctgcgtcacgatctctcgttggggggggtctcaggaggcagcgctctcaggacatcctccaccatggcctgggctctgctcgctcctcaccctctcactcgagggccacgaggggtcctcgggcccaggtcctcgccctagacctcacgcctgcccttcgtgtcgtcgggtcctcgtggacngtcactcaccntcctccgncctacgtaacggacncggtacagttcggtacgtttggttacggtaagttaagtacttgttccgttacgtacgtaaacccaacgaacccaccggacggaacctaaacccgacccccaaagtcctaagttcggtaacttttacgacggtacgtacctaaggttaccgtcccggaccgtttacggttacgggtttacttaacgtccgttctttcgtccgtcggtccctacgtacgtcgtacggacccaacggtcccgcctacccggctaacctctcgtcggtaccgccgttaccgaggcggtacggaacggtacncggtttanactttacgttcttacggtacncttacgtcctaggttacctacgccggtaacgttacggtacgtacgtaacggttcttacgggttcggtttacggggggtttaacccggggggggttacggggtaacccccggggtaagggtttaaaccggggtccccgtttaacccggtacgggtttaaccccggggacccgtacccggggtaaccccgtcccgggttttaccccggttccccccggg

SEQ ID NO: 196592 - DNA, 810 bp, Homo sapiens
  misc_feature: GYAE6OF01B2K3L.14.36.D03.1.454.CMB.1.raw
tcagcgtctagtaccacgaccggtgctcgattttagctgcgtcacgatctctcgttgggggggggtctcaggaggcagcgctctcgaggacatctccaccatcggcctgggctctgctgcctcctccaccctcctcactcgacgggcacgagggtcctgggcccagtctcgcctgacctcacgcctcgtcctccgtgtcgtcggttctcgtaggacgtcgtacgtactccaacctctccttaccgtcaccgtaaccggtaacgaacccgaggtacgtagggttacggtacggtttaggttaggtttaacgttaagttattccggttaccttaccggaaccgtaaaccaaaaccgtaaccgaacccgacggtaacccaaaaccccgacccctaaacttacttaatttagttacggtacggtaacgtaacttaacgtaccgtacccggtcctaggtacgttactttactacgttccgttcttactcggtactaccgtacggtctacgccgtaacgacccgtccgtaccgtcgtacggactcacgttcggccgtacggacccgtcggtacggtacgtacgggaccgggtagggacgttacttaaggtaagtttacgaacgtcgtctaacggtacttaataacgttttaacctaagtaacggttaacacggttaaagggtttcggtacgggttttacggggttaccggggaaccgggttacgggaacccggttaccgggttacccggtaaccggttacggtaaccgtcccgggtaacggtaacccgtccggtccccggtacccggttaccccgg

SEQ ID NO: 196593 - DNA, 768 bp, Homo sapiens
  misc_feature: GYAE6OF01ADIB5.14.36.D03.1.454.CMB.1.raw
  modified_base (247)..(247): a, c, t, g, unknown or other
  misc_feature (247)..(247): n is a, c, g, or t
  modified_base (582)..(582): a, c, t, g, unknown or other
  misc_feature (582)..(582): n is a, c, g, or t
tcagcgtctagtaccacgaccggtgctcgatttagctgcgtcacgatctctcgttggggggggtctcaggaggcagcgctctcaggacatctccaccatggcctgggctctgctgctcctcaccctcctcactcagggcacgagggtcctgggcccagtctcgccctgactcacgcctgcctccgtgtcgtgggtctccgtggacagtcgatccaacctattcctcctcgaccacgtacggaacccngacctaggtcggtacggtttgggttaggtttaattaaaggttacgttcgttacccgttccgttacgggtaaaccctaaaccgtaaacccaccccgaacgggaacccaaaacccggtaaccccccctaaaacctccgtaacttacggttaattttaacgtggtaacgggttacgtaaacgttaaccgttcccggtaccccgttacggttacggggttttacctaacgttccgttactttcctaccgtcggtacccttaccgtaaggttccgtacggacccgtaaccgacccggtcccctacccgtacgtaccctcgttccgtcgtcggccttacgnggtacgacggaacgtacgtacgtctagttattgttacgtcgtcgtactctacgatacgtccgacctcgtcgacagtaccacgtacgtcgggttacggtttaccgggggttaccggggaacggggtacccggtacgggtccggtaccgttacgtaccggtaacggccgtacccggtacggtccccgg

SEQ ID NO: 196594 - DNA, 238 bp, Homo sapiens
  misc_feature: GYAE6OF02GU2WO.14.36.D03.1.454.CMB.1.raw
  modified_base (233)..(238): a, c, t, g, unknown or other
  misc_feature (233)..(238): n is a, c, g, or t
tcagcgtctagtaccacgaccggtgctcgatttagctgcgtcacgatctctcttgggctttgatatctgggccaagggacagtggtcaccgtctcttcagcctccaccaagggcccatcggtcttcccctggcaccctcctccaagagcacctctggggcacagcggccctgggctgcctggtcaaggactacttccgtactagacgctgagcgggctggcaaggcgcatagnnnnnn

SEQ ID NO: 196595 - DNA, 246 bp, Homo sapiens
  misc_feature: GYAE6OF02F5L3D.14.36.D03.1.454.CMB.1.raw
  modified_base (236)..(246): a, c, t, g, unknown or other
  misc_feature (236)..(246): n is a, c, g, or t
tcagcgtctagtaccacgaccggtgctcgatttagctgcgtcacgatctcgtcttgggcttttgatatctggggccaagggacagtggtcaccgtctcttcagcctccaccaagggcccatcggtcttccccctggcacctcctccaagagcacctctgggggcacagcggccctgggctgcctggtcaaggctacttccgtactagacgctgagcgggctggcaaggcgcatagnnnnnnnnnnn

SEQ ID NO: 196596 - DNA, 237 bp, Homo sapiens
  misc_feature: GYAE6OF02IDIQO.14.36.D03.1.454.CMB.1.raw
  modified_base (234)..(237): a, c, t, g, unknown or other
  misc_feature (234)..(237): n is a, c, g, or t
tcagcgtctagtaccacgaccggtgctcgatttagctgcgtcacgatctctcttgggctttgatatctggggccaagggacagtggtcaccgtctcttcagcctccaccaagggcccatcggtcttcccctggcaccctcctccaagagcacctctggggcacagcggccctgggctgcctggtcaaggactacttccgtactagacgctgagcgggctggcaaggcgcatagnnnn

SEQ ID NO: 196597 - DNA, 241 bp, Homo sapiens
  misc_feature: GYAE6OF02I0FYK.14.36.D03.1.454.CMB.1.raw
  modified_base (237)..(241): a, c, t, g, unknown or other
  misc_feature (237)..(241): n is a, c, g, or t
tcagcgtctagtaccacgaccggtgctcgatttagctgcgtcacgatctctcttggggcttttgatatctggggccaagggacagtggtcaccgtctcttcagcctccaccaagggcccatcggtcttccccctggcaccctcctccaagagcacctctggggcacagcggccctgggctgcctggtcaaggactacttccgtactagacgctgagcgggctggcaaggcgcatagnnnnn

SEQ ID NO: 196598 - DNA, 239 bp, Homo sapiens
  misc_feature: GYAE6OF02F6T8L.14.36.D03.1.454.CMB.1.raw
  modified_base (235)..(239): a, c, t, g, unknown or other
  misc_feature (235)..(239): n is a, c, g, or t
tcagcgtctagtaccacgaccggtgctcgatttagctgcgtcacgatctctcttgggctttgatatctggggccaagggacagtggtcaccgtctcttcagcctccaccaagggcccatcggtcttccccctggcaccctcctccaagagcacctctggggcacagcggccctgggctgcctggtcaaggactacttccgtactagacgctgagcgggctggcaaggcgcatagnnnnn

SEQ ID NO: 196599 - DNA, 263 bp, Homo sapiens
  misc_feature: GYAE6OF02HXEW3.14.36.D03.1.454.CMB.1.raw
  modified_base (238)..(263): a, c, t, g, unknown or other
  misc_feature (238)..(263): n is a, c, g, or t
tcagcgtctagtaccacgaccggtgctcgatttagctgcgtcacgaatctctcttgggcttttgatatctggggccaagggacagtggtcaccgtctcttcagcctccaccaagggcccatcggtcttccccctggcaccctcctccaagagcacctctgggggcacagcggccctgggctgcctggtcaaggactacttccgtactagacgcgagcgggcgtggcaaggcgcatagnnnnnnnnnnnnnnnnnnnnnnnnnn

SEQ ID NO: 196600 - DNA, 237 bp, Homo sapiens
  misc_feature: GYAE6OF02ITOQP.14.36.D03.1.454.CMB.1.raw
  modified_base (235)..(237): a, c, t, g, unknown or other
  misc_feature (235)..(237): n is a, c, g, or t
tcagcgtctagtaccacgaccggtgctcgatttagctgcgtcacgatctctcttgggcttttgatatctggggccaagggacagtggtcaccgtctcttcagcctccaccaagggcccatcggtcttccccctggcaccctcctccaagagcacctctggggcacagcggccctggctgcctggtcaaggactacttccgtactagacgctgagcgggctggcaaggcgcatagnnn

SEQ ID NO: 196601 - DNA, 495 bp, Homo sapiens
  misc_feature: GYAE6OF02IHBFV.14.36.D03.1.454.CMB.1.raw
tcagcgtctagtaccacgaccggtgctcgatttagctgcgtcacgatctctcttggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctcctggtaccaacaacacccaggcaaagcccccaaactcatgatttatgaggtcagtaatcggcctcagggttctaatcgcttctctggctcaagtctggcaacacggcctcctgaccatctctgggctccaggctgaggacgagtctgatttattattgcagctcatatgcacctggcagcatcatgtggtttcggcgggggtactaaggtgaccgtcgtaggtcagcccgaggtccg

SEQ ID NO: 196602 - DNA, 503 bp, Homo sapiens
  misc_feature: GYAE6OF02FIAHI.14.36.D03.1.454.CMB.1.raw
tcagcgtctagtaccacgaccggtgctcgatttagctgcgtcacgatctctcttgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctcctggtaccaacaacacccaggcaaagcccccaaactcatgatttatgaggtcagtaatcggccctcaggggtttctaatcgcttctctggctccaagtctggcaacacggcctccctgaccatctctgggctccaggctgaggacgagtctgattattattgcagctcatatgcacctgcagcaatcatggttggtttcgggcgggggtaccaggtcgaccgtccgtaggtcagcccaggtccg

SEQ ID NO: 196603 - DNA, 241 bp, Homo sapiens; identical to SEQ ID NO: 196461
  misc_feature: GYAE6OF02F2SQY.14.36.D03.1.454.CMB.1.raw
  modified_base (238)..(241): a, c, t, g, unknown or other
  misc_feature (238)..(241): n is a, c, g, or t

SEQ ID NO: 196604 - DNA, 497 bp, Homo sapiens
  misc_feature: GYAE6OF02IFVNU.14.36.D03.1.454.CMB.1.raw
  modified_base (324)..(324): a, c, t, g, unknown or other
  misc_feature (324)..(324): n is a, c, g, or t
tcagcgtctagtaccacgaccggtgctcgatttagctgcgtcacgatctctcttgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctcctggtaccaacaacacccaggcaaagcccccaaactcatgatttatgagtcagtaatcggccctnagggtttctaatcgcttctctggctcaagtctgcaacacggcctccctgaccatctctggctcaggctgaggacgagtctgatttattattgctagctcatatgcacctggcagcaatcatggtggtttcggcgggggacctaggtgaccgtcgtaggtcacgcccaggtccg

SEQ ID NO: 196605 - DNA, 183 bp, Homo sapiens
  misc_feature: GYAE6OF02G0IUM.14.36.D03.1.454.CMB.1.raw
  modified_base (181)..(183): a, c, t, g, unknown or other
  misc_feature (181)..(183): n is a, c, g, or t
tcagcgtctagtaccacgaccggtgctcgatttagctgcgtcacgatctctcttgggttttgggggaagaggaagactgacggtcccccaggagttcaggtgctgggcacagcggccctgggctgcctggtcaaggactacttccgtactagacgctgagcgggctggcaaggcgcatagnnn

SEQ ID NO: 196606 - DNA, 531 bp, Homo sapiens
  misc_feature: GYAE6OF02JRMOF.14.36.D03.1.454.CMB.1.raw
tcagcgtctagtaccacgaccggtgctcgatttagctgcgtcacgatctctcttgggggggtctcaggaggcagctctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctcctggtaccaacaacaccaggcaaacgcccccaaactcatgatttatgagtcagtaatcggcctgagggtttctaatcgcttctctggctcaagtctggcaacacggcctcctgaccatctctcgggctccgagctgacggacgagtctgattattatgcagctcatatgactacctggcagctaatcaagttggtgggttttacgggcggggggtaaccgtaacgggttcgacccggttcgtacgggtccgacggtacccgtaagggtcccg

SEQ ID NO: 196607 - DNA, 508 bp, Homo sapiens
  misc_feature: GYAE6OF02G7T46.14.36.D03.1.454.CMB.1.raw
tcagcgtctagtaccacgaccggtgctcgatttagctgcgtcacgatctctcttgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctcctggtaccaacaacacccaggcaaagcccccaaatcatgatttatgaggtcagtaatcggccctcaggggtttctaatcgcttctctggctcaagtctggcaacacggcctccctgaccatctctgggctccaggctgaggacgagtctgattattattgcagctcatatgcacctggcagcaatcatggtggttttcggcgggggtaccaagggtcgaccgtccgtaggtcgacgcccgaaggtcccg

SEQ ID NO: 196608 - DNA, 502 bp, Homo sapiens
  misc_feature: GYAE6OF02FXQDY.14.36.D03.1.454.CMB.1.raw
  modified_base (326)..(326): a, c, t, g, unknown or other
  misc_feature (326)..(326): n is a, c, g, or t
tcagcgtctagtaccacgaccggtgctcgatttagctgcgtcacgatctctcttgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctcctggtaccaacaacacccaggcaaagcccccaaaactcatgatttatgaggtcagtaatcggccctnagggtttctaatcgcttctctggctccaagtctggcaacacggcctcctgaccatctctgggctccaggctgaggacgagttctgtattattattgcagtctacatatgcacctgcagcatcatggttggtttcggcgggggtaccaggtgaccgtcgtaggtcacgcccaggccg

SEQ ID NO: 196609 - DNA, 240 bp, Homo sapiens
  misc_feature: GYAE6OF02FWN7C.14.36.D03.1.454.CMB.1.raw
  modified_base (238)..(240): a, c, t, g, unknown or other
  misc_feature (238)..(240): n is a, c, g, or t
tcagcgtctagtaccacgaccggtgctcgatttagctgcgtcacgatctctcttggggcttttgatatctggggccaagggacagtggtcaccgtctcttcagcctccaccaagggcccatcggtcttccccctggcaccctcctccaagagcacctctgggggcacagcggccctgggctgcctggtcaaggactacttccgtactagacgctgagcgggctggcaaggcgcatagnnn

SEQ ID NO: 196610 - DNA, 510 bp, Homo sapiens
  misc_feature: GYAE6OF02JCAON.14.36.D03.1.454.CMB.1.raw
  modified_base (305)..(305): a, c, t, g, unknown or other
  misc_feature (305)..(305): n is a, c, g, or t
  modified_base (325)..(325): a, c, t, g, unknown or other
  misc_feature (325)..(325): n is a, c, g, or t
  modified_base (429)..(429): a, c, t, g, unknown or other
  misc_feature (429)..(429): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctcctggtaccaacaacacccaggcaaagcccccaaatcatgatttangaggtcaataatcggccctnaggtagtttctaatcgcttctctggctcaagtctggcaacacggcctccctgagcatctcgtgggctccgaggctgaggacgaggctgatttatactgcagctnatatacttatagcagtactgttggtttcggcggaggaacctaaggtcgaccgtcgtaggtccacggcccgaggcctcccgg

SEQ ID NO: 196611 - DNA, 534 bp, Homo sapiens
  misc_feature: GYAE6OF02I4R9S.14.36.D03.1.454.CMB.1.raw
  modified_base (229)..(229): a, c, t, g, unknown or other
  misc_feature (229)..(229): n is a, c, g, or t
  modified_base (307)..(307): a, c, t, g, unknown or other
  misc_feature (307)..(307): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtggttataagtatgtctcctggtaccaacaacacccaggcaaacgcccccaaactcatgatttangaggtcagtaatcgcctcgagggtttcaatcgctttctctggctaccaagtctggccaacgaccggcctccctgacccatctcgtgggcctccaggctggaggacgagtctgtaattattattgcagctacatatgccactggcagctaatcattcggttcgggttttcgggcgggggtaccgtaaggtcggacccggttccgtaggtcacgtacccggaggtcccg

SEQ ID NO: 196612 - DNA, 242 bp, Homo sapiens
  misc_feature: GYAE6OF02F5VWT.14.36.D03.1.454.CMB.1.raw
  modified_base (237)..(242): a, c, t, g, unknown or other
  misc_feature (237)..(242): n is a, c, g, or t
tcagcgtctagtaccacgaccggtgctcgatttagctgcgtcacgatctctcttgggcttttgatatctggggccaagggacagtggtcaccgtctcttcagcctccaccaagggcccatcggtcttccccctggcaccctcctccaagagcacctctgggggcacagcggccctgggctgcctggtcaaggactacttccgtactagacgctgagcgggctggcaaggcgcatagnnnnnn

SEQ ID NO: 196613 - DNA, 502 bp, Homo sapiens
  misc_feature: GYAE6OF02GR92R.14.36.D03.1.454.CMB.1.raw
tcagcgtctagtaccacgaccggtgctcgatttagctgcgtcacgatctctcttgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctcctggtaccaacaacacccaggcaaagcccccaaactcatgatttatgaggtcagtaatcggccctcagggttctaatcgcttctctggctcaagtctggcaacacggcctccctgaccatctctcgggctccaggctgaggacgagtctgtattattattgcagctcatatgcactggcagcaatcatggtggtttcggcgggggtaccgaaggtgaccgtcgtaggtcgagcccgaggtccg

SEQ ID NO: 196614 - DNA, 242 bp, Homo sapiens
  misc_feature: GYAE6OF02GBY7J.14.36.D03.1.454.CMB.1.raw
  modified_base (238)..(242): a, c, t, g, unknown or other
  misc_feature (238)..(242): n is a, c, g, or t
tcagcgtctagtaccacgaccggtgctcgatttagctgcgtcacgatctctcttggggcttttgatatctggggccaagggacagtggtcaccgtctcttcagcctccaccaagggcccatcggtcttccccctggcaccctcctccaagagcacctctgggggcacagcggccctgggctgcctggtcaaggactacttccgtactagacgctgagcgggctggcaaggcgcatagnnnnn

SEQ ID NO: 196615 - DNA, 505 bp, Homo sapiens
  misc_feature: GYAE6OF02GKK47.14.36.D03.1.454.CMB.1.raw
tcagcgtctagtaccacgaccggtgctcgatttagctgcgtcacgatctctcttgggggggtctcaggaggcagctctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctcctggtaccaacaacacccaggcaaagcccccaaactcatgatttatgaggtcagtaatcggccctcgagggtttctaatcgcttctctggctcagtctgcaacacggcctcctgaccatcctctgggcctccgaggctgacggacgagtctgattattattgcagctacatatgcaccgtgcagcatcagtggtggtttcgggcgggggaccaggtcgaccgtcgtaggtcgacgcccgaggtccg

SEQ ID NO: 196616 - DNA, 241 bp, Homo sapiens; identical to SEQ ID NO: 196461
  misc_feature: GYAE6OF02GOE2G.14.36.D03.1.454.CMB.1.raw
  modified_base (238)..(241): a, c, t, g, unknown or other
  misc_feature (238)..(241): n is a, c, g, or t

SEQ ID NO: 196617 - DNA, 509 bp, Homo sapiens
  misc_feature: GYAE6OF02I0880.14.36.D03.1.454.CMB.1.raw
  modified_base (325)..(325): a, c, t, g, unknown or other
  misc_feature (325)..(325): n is a, c, g, or t
tcagcgtctagtaccacgaccggtgctcgatttagctgcgtcacgatctctcttgggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcaccatctcctgcactggaaccagcagtgacgttggtggttataagtatgtctcctggtaccaacaacacccaggcaaagcccccaaactcatgatttatgaggtcagtaatcggcccctnaggggttctaatcgcttctctggctcaagtctggcaacacggcctccctgaccatctcgtcgggctccaggctggacggacgagtctagtattattattcgcagctacatatgcacctggcagcaatcattggtggtttcggcgggggtaacaggtcgaccgtcgtaggtcacgccgaggtccg

SEQ ID NO: 196618 - DNA, 182 bp, Homo sapiens
  misc_feature: GYAE6OF02HQP09.14.36.D03.1.454.CMB.1.raw
  modified_base (181)..(182): a, c, t, g, unknown or other
  misc_feature (181)..(182): n is a, c, g, or t
tcagcgtctagtaccacgaccggtgctcgatttagctgcgtcacgatctctcttgggttttgggggaagaggaagactgacggtccccccaggagttcaggtgctgggcacagcggccctgggctgcctggtcaaggactacttccgactagacgctgagcgggctggcaaggcgcatagnn

SEQ ID NO: 196619 - DNA, 238 bp, Homo sapiens
  misc_feature: GYAE6OF02ISA0B.14.36.D03.1.454.CMB.1.raw
  modified_base (234)..(238): a, c, t, g, unknown or other
  misc_feature (234)..(238): n is a, c, g, or t
tcagcgtctagtaccacgaccggtgctcgatttagctgcgtcacgatctctcttgggcttttgatatctggggccaagggacgctggtcaccgtctcttcagcctccaccaagggcccatcggtcttcccctggcacctcctccaagagcacctctgggggcacagcggccctgggctgcctggtcaagactacttccgtactagacgctgagcgggctggcaaggcgcatagnnnnn

SEQ ID NO: 196620 - DNA, 509 bp, Homo sapiens
  misc_feature: GYAE6OF02GKHXJ.14.36.D03.1.454.CMB.1.raw
  modified_base (365)..(365): a, c, t, g, unknown or other
  misc_feature (365)..(365): n is a, c, g, or t
tcagcgtctagtaccacgaccggtgctcgatttagctgcgtcacgatctctcttgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctcctggtaccaacaacacccaggcaaagcccccaaaatcatgatttatgaggtcagtaatcggccctcgagggtttctaatcgcttctctggctcaagtctggcaacncggcctccctgaccatctctgggctccgaggctgaggacgagtctgtattattattgcagctcatatgcacctggcagcaatcagtggtggtttcgggcgggggtaccaagggtgaccggtcgtaggtcgacgcccgaggtccg

SEQ ID NO: 196621 - DNA, 243 bp, Homo sapiens
  misc_feature: GYAE6OF02HZTPI.14.36.D03.1.454.CMB.1.raw
  modified_base (238)..(243): a, c, t, g, unknown or other
  misc_feature (238)..(243): n is a, c, g, or t
tcagcgtctagtaccacgaccggtgctcgatttagctgcgtcacgatctctcttggggcttttgatatctggggccaagggacagtggtcaccgtctcttcagcctccaccaagggcccatcggtcttccccctggcaccctcctccaagagcacctctgggggcacagcggccctgggctgcctggtcaaggactacttccgtactagacgctgagcgggctggcaaggcgcatagnnnnnn

SEQ ID NO: 196622 - DNA, 518 bp, Homo sapiens
  misc_feature: GYAE6OF02GXQBC.14.36.D03.1.454.CMB.1.raw
  modified_base (307)..(307): a, c, t, g, unknown or other
  misc_feature (307)..(307): n is a, c, g, or t
  modified_base (369)..(369): a, c, t, g, unknown or other
  misc_feature (369)..(369): n is a, c, g, or t
  modified_base (444)..(444): a, c, t, g, unknown or other
  misc_feature (444)..(444): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctcctggtaccaacaacacccaggcaaacgcccccaaactcatgatttangaggtcagtaatcggccctcgtagggtttctaatcgcttctctggctccaagtctggcaacncggcctccctgaccatctctcgggcctccgaggctgaggacgtagtctagtatttattattgcagctcatatgcncgtgcagcaatcagtggttgggtttacgggcgggggtacagggtcgaccgtcgtaggtcacgcccgaggtcccg

SEQ ID NO: 196623 - DNA, 172 bp, Homo sapiens
  misc_feature: GYAE6OF02F9USO.14.36.D03.1.454.CMB.1.raw
  modified_base (172)..(172): a, c, t, g, unknown or other
  misc_feature (172)..(172): n is a, c, g, or t
tcagcgtctagtaccacgaccggtgctcgattagctgcgtcacgatctctcttggttgggaagaggaagactgacggtccccaggagttcaggtgctgggcacagcggccctggctgcctggtcaaggactacttccgtactagacgctgagcggctggcaaggcgcatagn

SEQ ID NO: 196624 - DNA, 507 bp, Homo sapiens
  misc_feature: GYAE6OF02GKJCZ.14.36.D03.1.454.CMB.1.raw
  modified_base (326)..(326): a, c, t, g, unknown or other
  misc_feature (326)..(326): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctcctggtaccaacaacacccaggcaaagcccccaaactcatgatttatgaggtcagtaatcggccctnaggggtttctaatcgcttctctggctcaagtctgcaacacggcctcctgaccatctctgggctccgaggctgaggacgagtctgtattaattattgcagctacatatgccactggcagcaatcatggttgggtttcgggcgggggactagggtgacccgtcgtaggtcgacgccaggtccg

SEQ ID NO: 196625 - DNA, 513 bp, Homo sapiens
  misc_feature: GYAE6OF02JHJEP.14.36.D03.1.454.CMB.1.raw
tcagcgtctagtaccacgaccggtgctcgatttagctgcgtcacgatctctcttgggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcaccatctcctgcactggaaccagcagtgacgttggtggttataagtatgtctctggtaccaacaacaccaggcaaagccccaaatcatgatttatgaggtcagtaatcggcctcagggtttctaatcgcttctctggctcaagtctggcaacaccggcctccctgaccatctcgtcggctccaggctgaggacgagtctgtattattattgctagctcatatgcactggcagctaatctatggtcgggttttcggcggggggtaccaagggtcgaccggttcgtaggtcacggtcccgaaggtcccgg

SEQ ID NO: 196626 - DNA, 524 bp, Homo sapiens
  misc_feature: GYAE6OF02HLLS0.14.36.D03.1.454.CMB.1.raw
  modified_base (229)..(229): a, c, t, g, unknown or other
  misc_feature (229)..(229): n is a, c, g, or t
  modified_base (306)..(306): a, c, t, g, unknown or other
  misc_feature (306)..(306): n is a, c, g, or t
tcagcgtctagtaccacgaccggtgctcgatttagctgcgtcacgatctctcttgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatcctcctgcactggaaccngcagtgacgttggtggttataagtatgtctcctggtaccaacaacacccaggacaaagcccccaaatcatgatttangagtcagtaatcggcctgagggtttctaatcgtcttctctggctccaagtctggcaacacggcctccctgaccatctctggctccaggctagaggacgagtctgtatttattatgacagctacatatgccacctggcaagcaatctagttggttaggtttccggggacgggggtaaccaagggttcgaccggttccaggttccaccgtccgagtcccg

SEQ ID NO: 196627 - DNA, 543 bp, Homo sapiens
  misc_feature: GYAE6OF02I0MA3.14.36.D03.1.454.CMB.1.raw
  modified_base (382)..(382): a, c, t, g, unknown or other
  misc_feature (382)..(382): n is a, c, g, or t
  modified_base (430)..(430): a, c, t, g, unknown or other
  misc_feature (430)..(430): n is a, c, g, or t
tcagcgtctagtaccacgaccggtgctcgatttagctgcgtcacgatctctcttgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatcctctgcactggaaccagcagtgacgttggtggttataagtatgtctcctggtaccaacaacacccaggcaaaagcccccaaactcatcgatttatgaggtcagtaatcggccctgtaggggtttctaatcgtactttctctggctccaagtctggcaacacggccctccncgaccatctctcgggctccaggctgaggacgagttctgattattattnctagctcattatgacaccttggaccagacaatcattggttcgggttttccgggacggggggtaccaagggttcgacccggttcgtacggttacacggtaccccaggtccccgg

SEQ ID NO: 196628 - DNA, 648 bp, Homo sapiens
  misc_feature: GYAE6OF02HPY2N.14.36.D03.1.454.CMB.1.raw
  modified_base (271)..(271): a, c, t, g, unknown or other
  misc_feature (271)..(271): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatcctccgcactggaaccagcagtgacgttggtggttataagtatgtctcctggtaccaanaaccacccaggacaaacgcccccaaactcatagatttatgagtacagtaactcggaccctcgtagggtttctaacgtcgtacttctcgtggtctaccgaagttcgtgaccaacgaccggtccctcctacgacctatctaccgtcgggcctccgaggtcgtcggacgggacgtacgttccgttagtactttaagtttacttgtacctagtccttacgtaattacgtcgaccctaccgttaggaccgtaacgtactaactacgtagttacggggttttcgggttttacccgggggaccggggggtaacctaacggggttcggtaaccccggttacgtaccgggttaccgaacggtacccgaaccggtccgtaccccggg

SEQ ID NO: 196629 - DNA, 674 bp, Homo sapiens
  misc_feature: GYAE6OF02J3RGG.14.36.D03.1.454.CMB.1.raw
  modified_base (198)..(198): a, c, t, g, unknown or other
  misc_feature (198)..(198): n is a, c, g, or t
  modified_base (208)..(208): a, c, t, g, unknown or other
  misc_feature (208)..(208): n is a, c, g, or t
  modified_base (214)..(214): a, c, t, g, unknown or other
  misc_feature (214)..(214): n is a, c, g, or t
  modified_base (226)..(226): a, c, t, g, unknown or other
  misc_feature (226)..(226): n is a, c, g, or t
tcagcgtctagtaccacgaccggtgctcgatttagctgcgtcacgatctctcttgggggggtctcaggaggcagcgctctcaggacatctccaccatggcctgggctctgctgctcctcaccctcctcactcagggcacagggtcctgggcccagtctgccctgactcagcctgcctccgtgtctggtctcctggacngtcatcaccntctccngcactggaaccngcagtgacgttggtgtatagtatgtctctgtacaactacaccagcaaacgccccaatcactgtattatagaggtcaagtacgtccggtccgtagtacgggtttcaacgtcgtcttcgtacgttcggacctcgtaacgtcgtacggacctaaaccgccggtcccttcccgtacggaaccctacttccgtcgttcgggcctttaccgaacgggtcgttacgggacggtaacgtagttacgttggttaaactttattacgttagaccgttagtccttacgtaatttactacgtacccgtacggtaccggtacacggtactagttacgtaaggtttccggggtacgggtttttccgggggaaccgggggtaaccgttaacgggttaccggttaacccggttccggtaaccgggttcccgtaacccgggtaccccggtaacgttacccccggg

SEQ ID NO: 196630 - DNA, 518 bp, Homo sapiens
  misc_feature: GYAE6OF02F6VLW.14.36.D03.1.454.CMB.1.raw
  modified_base (410)..(410): a, c, t, g, unknown or other
  misc_feature (410)..(410): n is a, c, g, or t
  modified_base (455)..(455): a, c, t, g, unknown or other
  misc_feature (455)..(455): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctcctggtaccaacaacacccaggacaaacgcccccaaactcatgatttatgaggtcagtaatcggccctgtagggtttctaagtcgtcttctctggctcaagtctgcacacggcctcctgaccatctcgtggcctccgaggctggaggacgngtctgtatttattatgcagctacatatcgcaccgtgacagacatntagtggttcgggtttcgggacggggtacaggtcgaccgtcgtaggtccgacgtaccgagtccg

SEQ ID NO: 196631 - DNA, 533 bp, Homo sapiens
  misc_feature: GYAE6OF02GLAAU.14.36.D03.1.454.CMB.1.raw
  modified_base (229)..(229): a, c, t, g, unknown or other
  misc_feature (229)..(229): n is a, c, g, or t
  modified_base (365)..(365): a, c, t, g, unknown or other
  misc_feature (365)..(365): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtggttataagtatgtctcctggtaccaacaacacccaggcaaagcccccaaatcatgatttatgaggtcagtaatcggccctcgagggtttctaatcgcttctctggctcaagtctggcaacncggccctcctgaccatcctcgtcgggcctccgaggctggaacgggacgagttctgtatttattattcgcagtctacatatgcaccgtggacagcaatcagtggttgggtttcgggacgggggtacctagggtcgacccggttcgtaggtccgacgtcccgaggtcccg

SEQ ID NO: 196632 - DNA, 549 bp, Homo sapiens
  misc_feature: GYAE6OF02I49J1.14.36.D03.1.454.CMB.1.raw
  modified_base (419)..(419): a, c, t, g, unknown or other
  misc_feature (419)..(419): n is a, c, g, or t
  modified_base (447)..(447): a, c, t, g, unknown or other
  misc_feature (447)..(447): n is a, c, g, or t
  modified_base (462)..(462): a, c, t, g, unknown or other
  misc_feature (462)..(462): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatcctcctgcactggaaccagcagtgacgttggtggttataagtatgtctcctggtaccaacaacacccaggacaaacgccccccaaactcatgatttatgaggtcagtaactccggccctcgtagggtttctaatcgtctttctctggtctcgtaagtcgtaggccaaccgacggtccctccctgaccctatcctcgtcgggctccgnggtctggaggacgagtctagtattattntgcagtctacattcngctaccgtggcagacatcagtggtcgggtttcgggaccgggggactacgggtcgtaccggtcgtaggtcaccggacccgaggtcccg

SEQ ID NO: 196633 - DNA, 512 bp, Homo sapiens
  misc_feature: GYAE6OF02FU6ND.14.36.D03.1.454.CMB.1.raw
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctcctggtaccaacaacacccaggcaaagcccccaaaatcatgatttatgagtcagtaatcggccctcagggtttctaatcgctttctctggctcaagtctggcaacacggcctccctgaccatctctgggctccgaggctgaggacgagtctgtatttattattgcagctacatatgcaccgtgcagcaatcatggttggtttccgggcgggggtaccagggtcgaccgtcgtaggtcacgacccgaggtcccg

SEQ ID NO: 196634 - DNA, 539 bp, Homo sapiens
  misc_feature: GYAE6OF02IN2Z5.14.36.D03.1.454.CMB.1.raw
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttatagtatgtctctgtaccacaacaccagcaaacgccccaaactcatgatttatgaggtcagtaatccggcctcgtagggttctaatcgcttctctgctcaagtctgcaacgacgccctcctgaccatctcgtcgggctccgaggctggacggacgagtctagtatttattattgctagtctacatatcgcaccgtggacagacaatcagttgggttcgggttttaccggggcgggggtaaccgtaagggtacggtacccggttcgttacggtccgacggacccgaaggtcccg

SEQ ID NO: 196635 - DNA, 539 bp, Homo sapiens
  misc_feature: GYAE6OF02JZYPC.14.36.D03.1.454.CMB.1.raw
  modified_base (230)..(230): a, c, t, g, unknown or other
  misc_feature (230)..(230): n is a, c, g, or t
  modified_base (310)..(310): a, c, t, g, unknown or other
  misc_feature (310)..(310): n is a, c, g, or t
  modified_base (380)..(380): a, c, t, g, unknown or other
  misc_feature (380)..(380): n is a, c, g, or t
  modified_base (439)..(439): a, c, t, g, unknown or other
  misc_feature (439)..(439): n is a, c, g, or t
tcagcgtctagtaccacgaccggtgctcgatttagctgcgtcacgatctctcgttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtggttataagtatgtctcctggtaccaacaacacccaggacaaacgcccccaaactcatgatttacngaggtcagtaactccggccctcgaggggtatctaatcgcttctctggctcaagtctgcaacgcgcctccngaccatctctggctccgagctagacggacgagtctgtattattatgacagtctactatntagcctaccgtggacagctaatctagtggttcgggtttcgggaccgggggtactaagggtcgtaccggtccgtacggtaccgtacggtaccgtaaccggg

SEQ ID NO: 196636 - DNA, 563 bp, Homo sapiens
  misc_feature: GYAE6OF02GXDJP.14.36.D03.1.454.CMB.1.raw
  modified_base (368)..(368): a, c, t, g, unknown or other
  misc_feature (368)..(368): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctcctggtaccaacaacacccaggcaaacgcccccaaactcatgatttatgaggtcagtaatcggccctcgagggtttctaatcgctttctctggctcaagtctggcaacncggcctccctgaccatctctgggctcaggctgaggcgagttctagtattattattgctacgctcgattagtcgccaccgtggcaacgactaactctagttcggttcggggttttcgggaccgggggggtaaccgtaacgggttcggtaacccggttccggttacgggtaccgtaccggacccgtaagggtccccg

SEQ ID NO: 196637 - DNA, 597 bp, Homo sapiens
  misc_feature: GYAE6OF02HC85O.14.36.D03.1.454.CMB.1.raw
  modified_base (305)..(305): a, c, t, g, unknown or other
  misc_feature (305)..(305): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctctggtaccaacaacaccaggcaaacgcccccaaactcatgatttangagtcagtaatccggccctgtagggtttactaatcgtctttctcgtcggctcaagtctggaccaaccgaccggcccttccctcgacccattccgtcgtcgggcctccgaggtctgggacggacgtagttctagtatttattagttgctagtcctactaagttacgtcgtaccaccgttggacaacgactaacgtctagtttcgggtttggggtttaccgggggacgggggtaaccgtaacgggtcgtacccggttacggttacggtaccgaccggtacccgacggtccccgg

SEQ ID NO: 196638 - DNA, 630 bp, Homo sapiens
  misc_feature: GYAE6OF02JA7OT.14.36.D03.1.454.CMB.1.raw
  modified_base (305)..(305): a, c, t, g, unknown or other
  misc_feature (305)..(305): n is a, c, g, or t
tcagcgtctagtaccacgaccggtgctcgatttagctgcgtcacgatctctcttgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctcctggtaccaacaacacccaggcaaacgcccccaaatcatgatttangaggtcagtaatcgcctgagggtttcaatcgtcttctctggctcaagtctggctaacgaccggcctcctgaccatctcgtcgggcctccgaggctaggaggaccgagtctagtaactttattagttgctaagtctacgtaattagtcgtccgtaaccgttcgggacctaacggtacctaacgttacccgtaaggttttcgggtttaccgggggtttttaccgggggaaccgggggggttaacccgtaaacggggttacggtaacccccgggttaccggtttaacggggtacccgtaaccggtacccccggtaagggttcccccgg

SEQ ID NO: 196639 - DNA, 585 bp, Homo sapiens
  misc_feature: GYAE6OF02G9G8E.14.36.D03.1.454.CMB.1.raw
  modified_base (308)..(308): a, c, t, g, unknown or other
  misc_feature (308)..(308): n is a, c, g, or t
  modified_base (417)..(417): a, c, t, g, unknown or other
  misc_feature (417)..(417): n is a, c, g, or t
  modified_base (432)..(432): a, c, t, g, unknown or other
  misc_feature (432)..(432): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcagtcaccatatcctgcactggaaccagcagtgacgttggtgcttataactttgtctcctggtaccaacagcacccaggcaaacgcccccaaaactcatgatttangacgtcaataagcggacccgtcggggtccctgactcgtcttctcgtggctaccaagtctggaccaacgaccggccctcctgacctctcgtggctccgagctgacgatgngtctgtattattacngcagtcctacgactattcgactagtacctaaaggttaaccttaaggtttttccgggggttttacggacggggtaacgggaaccaaggtcccgtacggtaacccgtaccgttaacggtccgaaccggtaccccgtaagggtcccttaccccggg

SEQ ID NO: 196640 - DNA, 522 bp, Homo sapiens
  misc_feature: GYAE6OF02FNDRC.14.36.D03.1.454.CMB.1.raw
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctcctggtaccaacaacacccaggcaaagcccccaaactcatgatttatgaggtcaaataactcggccctcaggtagtttctaatcgcttctctggctcaagtctggacaacacggcctccctgacgcatctctgggctccgaggctggaggacgaggtctgatttatactgcagctcattactactattagcagtaacttgtcggttttcggcggagggtacccgaaggtcgaccggttctaggtccgagcccaaggctcccgg

SEQ ID NO: 196641 - DNA, 555 bp, Homo sapiens
  misc_feature: GYAE6OF02I6IRC.14.36.D03.1.454.CMB.1.raw
  modified_base (211)..(211): a, c, t, g, unknown or other
  misc_feature (211)..(211): n is a, c, g, or t
  modified_base (305)..(305): a, c, t, g, unknown or other
  misc_feature (305)..(305): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccntctcctgcactggaaccagcagtgacgttggtggttataagtatgtctctggtaccaacaacacccaggcaaacgcccccaaatcatgatttangaggtcagtaatcgccctgtagggttctaatcgcttctcgtggctcaagtctggcaacacggcctcctgaccattcgtcgtgggcctccgaggtcctaggacggaccgtaggttctagtatttattacgttgctagtcttacatactgacaccttggacagctaagtctagttcggttggttttccggggacggggtaccgtaagggtcgtaccggttccgtacgggtcgaaccggtccgtaggtccccg

SEQ ID NO: 196642 - DNA, 239 bp, Homo sapiens
  misc_feature: GYAE6OF02JACOY.14.36.D03.1.454.CMB.1.raw
  modified_base (237)..(239): a, c, t, g, unknown or other
  misc_feature (237)..(239): n is a, c, g, or t
tcagcgtctagtaccacgaccggtgctcgatttagctgcgtcacgatctctcttgggcttttgatatctggggccaagggacagtggtcaccgtctcttcagcctccaccaagggcccatcggtcttccccctggcaccctcctccaagagcacctctgggggcacagcggccctgggctgcctggtcaaggactacttccgtactagacgctgagcgggctggcaaggcgcatagnnn

SEQ ID NO: 196643 - DNA, 684 bp, Homo sapiens
  misc_feature: GYAE6OF02HVH76.14.36.D03.1.454.CMB.1.raw
  modified_base (307)..(307): a, c, t, g, unknown or other
  misc_feature (307)..(307): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtgttataagtatgtctcctgtaccaacaacaccaggacaaacgccccaaactcatagtatttagngaggtcagtaatccggccctcgtagggtttcaagtcgtcttctctggtctaccaagtctggaccaacgtaccggccctccctacgacctacttccgtccggttcgggccctacccgtagggtcctacgggaacgggtaccgtacgttccgttaggtaattttaactttacgttcgaccgtacgtccttaccgtaattacgttcgacccgttaacgttcgggacctaacgacctaacttcgttaaggtttcgggttttacgggggttttacccggggtaccgggggggtaaacccgtaacggggttaccggttaccccggttacccgggttaacgggttacccggtaacggtacccccgggtaacggttacccccggg

SEQ ID NO: 196644 - DNA, 633 bp, Homo sapiens
  misc_feature: GYAE6OF02IKKXK.14.36.D03.1.454.CMB.1.raw
  modified_base (320)..(320): a, c, t, g, unknown or other
  misc_feature (320)..(320): n is a, c, g, or t
  modified_base (350)..(350): a, c, t, g, unknown or other
  misc_feature (350)..(350): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacgagggtcctgggcccagtctcgccctgactcacgcctcgccctccgtgtccgtgggttcctccgtggacacggtcgactccaaccgtatcctcctgtccaccgtaggaaccagacctggtagtaccggttggttaggttaataagttagtcgtcctccgtacgtaaccaacaaccaccgngaaccaaaccgaccccaatcaatctattangtacgtacagtactccggcttacgagggttctaagtctacttctctcgctacgagttcacgtaacgcgtcctcctcgaacctagtccctagtaccgccgcgtacggtgtacggtacggtacgtacgtacgttacgtacgttacgttacgtacgtcgtacgtcgtagtactacgtacgtacgtaacgtacgtacgtacgtaactacgtacgtagttcggttcggttcggtcggtacggtacgtacgtacgtacgtacgtacgtacggtacgtaccgtacgtccg

SEQ ID NO: 196645 - DNA, 525 bp, Homo sapiens
  misc_feature: GYAE6OF02G3TT6.14.36.D03.1.454.CMB.1.raw
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctcctggtaccaacaacacccaggcaaagcccccaaactcatgatttatgaggtcagtaatccggccctcgtagggtttctaatcgcttctctggctcaagtctggcaacacggcctccctgaccatctcgtgggctccgaggctggaggacgagtctgatttattatgcagctacatatgcaccgtggcagcaatcagttggttgggttttcggacggggggtacctaagggtcgaccgttccgtaggtcgacggtcccaggtcccg

SEQ ID NO: 196646 - DNA, 619 bp, Homo sapiens
  misc_feature: GYAE6OF02H69TT.14.36.D03.1.454.CMB.1.raw
  modified_base (212)..(212): a, c, t, g, unknown or other
  misc_feature (212)..(212): n is a, c, g, or t
  modified_base (231)..(231): a, c, t, g, unknown or other
  misc_feature (231)..(231): n is a, c, g, or t
  modified_base (263)..(263): a, c, t, g, unknown or other
  misc_feature (263)..(263): n is a, c, g, or t
  modified_base (309)..(309): a, c, t, g, unknown or other
  misc_feature (309)..(309): n is a, c, g, or t
  modified_base (315)..(315): a, c, t, g, unknown or other
  misc_feature (315)..(315): n is a, c, g, or t
tcagcgtctagtaccacgaccggtgctcgattttagctgcgtcacgatctctcttgggggggggtctcaggaggcagcgctctcaggacatctccaccatggcctgggctctgctgctcctcacctcctcactcagggcacagggtcttgggcccagtctgccctgactcagcctgcctccgtgtctgggtctccgtggacagtcgatcacntctcctgcactcggaaccngcagtgtacgttggtaggttataagtatgtcnccgtgtacaacacaccgagcaaacgccccaaatcatagtactttancgagtntaagacgtcgcctacggtacggtttactaagtcgtcttctgtcgctacaagttcagacaacgccggtacctaccctcgaacctctccgtacgtcggacctcggaagctggaaggactaggtccgttagtacgtttattacgtcgctacgtctactatacgtcaccgtacgtcggtacgacgtaagtacctacgtaaggtttcggttccggggtttacgggggacccgggttaaccggtaacggttacgggtaccccggttaaccggtcggtaacccggtacggtacccggtaacggtccccggg

SEQ ID NO: 196647 - DNA, 526 bp, Homo sapiens
  misc_feature: GYAE6OF02IHIUO.14.36.D03.1.454.CMB.1.raw
  modified_base (365)..(365): a, c, t, g, unknown or other
  misc_feature (365)..(365): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctctggtaccaacaacacccaggcaaacgcccccaaactcatgatttatgaggtcagtaatcggccctcgagggttctaatcgcttctctggctcaagtctggcaacncgcctcctgaccatctctgggctccgaggctggacggacgagttctagtattattattgctagctcatatcgctaccgtggacagcaatcagttggttcgggttttacgggcgggggtaacctaagggtgtaccgtcgtacggtcacgcccgaaggtcccg

SEQ ID NO: 196648 - DNA, 611 bp, Homo sapiens
  misc_feature: GYAE6OF02JI5EN.14.36.D03.1.454.CMB.1.raw
  modified_base (309)..(309): a, c, t, g, unknown or other
  misc_feature (309)..(309): n is a, c, g, or t
  modified_base (353)..(353): a, c, t, g, unknown or other
  misc_feature (353)..(353): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtcctcctggacagtcgatcaccatcctcctgcacgtggaacccagcagtgacgttggtggttataagtatgtctcctggtaccaacaacaccaggcaaacgcccccaaatcatgatttangaggtcaagtaactcggcctcgtagggtttactaatcgctttcnctgctacagtctgcaaccgacggcctcctgacctagtcctcgtcggccttaccgaggtctaggacggacgtagttcgtagtaactttattagttcgacgtagccttacgtaattacgtcgtaccgtacttcgggacaacggacttaacttctaacggttcgggtttcgggggttttaacccgggggacgggggtaacccgtaaaggggttcgaaccgtacgggttaccgtaacgggtccgtacggaccccgtaacggg

SEQ ID NO: 196649 - DNA, 246 bp, Homo sapiens
  misc_feature: GYAE6OF02I1FOO.14.36.D03.1.454.CMB.1.raw
  modified_base (238)..(246): a, c, t, g, unknown or other
  misc_feature (238)..(246): n is a, c, g, or t
tcagcgtctagtaccacgaccggtgctcgatttagctgcgtcacgatctctcttggggcttttgatatctggggccaagggacagtggtcaccgtctcttcagcctccaccaagggcccatcggtcttccccctggcaccctcctccaagagcacctctgggggcacagcggccctgggctgcctggtcaaggactacttccgtactagacgctgagcgggctggcaaggcgcatagnnnnnnnnn

SEQ ID NO: 196650 - DNA, 653 bp, Homo sapiens
  misc_feature: GYAE6OF02JUFRE.14.36.D03.1.454.CMB.1.raw
  modified_base (229)..(229): a, c, t, g, unknown or other
  misc_feature (229)..(229): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctcgtgtctgggtctccgtggacagtcgatcaccatctcctgcactggaaccngcagtgacgttggtgttataagtatgtctctacggtaccaacaaccaccaggaccaaaccgccccaaactcatagtatttatgaggtacagtaacgtccggtcctacggtacgggtttactaacgtcgtaccttcgtcgtcgtccgtacgtaagttcgtacgaccgaaccgtaccggtccctacccgtacgacctacttccgtcgtcgggtcctaccgtagtccgtaggaacggacgtagttcgttacgttaatttagttacgttgacgtacgtcttactacttcgtcgaccgtaccgtcggaacacgtacgtaacttcgtaaggtttcgggttacggggtttccggggaccggggggtaaccgttaacgggtaccggtacccggttaccgtacggtaccggtacggtacccgacgggtccccg

SEQ ID NO: 196651 - DNA, 241 bp, Homo sapiens; identical to SEQ ID NO: 196461
  misc_feature: GYAE6OF02I5Y46.14.36.D03.1.454.CMB.1.raw
  modified_base (238)..(241): a, c, t, g, unknown or other
  misc_feature (238)..(241): n is a, c, g, or t

SEQ ID NO: 196652 - DNA, 578 bp, Homo sapiens
  misc_feature: GYAE6OF02FQ6DO.14.36.D03.1.454.CMB.1.raw
  modified_base (228)..(228): a, c, t, g, unknown or other
  misc_feature (228)..(228): n is a, c, g, or t
tcagcgtctagtaccacgaccggtgctcgatttagctgcgtcacgatctctcttgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtggttataagtatgtctcctggtaccaacaacacccaggcaaacgcccccaaactcatgatttatgaggtcagtaatcggcctcgagggtttctaatcgcttctctggctcaagtctggcaacgaccggcctccctgacctactcttcgtcgggtcctccgaggcctaggacggacgtagttctgtaattattatgcagtctacattatcgtacaccgttggaccacggtactaagtcctagttgggtttcgggtttaccggggaccggggggtaacccgttaagggtccggtaacccggttccgtaacgggttccgacgtacccggaaggtccccg

SEQ ID NO: 196653 - DNA, 557 bp, Homo sapiens
  misc_feature: GYAE6OF02G1LQC.14.36.D03.1.454.CMB.1.raw
  modified_base (229)..(229): a, c, t, g, unknown or other
  misc_feature (229)..(229): n is a, c, g, or t
  modified_base (306)..(306): a, c, t, g, unknown or other
  misc_feature (306)..(306): n is a, c, g, or t
  modified_base (447)..(447): a, c, t, g, unknown or other
  misc_feature (447)..(447): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtggttataagtatgtctctggtaccaacaacaccaggacaaacgccccaaactcatgtatttangagtcagtaatcggcctgtagggttctaatcgtcttctctcggtctaccaagtctcggaccaacgaccggtccctccctcgaccctactctcgtcgggcctccgaggctggacggtacgtagtctagtatttattattgcngtctacatagtgacctacgtgacagtacatctagttggttcgggtttcggggaccgggggtactaacgggtcgtaccggttcgtacggtcgaccggacccgaaggtcccg

SEQ ID NO: 196654 - DNA, 524 bp, Homo sapiens
  misc_feature: GYAE6OF02HNQ16.14.36.D03.1.454.CMB.1.raw
  modified_base (305)..(305): a, c, t, g, unknown or other
  misc_feature (305)..(305): n is a, c, g, or t
  modified_base (362)..(362): a, c, t, g, unknown or other
  misc_feature (362)..(362): n is a, c, g, or t
  modified_base (370)..(370): a, c, t, g, unknown or other
  misc_feature (370)..(370): n is a, c, g, or t
  modified_base (424)..(424): a, c, t, g, unknown or other
  misc_feature (424)..(424): n is a, c, g, or t
  modified_base (428)..(428): a, c, t, g, unknown or other
  misc_feature (428)..(428): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctcctggtaccaacaacaccaggacaaagcccccaaatcatgatttangagtcagtaatcggccctcgagggtttctaatcgcttctctggctcagtctgcaacncgcctccngaccatctcgtggcctccgaggctggaggacgagttctgatttattattgctanctanatatgcaccgtggcagacaatcagttggttcgggtttcgggacgggggtactaacgggtcgtaccggttcgtaggtccgacggcccgaaggtcccg

SEQ ID NO: 196655 - DNA, 578 bp, Homo sapiens
  misc_feature: GYAE6OF02F4WKO.14.36.D03.1.454.CMB.1.raw
  modified_base (213)..(213): a, c, t, g, unknown or other
  misc_feature (213)..(213): n is a, c, g, or t
  modified_base (230)..(230): a, c, t, g, unknown or other
  misc_feature (230)..(230): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctcgtgtctggtctcctggacagtcgatcaccattcncctgccactcggaaccngcagtgacgttggtgttataagtatgtctccgtggtaccaacaacacccaggacaaacgacccccaaactcatcgtatttatgagtcaagtaactcggcccttagtagggtttctaactcgtctttctctgctacaagtcgtgacaacgcgtcctcctcgaccatctcgtcggtctccgagtctggacgacgtagtcgtgtatttattactagctagtctactatagttcgacctacgtcgcgtacactacttacgtagttggtttcggggttcgggtacgggggtaaccgtagggtaccggacccggttacggtacggtaccggtaccgacccggaacggtccccgg

SEQ ID NO: 196656 - DNA, 508 bp, Homo sapiens
  misc_feature: GYAE6OF02G36J1.14.36.D03.1.454.CMB.1.raw
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctcctggtaccaacaacacccaggcaaagcccccaaactcatgatttatgaggtcagtaatcggccctcaggggtttctaatcgcttctctggctccaagtctggcaacacggcctccctgaccatctctgggctccaggctgaggacgagtctgattattattgcagctcatatgcacctggcagcaatcatggttggttttcggcgggggtaccagggtgaccgtcgtacggtcacgcccgaggtcccg

SEQ ID NO: 196657 - DNA, 551 bp, Homo sapiens
  misc_feature: GYAE6OF02JECLB.14.36.D03.1.454.CMB.1.raw
  modified_base (226)..(226): a, c, t, g, unknown or other
  misc_feature (226)..(226): n is a, c, g, or t
  modified_base (385)..(385): a, c, t, g, unknown or other
  misc_feature (385)..(385): n is a, c, g, or t
  modified_base (412)..(412): a, c, t, g, unknown or other
  misc_feature (412)..(412): n is a, c, g, or t
  modified_base (446)..(446): a, c, t, g, unknown or other
  misc_feature (446)..(446): n is a, c, g, or t
tcagcgtctagtaccacgaccggtgctcgatttagctgcgtcacgatctctcttgggggggtcgtcaggaggcagcgctctcaggacatctccaccatggcctgggctctgctgctcctcaccctcctcactcaggcacagggtcctgggcccagtctgccctgactcagcctgcctccgtgtctgggtctcctggacagtcgatcaccatctctgcactgaaccngcagtgacgtgtgttataagtatgtctcctggtaccaacaacaccagacaaacgcccccaaactcactagtatttatgaggtcagtaatcggccctcgagggtttctaacgtcgctttctctgctccaagtctgacacacgccctcctcgacatctcgngggtctccgaggcgtaggacggtacgngttacgtgtatttaattagtttgcagtctacatntcgctacgtgacacgcaactcagtcggttcgggtttcgggacgggggttaaccaacgggttacggaccggttaccgtacggtaccgacgtacccgtaaggtcccg

SEQ ID NO: 196658 - DNA, 273 bp, Homo sapiens
  misc_feature: GYAE6OF02GXVW4.14.36.D03.1.454.CMB.1.raw
  modified_base (242)..(273): a, c, t, g, unknown or other
  misc_feature (242)..(273): n is a, c, g, or t
tcagcgtctagtaccacgaccggtgctcgatttagctgcgtcacgatcgtctcttggggcttttgatatctggggccaagggacagtggtcaccgtctcttcagcctccaccaagggcccatcggtcttcccccctggcaccctcctccaagagcacctctgggggcacagcggccctgggctgcctggtcaaaggactacttccgtactagaccgctgagcgggctggcaaggcgcatagnnnnnnnnnnnnnnnnnnnnnnnnnnnnnnnn

SEQ ID NO: 196659 - DNA, 571 bp, Homo sapiens
  misc_feature: GYAE6OF02FWK8M.14.36.D03.1.454.CMB.1.raw
  modified_base (210)..(210): a, c, t, g, unknown or other
  misc_feature (210)..(210): n is a, c, g, or t
  modified_base (228)..(228): a, c, t, g, unknown or other
  misc_feature (228)..(228): n is a, c, g, or t
tcagcgtctagtaccacgaccggtgctcgatttagctgcgtcacgatctctcgttggggggggtctcaggaggcagcgctctcaggacatctccaccatggcctgggctctgctgctcctcaccctcctcactcgagggcacgagggtcctgggcccagtctgcctgactcagcctgcctcgtgtctggtctctggacagtcgatcaccntcctctgcactggaaccngcagtgacgttggtgtataagtatgtctctgtaccaacaacacccaggaccaaacgacccccaaactcatgtatttatgaggtcaagttaacgtcggtccctcgtagggtttactaatcgtcttctcgtggcctacgaagtctgcaaccgcggtccctcctgaccatcctcgtcggccttccgaggtctaggacggacgtagtctagtatttagtattcgatacgctatatctgcctacgtcgacgacgtacagtcctagttcgggtttacggggtttccgggaacgggggtactaacgggtcgtaccggttacgtacgggtccaccggaccgaggtaccccg

SEQ ID NO: 196660 - DNA, 610 bp, Homo sapiens
  misc_feature: GYAE6OF02GQM8G.14.36.D03.1.454.CMB.1.raw
  modified_base (236)..(236): a, c, t, g, unknown or other
  misc_feature (236)..(236): n is a, c, g, or t
  modified_base (312)..(312): a, c, t, g, unknown or other
  misc_feature (312)..(312): n is a, c, g, or t
  modified_base (348)..(348): a, c, t, g, unknown or other
  misc_feature (348)..(348): n is a, c, g, or t
tcagcgtctagtaccacgaccggtgctcgatttagctgcgtcacgattcgtcgtcttgggggggtctcaggaggcagcgctctcaggacatctccaccatggcctgggctctgctgctcctcaccctcctcactcagggcacagggtcctgggcccagtctgccctgactcagcctgcctcgtgtctagggtctcctggacagtccgatcgaccatcctcctgctacgtggaaccngccagtgacgttggtgttataagtatgtctcgtggtaccaacaacaccaggacaaacgccccaaatcatgatttangaggtcagtatcgcctcgtagggttctaatcgcttntctgtctcagtctggacacacggtcctccgtcgacctatcctacgtcgggtcctaccggacggtactggaacgggtacggtacgttccgtagttaactttacgtttacgttggtacgtacgtctaccgtaagttcgtagtaccgtaccgtcgggactacggactaacgtacgtagttcgggttagggttttaccgggacggggtaaccttagggtaccgtaccgttacggtacggtaccgtacggtacccgtagttacccgg

SEQ ID NO: 196661 - DNA, 743 bp, Homo sapiens
  misc_feature: GYAE6OF02F69TV.14.36.D03.1.454.CMB.1.raw
  modified_base (211)..(211): a, c, t, g, unknown or other
  misc_feature (211)..(211): n is a, c, g, or t
  modified_base (229)..(229): a, c, t, g, unknown or other
  misc_feature (229)..(229): n is a, c, g, or t
tcagcgtctagtaccacgaccggtgctcgatttagctgcgtcacgatctctcttgggggggtctcaggaggcagcgctctcaggacatctccaccatggcctgggctctgctgctcctcacctcctcactcaggcacagggtcctgggcccagtctgaccctgactcagcctgcctccgtgtcgtggtctccgtggacagtcgatccaacntcctctgcactggaaccngcagtcgacgttggtgttaataagtatgtccttcgtcgtaccgaactaaccacccgtaggaccaaacggacccccaaaacgtctaacgtagtaactttagtacggaacggttacctaagtaaacgttcccgggtacccttaccgttaagggggttttaccttaaacggttccgtacttttccggtacgtaccgggtaccttacccgtaaagtccgtaacggggacctaaaccggaccgggttcccctttaccggtaccggtaccttaaacgtcctacggttccggggtaccttcccggtacggtcgtacgggtacggaacgtacgggttactacgggttattaacgtttacgttacgcgtaacggttctacgttactagttacgacctacgtcgtacaagtacctaacgttcaagttcgtttacgggggttaccgggtaccggggggtaactaacgggttaccggtaacccgtttcggtaaccgggtcgtaacccggtaccgaacgggttcccg

SEQ ID NO: 196662 - DNA, 670 bp, Homo sapiens
  misc_feature: GYAE6OF02JOIQH.14.36.D03.1.454.CMB.1.raw
  modified_base (229)..(229): a, c, t, g, unknown or other
  misc_feature (229)..(229): n is a, c, g, or t
tcagcgtctagtaccacgaccggtgctcgatttagctgcgtcacgatctctcttgggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcaccgatctcctgacactggaaccngcagtgacgttggtggttataagtatgtctcctggtaccaacaacacccaggactaacgaccccaaactccaatcgtatttactgaggtcagtaatccggccctcgtaggggtttactaagtcgtactttcgtctcggtactctaaacgtctacgggtacaaaccgaccggtccctccgttcgacctatccgtacgtcgggtcctccgaggtcgtaggacggtacgtacgtcgttagtaatttacgttatttgacgtacgtcgtacctagttacttacgccgtaacccgttgggacccttaaggacctaattcccgtaagttccggggtttacggggtttttccgggggaacccgggggtaacccgtaaggggtttacccggtaacccgggtttcccgaacggggtttacccgaaccggtacccggtaacggtcccccggg

SEQ ID NO: 196663 - DNA, 608 bp, Homo sapiens
  misc_feature: GYAE6OF02GHRPJ.14.36.D03.1.454.CMB.1.raw
tcagcgtctagtaccacgaccggtgctcgatttagctgcgtcacgatctctcttggggggggtctcaggaggcagctctctcaggacatctccaccatggcctgggctctgctgctcctcaccctcctcactcagggcacgagggtcctgggcccagtctgccctgactcagcctgcctccgtgtctgggtctcctggacagtcgatcaccatctcctgcactggaaccagcagtgacgttggtggttataagtatgtctcctggtaccaacaacacccaggacaaacgcccccaaactcatgtatttatgaggtcagtaacgtcggccctacgtaggggtttctaatcgtctttctcgtggtcctaccgaagtctcggacaaccgaccggtccctcccgtcgaccctatccgtcgtcggggcctccgaggcctggacggacgtagttctgtatttattatgacacgtctacatagtgtccaccgtggcagacctaatacgtagttcgggtttcggggttttaccggggaccggggggtaacccgtaacggggttccggtaacccggttccggtaacgggtcccgaacggtaccccgaagggtccccg

SEQ ID NO: 196664 - DNA, 524 bp, Homo sapiens
  misc_feature: GYAE6OF02HXNM9.14.36.D03.1.454.CMB.1.raw
  modified_base (303)..(303): a, c, t, g, unknown or other
  misc_feature (303)..(303): n is a, c, g, or t
  modified_base (440)..(440): a, c, t, g, unknown or other
  misc_feature (440)..(440): n is a, c, g, or t
  modified_base (451)..(451): a, c, t, g, unknown or other
  misc_feature (451)..(451): n is a, c, g, or t
  modified_base (470)..(470): a, c, t, g, unknown or other
  misc_feature (470)..(470): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcacatctctgcactggaaccagcagtgacgttggtggttataagtatgtctctggtaccaacaacaccaggacaaacgccccaaactcatgatttangaggtcaagtaatccggcctcgtacgggtttctaatcgtctttctctgctcaagtctggacaacgacgcctccctacgaccactctctcggcctccgacggtctgacggacgaggctgtattattactgacagctanatatactatancagagttagtggtttcggngtacggactaggtcgtaccgtcgtagtcgacgaccgacgtacgtcgcccctcgg

SEQ ID NO: 196665 - DNA, 498 bp, Homo sapiens
  misc_feature: GYAE6OF02G3J4S.14.36.D03.1.454.CMB.1.raw
  modified_base (426)..(426): a, c, t, g, unknown or other
  misc_feature (426)..(426): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctcctggtaccaacaacacccaggcaaagcccccaaactcatgatttatgaggtcagtaatcggccctcgagggtttctaatcgcttctctggctccaagtctggcaacacggcctccctgacccatctctcgggctccgagctgaggacgagtctgattattattgcngctacatatgcactgcagcatcatggtgtttcgggcggggtacaggtgaccgtcgtaggcacgcccgagccg

SEQ ID NO: 196666 - DNA, 645 bp, Homo sapiens
  misc_feature: GYAE6OF02HIU58.14.36.D03.1.454.CMB.1.raw
  modified_base (231)..(231): a, c, t, g, unknown or other
  misc_feature (231)..(231): n is a, c, g, or t
  modified_base (309)..(309): a, c, t, g, unknown or other
  misc_feature (309)..(309): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtcctcctggacagtcgatcaccatcctcctgcactggaaccngcagtgacgttggtgttataagtatgtctcctggtacaacaacaccaggacaaacgcccccaaactcatcgtatttangagtcaagtaatccggcctagtagggtttacaacgtcgtctttctcgtggcctccgaaagtcgtacgactaacgaccggcctcccgtagaccctatccgtcgtcgggcctaccgaggtacttacggacggtacggacgttacgtagtaatttacttacgtacgacgacgtacctacgtaagttaactaacgttaactacgtacgtaagtaaccgttgggttacggtttaccggacgggtaccgggtaaccggtacggtaccggtacccgttaccggttacggtacccgacgggtacccgtaacgggtacccgtacccggtaccccccgttaccggg

SEQ ID NO: 196667 - DNA, 606 bp, Homo sapiens
  misc_feature: GYAE6OF02H4HTN.14.36.D03.1.454.CMB.1.raw
  modified_base (230)..(230): a, c, t, g, unknown or other
  misc_feature (230)..(230): n is a, c, g, or t
  modified_base (307)..(307): a, c, t, g, unknown or other
  misc_feature (307)..(307): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatcctcctgcactggaaccngcagtgacgttggtgttataagtatgtctcctggtaccaacaacaccaggacaaacgccccaaactcatgtatttangaggtcagtaatcggccctcgtagggtttctaatcgtcttctcgtgtactaccaagtctggaccaacgaccggtccctcccgtcgacctacgtctcgtcggctccgaggtctaggacggacgtagttcgtagtatttagttatcgactagtctacattatcgacctaccgtcgacaacgactaactcgtagtttcggtttcggggttttccggggaccgggggttaaccgtaacgggttaccgtaacccgggttaccggtaacgggttacccgaacggtaccccggtaaggtaccccgg

SEQ ID NO: 196668 - DNA, 706 bp, Homo sapiens
  misc_feature: GYAE6OF02I0YL3.14.36.D03.1.454.CMB.1.raw
  modified_base (229)..(229): a, c, t, g, unknown or other
  misc_feature (229)..(229): n is a, c, g, or t
  modified_base (299)..(299): a, c, t, g, unknown or other
  misc_feature (299)..(299): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtggttatagtatgtctctgtacaacacaccagacaacgccccaaatcatgatttagngagtcaagtaatccggtccctacgtagggtttactaacgtcgtactttctcgtcggtcctaccgtaaagtcgtacggaccaaaccgacccggtacccttcccgtacgaaccctaacttcccgtacggttcgggcccttacccgagggtcgtagggaacggtaccggtacggttaccgttagttaatttacgtttaacgttcgactacgtccttacgtaagttacgtcgtacccgtaccgttcggacctaacgtaactaagttccgtaaggttttccggggtttaacggggttttaccggggggaacccgggggggttaaaccttaaacggggttacccggttaaccccgggtttaccggttaaccgggtacccgtaaccccgggtacccggtaacggggtcccccgg

SEQ ID NO: 196669 - DNA, 248 bp, Homo sapiens
  misc_feature: GYAE6OF02GXMOT.14.36.D03.1.454.CMB.1.raw
  modified_base (239)..(248): a, c, t, g, unknown or other
  misc_feature (239)..(248): n is a, c, g, or t
tcagcgtctagtaccacgaccggtgctcgatttagctgcgtcacgatctctcttggggcttttgatatctggggccaagggacagtggtcaccgtctcttcagcctccaccaagggcccatcggtcttcccccctggcaccctcctccaagagcacctctgggggcacagcggccctgggctgcctggtcaaggactacttccgtactagacgctgagcgggctggcaaggcgcatagnnnnnnnnnn

SEQ ID NO: 196670 - DNA, 625 bp, Homo sapiens
  misc_feature: GYAE6OF02GGPJO.14.36.D03.1.454.CMB.1.raw
  modified_base (230)..(230): a, c, t, g, unknown or other
  misc_feature (230)..(230): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatcctcctgcactggaaccngcagtgacgttggtgtatagtatgtctctgtaccaacacaccagacaaacgcccccaaactcatgtatttatgagtcagtaactccggcctgtagggtttctaagtcgtctttctcgtggctactaagtcgtggaccaacgaccggccctcccgtcgaccctactccgtcgtcgggccttaccgaggtccgtaggacggacggtacgttcgtagttatttagtttacgttcgacctacgtaccttactaattacgtcgtacctaccgttggtacgactacgtcgttagttcgggtttacggggtttcggggaccgggggttaaccgtacgggttaccggtacccgttccggttacgggtaccgtaccggtacccggtaacggtccctaccccggg

SEQ ID NO: 196671 - DNA, 734 bp, Homo sapiens
  misc_feature: GYAE6OF02IYBNI.14.36.D03.1.454.CMB.1.raw
  modified_base (212)..(212): a, c, t, g, unknown or other
  misc_feature (212)..(212): n is a, c, g, or t
  modified_base (229)..(229): a, c, t, g, unknown or other
  misc_feature (229)..(229): n is a, c, g, or t
tcagcgtctagtaccacgaccggtgctcgatttagctgcgtcacgatctctcgttgggggggggtctcaggaggcagcgctctcaggacatctccaccatggcctgggctctgctgctcctcaccctcctcactcagggcacgagggtcctgggcccagtctgccctgactcagcctgcctccgtgtctggtctctggacagtcgatcaccntctctgcactggaaccngcagtgacgttgtggttatagtatgtctcgtacgtacaacaaccaccaggacaaacgacccccaactcagtacgtatttagtgtaggtactagtaacgtcggtcccttacgtacggggtttactaagttccgtctttccgttcgtcggtccttaccaacgttcgtcggaccaaccgacccggtcccttacccgtacgtaccctacgttccgtaccgtcgggccttacccgaggtcgtaggaacgggacgtacgttcgtaggttaactttagtttaagttcgacgtcgtacttacgtaattacgtaccgtacctaccgttgggtaactaaccgtaagttccttagggtttccggggttttcgggggtttttaacccgggggggacccgggggggttaaaccgttaacgggggttaacccggttaaccccggtttacccgggttaaccgggtttacccggaaacccgggttccccgggtaaaccgggttccccgttaccccccgggg

SEQ ID NO: 196672 - DNA, 814 bp, Homo sapiens
  misc_feature: GYAE6OF02H60M2.14.36.D03.1.454.CMB.1.raw
  modified_base (367)..(367): a, c, t, g, unknown or other
  misc_feature (367)..(367): n is a, c, g, or t
tcagcgtctagtaccacgaccggtgctcgatttagctgcgtcacgatctctcgttgggggggggtctcaggaggcagcgctctcaggacatctccaccatggcctgggctctgctgctcctccaccctcctcactcagggcacgagggtcctcgggcccagtctcgccctgactcacgcctgcctccgtgtcgtgggtcctccgtggacagtcgatcaccatcctcctgacacgtacggaaccagacgaggttgtacggtttgggttaggtttaagttaagttactggttccttaccgtacggtaaacccaaaccaacccaaccgaacggaaccaaacccgaacccccaaacttcaatgttatttancggtaacgtacgaagtaacgtccggccttacggtaacgggttttactaacgttccgttcctttactcgttcggtacctaccgtaagttccgtacgaccctaaccgacccgggtcccttaccccgtacgtaacctacgtttcccgtaccgggttccggggtacccttaccggaggtaccggtaacgggaacgggtaacgtacggttaccgtttagttaaacgtttaactttaagtccggaacgtacgttacctacgttactacgttaccgtaccgtaaccggtcgaacgtaacgtacgtaacttaccggttaggttttccggggtttcgggggttttaacccggggggaccgggggtaacccggttaacgggttacccgggttaccccggttaaccgggttaccgggttaaccccggttacgggacccccggttaaggttccccccgg

SEQ ID NO: 196673 - DNA, 712 bp, Homo sapiens
  misc_feature: GYAE6OF02IV8GH.14.36.D03.1.454.CMB.1.raw
  modified_base (201)..(201): a, c, t, g, unknown or other
  misc_feature (201)..(201): n is a, c, g, or t
  modified_base (229)..(229): a, c, t, g, unknown or other
  misc_feature (229)..(229): n is a, c, g, or t
  modified_base (336)..(336): a, c, t, g, unknown or other
  misc_feature (336)..(336): n is a, c, g, or t
tcagcgtctagtaccacgaccggtgctcgatttagctgcgtcacgatctctcttgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacngtcatcacatcctctgcactcggaaccngcaggtcgtacggtttggttaggttaataagttagtcgttccttccgtcggtaacccaacaaccacccgagaccaaaccgacccccaaactccaatacgtatttagnggtacgtacaagtacgtccgccgtacgttacgggtttactagttccgtctttcgtcgtcggtctaccgtaagttccgtggaacccaaccgtcccggtccccttacccgtacggtaaccctacttccgtacccggttcggggacccttaccggacgggtccgtagggaaccggtacgtagttcgttagttaactttagtttaatcggtactacgttctacttagtacgtactccgtaccggttagacgtacgtacctaacgttcgtaaggtttcggggtttacgggggtttaccgggggaaccggggggtattaaccggggtaccgttacccggttacgggttaacggacccggtacgaccccggtaggtcccccgg

SEQ ID NO: 196674 - DNA, 561 bp, Homo sapiens
  misc_feature: GYAE6OF02F8I5Y.14.36.D03.1.454.CMB.1.raw
  modified_base (304)..(304): a, c, t, g, unknown or other
  misc_feature (304)..(304): n is a, c, g, or t
  modified_base (372)..(372): a, c, t, g, unknown or other
  misc_feature (372)..(372): n is a, c, g, or t
  modified_base (376)..(376): a, c, t, g, unknown or other
  misc_feature (376)..(376): n is a, c, g, or t
  modified_base (417)..(417): a, c, t, g, unknown or other
  misc_feature (417)..(417): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctctggtaccaacaacaccaggcaaacgcccccaaatcatgatttangagtcagtaatccggcctcgtagggtttctaatcgtcttctctgctcaagtctgcacgcgtcctcctnaccntctctggctcgaggctaggacgacgtgtctagtatttattntgctacgctactagtatcgaccacgtgacagactaatcgagttcgggtttcgggtttaccggggaccgggggtaaccgtaacggggttccgtacccgggttccggttaacgggtccgtaaccggtaccccgtaacggtccccgg

SEQ ID NO: 196675 - DNA, 629 bp, Homo sapiens
  misc_feature: GYAE6OF02IX9EG.14.36.D03.1.454.CMB.1.raw
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtcgtgggtctcctggacagtcgatcaccatcctcctgcactggaaccagcagtgacgttggtggttatagtaaatgtctcctggtaccaacacaccaggcaaacgccccaaactcatgattatgaggtacagtaatcggccctcgtagggttctaatcgcttctctgctcgaagtctggcaacgaccggccctcctacgacccactctcgtcgggctcccgacgggtctggacggaccgtacgttcgtagtagtttactttagttcgacgtgtccttactagttacgtgcctaaccgtcggacacggtacaacgttactaacgttcgggtttcggggtttttacccgggggacgggggggtaaccgtaaccggggttaccggttaaccccgggttccggttaaccgggtaccggtaaccggtaccccggaacgggttacccccggg

SEQ ID NO: 196676 - DNA, 735 bp, Homo sapiens
  misc_feature: GYAE6OF02HZDTE.14.36.D03.1.454.CMB.1.raw
  modified_base (500)..(500): a, c, t, g, unknown or other
  misc_feature (500)..(500): n is a, c, g, or t
  modified_base (580)..(580): a, c, t, g, unknown or other
  misc_feature (580)..(580): n is a, c, g, or t
  modified_base (662)..(662): a, c, t, g, unknown or other
  misc_feature (662)..(662): n is a, c, g, or t
  modified_base (668)..(668): a, c, t, g, unknown or other
  misc_feature (668)..(668): n is a, c, g, or t
  modified_base (719)..(719): a, c, t, g, unknown or other
  misc_feature (719)..(719): n is a, c, g, or t
tcagcgtctagtaccacgaccggtgctcgatttagctgcgtcacgatcgtcgtcgttggggggggtctcgaggaggcagcgctctcaggacatctccacatggcctggctctgctgctctcacctctcactcgaggcacagggtcctagggcccagtctgccctgactcgagcctgccctccgtgtctgggtcctccgtaggactagtcgaatccaccattcctccgtagccgtacgttacgggaaaccaggtctaggtaggtaaccggtttgggttaggtttaaattaaaggtagttcgtccgtaccgtacggtaaccaaacctaaccgacccgaaggaccctaaaaaccgaccccctaaaacttacagttacggtaattttacggaggtaacggtacctaaaggtaaccgttccccggaccgtttagggtaacgggttttaccttaacggttccgtacttttcccgtgtttaacgcccgtaaccgtaaacgggttccncggtaaacccgaaaccgtcccgggtaccttaccgttaaccggaaccttccgtaccgtcggtttcggacccttacggacgngtacggtaggacgtacgttacgtagtaacgtttacttaagtcgtagacgtatacgtatacgtacgccgtacgtgagaacgtnaccgtntaaggtttggtacggttacgggacggggtactaggccgtacgtgtaccgtnaccgaccgtagtcccg

SEQ ID NO: 196677 - DNA, 650 bp, Homo sapiens
  misc_feature: GYAE6OF02IG5PU.14.36.D03.1.454.CMB.1.raw
  modified_base (461)..(461): a, c, t, g, unknown or other
  misc_feature (461)..(461): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctccgtggacagtcgatcaccactctcctgacactggaaccagcagtgacgttggtggttaataagtatgtctcctcggtaaccaacaaccaccacggacaaaccgaaccccccaaacgtctatagtactttagtggtagtactaaggtaactcccggacccttacggtacgggtttactaacgttcgtccttttactccggtcgtaccctacgtaacgttcgcgtaacctacggaacccggtccctacccctcgtacctattccttcggnggtacctcgacgcgtaggaccggtacgagttcgttagtaatttagtttatggactcgtccttaacgtatagtacgccgtactacggacagtaactatcgttagttcggttggggttaccggggacggggtaacccgtaggtaccggtaccgtacgggtacggtacccgacggtacccgaggtaccccgg

SEQ ID NO: 196678 - DNA, 551 bp, Homo sapiens
  misc_feature: GYAE6OF02GU65B.14.36.D03.1.454.CMB.1.raw
  modified_base (229)..(229): a, c, t, g, unknown or other
  misc_feature (229)..(229): n is a, c, g, or t
  modified_base (305)..(305): a, c, t, g, unknown or other
  misc_feature (305)..(305): n is a, c, g, or t
  modified_base (378)..(378): a, c, t, g, unknown or other
  misc_feature (378)..(378): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgacgttggtggttataagtatgtctctggtaccaacaacaccaggacaaacgcccccaaatcatgatttangaggtcagtaatcggcctgtagggttcaagtcgcttctctggctcagtctggacaacgcggcctccctgaccntctcgtggcctcgagctgacggcgagttctgtattattgttgacagtctacatatcgctaccgtgacagactaatcctagttcggttacgggtttcggggaccgggggtaaccgtaagggtaccggtacccggttaccgtacgggtaccgaccggtacccgtaaggtccccgg

SEQ ID NO: 196679 - DNA, 518 bp, Homo sapiens
  misc_feature: GYAE6OF02GJJFN.14.36.D03.1.454.CMB.1.raw
  modified_base (393)..(393): a, c, t, g, unknown or other
  misc_feature (393)..(393): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcaccatctcctgcactggaaccagcagtgacgttggtggttatagtatgtctcctggtaccaacaacacccaggcaaagcccccaaactcatgatttatgaggtcagtaatcggccctcaggggtttctaatcgctttctctggctcaagtctggcaacacggcctccctgacatctctggctcagcngagacgagtctgtattattattgctagctacattagtcgcacctggcagtacaatcagttggttgggttttccggcggggggtaccaagggtcgtaccggtccgtaggtcacgtaccgaggtccg

SEQ ID NO: 196680 - DNA, 626 bp, Homo sapiens
  misc_feature: GYAE6OF02IA296.14.36.D03.1.454.CMB.1.raw
  modified_base (230)..(230): a, c, t, g, unknown or other
  misc_feature (230)..(230): n is a, c, g, or t
  modified_base (236)..(236): a, c, t, g, unknown or other
  misc_feature (236)..(236): n is a, c, g, or t
  modified_base (253)..(253): a, c, t, g, unknown or other
  misc_feature (253)..(253): n is a, c, g, or t
  modified_base (302)..(302): a, c, t, g, unknown or other
  misc_feature (302)..(302): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatcctcctgcactggaaccngcagtnacgttggtgtataagtntgtctcctgtaccaacacaccagacaaccgccccaaatcatgtatttangagtcagtactcggcctgtaggttctaatcgtcttctcgtggctacgagtcgtagactaaccgtacggtccctcccgtacgacctacttccgtacgtcgggaccttccgaggctaggacggacgacgttctagtactttattacgttagctatccgtatataacgtcgacctaccgtgtacgaacgtacaacgttacgtacggtttagggttttcggggttttaacccggggggacggggggtaaaccccgtaaaggggttcccgtaacccggggttccgttaacggggtaccccgtaacggtaacccccgggtagtccccggg

SEQ ID NO: 196681 - DNA, 248 bp, Homo sapiens
  misc_feature: GYAE6OF02GVF74.14.36.D03.1.454.CMB.1.raw
  modified_base (238)..(248): a, c, t, g, unknown or other
  misc_feature (238)..(248): n is a, c, g, or t
tcagcgtctagtaccacgaccggtgctcgatttagctgcgtcacgatctctcttgggcttttgatatctggggccaagggacagtggtcaccgtctcttcagcctccaccaagggcccatcggtcttccccctggcaccctcctccaagagcacctcgtgggggcacagcggccctgggctgcctggtcaaggactacttccgtactagacgctgagcgggctggcaaggcgcatagnnnnnnnnnnn

SEQ ID NO: 196682 - DNA, 643 bp, Homo sapiens
  misc_feature: GYAE6OF02G30J5.14.36.D03.1.454.CMB.1.raw
  modified_base (219)..(219): a, c, t, g, unknown or other
  misc_feature (219)..(219): n is a, c, g, or t
  modified_base (230)..(230): a, c, t, g, unknown or other
  misc_feature (230)..(230): n is a, c, g, or t
  modified_base (261)..(261): a, c, t, g, unknown or other
  misc_feature (261)..(261): n is a, c, g, or t
  modified_base (300)..(300): a, c, t, g, unknown or other
  misc_feature (300)..(300): n is a, c, g, or t
  modified_base (314)..(314): a, c, t, g, unknown or other
  misc_feature (314)..(314): n is a, c, g, or t
  modified_base (418)..(418): a, c, t, g, unknown or other
  misc_feature (418)..(418): n is a, c, g, or t
tcagcgtctagtaccacgaccggtgctcgatttagctgcgtcacgatctctcgttggggggggtctcaggaggcagcgctctcaggacatctccaccatggcctgggctctgctgctcctcaccctcctcactcaggcacagggtcctcgggcccagtctcgccctagactcagcctgccctcgtgtctgggtctctggacagtcgatcgaccatctcngcactggaacngtcaggtgacgttggtggttataagtatgtntcgtagtacaacgaaccaccgagacaacgaccccaaacnctatagtaacttanacgagtcaagttaacgccgtaccgtagtacgggtttactaagtcctcgttctcgtacggcttaaccgaacgtcgtagacaaaccgaccggtccctacccggtanaaccctacgtcctcggtcggtacctacccggtagccgtagggaacggtacgtacgtacgttagttaatttaattacgttgaccagtaccattaagttacgcgtacccgtctacgggactaaccggataaactcgaaggtttcggtttacgggtcgggggtaacgggtaaccgtaagggttccctaacgggttcccgtaaggaccgtacgacccgtaacggtccgg

SEQ ID NO: 196683 - DNA, 759 bp, Homo sapiens
  misc_feature: GYAE6OF02H6EH3.14.36.D03.1.454.CMB.1.raw
  modified_base (314)..(314): a, c, t, g, unknown or other
  misc_feature (314)..(314): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtaggttataagtatgtctcctagtaccaacaccaccgaggacaaaccgacccccaaactcactagtatttanggtagtacgaagtaactccggcccttacggacgggttttacctaacgtccgtctttctcgtcgacttacgtaagtccgtagacctaacgaccggtcccttaccgtcgaaccctactttcccgtacggttcgggacccttacggacggtaccgttacgggacggtaacggtacgttaccggttagttaacgtttaactttagttacgtaaccgtaggttaccctacgttaagttaccgttaccggtacccgtaaacccgttcgggaaccgaaacgttaacctaaccgtttacggtaacggtttttcggggtttaccggggggtttttacccgggggaaccggggggtaaaccccggtttaaacgggtaccccggttacccgggtttacccggtaacgggtttacccggtaacccgggtacccccggttaacgggttcccccccggg

SEQ ID NO: 196684 - DNA, 623 bp, Homo sapiens
  misc_feature: GYAE6OF02IU2H0.14.36.D03.1.454.CMB.1.raw
  modified_base (311)..(311): a, c, t, g, unknown or other
  misc_feature (311)..(311): n is a, c, g, or t
tcagcgtctagtaccacgaccggtgctcgatttagctgcgtcacgatctctcttgggggggggtctcaggaggcagcgctctcaggacatctccaccatggcctgggctctgctgctcctccaccctcctcactcagggcacagggtcctgggcccagtctgccctgactcagcctgcctccgtgtctgggtctcctggacagtcgatcaccatctcctgcactggaaccagcagtgtacggttggtaggttataagtatgtctctgtaccaacaacaccagacaaacgaccccaaatcatagtatttagngagtacaagtactccggcctgtacgggttactaactcgtcttctctcggctacgaagtcgtggaccaaccgaccggtccctcccgtacgacctactctcgtacgggtcctaccgaggcgtaggacggtacgtacggttcgttaggttaattttacgtttagttcgacgtacgtctacgtaatacgtcggtaccgtacgtcggacacgactaatcgtaggttcgggtttcggggttaccggggacgggggtaacctaacgggttcgacccggtttacggtacggtaccgaccggtacccggacgttaccccgg

SEQ ID NO: 196685 - DNA, 733 bp, Homo sapiens
  misc_feature: GYAE6OF02HGTIE.14.36.D03.1.454.CMB.1.raw
  modified_base (215)..(215): a, c, t, g, unknown or other
  misc_feature (215)..(215): n is a, c, g, or t
  modified_base (234)..(234): a, c, t, g, unknown or other
  misc_feature (234)..(234): n is a, c, g, or t
tcagcgtctagtaccacgaccggtgctcgatttagctgcgtcacgatctctcttgggggggggtctcaggaggcagcgctctcaggacatctccaccatggcctgggctctgctgctcctcaccctcctcactcagggcacgagggtcctgggcccagtctcgccctgactcagcctgcctcgtgtcgtgggtcctcgtggacagtcgatcaccntctcctgcacgtagaaccngcagtgacgttggtagttaatagtatcgtctcgtacgaaccaacaacaccgaagaccaaaccgaccccaaactcaagtgtaatttagtgtaggtactagttactccggccctcgtagggtttcagtacgtcgtcctttcgtcgtcgtcgtacgtacgttcgtacggaccgtaaaccgccggtccctacccgtacgtaaccctacgtttccgtaccggttccggggtaccttacccgggagggtacccgttagggaaaccgggccggttaacggtttaccgtaagttaacgttttaagttaacggtttaccggaccgttacgttaccgtaacgtaagttttaacgaccggtacccgtaaccgttgggaaccaagtaccgtaactcggttaacggtttcggggtttaccgggggttaccggggaaccgggggtaacgtacgggttacccgggttacccgtaccgggttaacgggtaccccgtacgggtaacccggtaccgg

SEQ ID NO: 196686 - DNA, 613 bp, Homo sapiens
  misc_feature: GYAE6OF02I2PTH.14.36.D03.1.454.CMB.1.raw
  modified_base (232)..(232): a, c, t, g, unknown or other
  misc_feature (232)..(232): n is a, c, g, or t
  modified_base (256)..(256): a, c, t, g, unknown or other
  misc_feature (256)..(256): n is a, c, g, or t
  modified_base (296)..(296): a, c, t, g, unknown or other
  misc_feature (296)..(296): n is a, c, g, or t
  modified_base (303)..(303): a, c, t, g, unknown or other
  misc_feature (303)..(303): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctccgtggacagtcgatcaccatcctcctgcacgtggaaccngcagtgtacgttggtgttatagtntgtctctgtaccaacaacaccagacaacgccccaatcatntatttangtagtcaagtactccgccgtacgtagggtttactaagtcgtcttctctcgcctacgtagtcgtgaccaaccgaccgccctcccgtacgacctactcctcgtcgggcctccggagtcgtaggacggtacgtagttactagttatttacttagtcgacgtacgtactacgtatacgtcgtacctacgtcgacgaacgtacgtaactcgtaggtttcgggtttcggggttccggggaaccgggggtaaccgtaacgggttaccgtacccggttaccggtacggtacccgaacggtacccggtaacggtccccg

SEQ ID NO: 196687 - DNA, 892 bp, Homo sapiens
  misc_feature: GYAE6OF02FHBC3.14.36.D03.1.454.CMB.1.raw
tcagcgtctagtaccacgaccggtgctcgatttagctgcgtcacgatctctcttgggggggggtctcaggaggcagcgctctcaggacatctccaccatggcctgggctctgctgctcctcaccctcctcactcagggcacagggtcctgggcccagtctgccctgactcagcctgcctccgtgtctgggtctctggacagtcgatccaccatcctcctgcactggaaccagcagtgacgttggtggttataagtatgtctcctggtaccaacaacacccgagaccaaacgacccccaaactcaactgtaatttagtaggacggtcgaaggttaacgtccggtcccttacggtacggggttttactaacgttcgtcctttactcgtcgggtcctaccgtaaacggtcctacgggaccaaaccggtacccggtaccccttacccgtacgtaacccctaactcccgttaccggttaccggggtacccttacccggaacggggttcccggttaaccgggaacggggtaaccggtaagggtttaccttaagggtttaaccgtttttaaagtttaacgttttacggtaaccggttaaccggttcccgttaacgtaaattttaacgttacccgggtaaccctttaacccgggttagggaacccgttaaacgggtaacccttaaacggtttacccgttaaaggttttaccgggggggttttttaaccggggggttttttaccccgggggggggggaacccgggggggggttaaaaccccgggtttaaaccgggggttaaccccgggggtttaacccccggttttaacccggggttaaaccggggttaaccggtaacccccgggggtttaacccccggaaacccggggttaccccccggg

SEQ ID NO: 196688 - DNA, 777 bp, Homo sapiens
  misc_feature: GYAE6OF02JNGXC.14.36.D03.1.454.CMB.1.raw
  modified_base (212)..(212): a, c, t, g, unknown or other
  misc_feature (212)..(212): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcgagggcacagggtcctgggcccagtctgccctgactcagcctgcctcgtgtcgtggtcctctggacagtcgatcacctntcctcctgacacgtcggaacccagccaggtgtacggttggttaggtttaactaagtacttggtaccttccgtaggtaacccaaacaaccacccgtaggaccaaaaccgaccccccaattaccgtaatcgttaactttagtcggtacgtacgtaaagttacgtcccggtccgttacggtaacggggttttacttaacgtccggttccttttacgtccgttcggtaccctaaccggtagtttaccggtacgggtaaccctaaaccgtccccgggtcccctttaacccgtaccgtaacccgttacgttcccgtttccgggttccgggtccccgttaccggaggttcccggttacggggaaccgggttacgtaccggtttactgttaagttttaacttgtttacggactacggttccttaacttacgttagtaccggtaccttaccggtcggaacgactacgttatacgttggtggttttccgggggtttacgggaccgggggtaaccgtacggttacccggtaccgttacgggttacggtaccctaccgggtaccggacggttcccgg

SEQ ID NO: 196689 - DNA, 621 bp, Homo sapiens
  misc_feature: GYAE6OF02F6J6Y.14.36.D03.1.454.CMB.1.raw
  modified_base (231)..(231): a, c, t, g, unknown or other
  misc_feature (231)..(231): n is a, c, g, or t
  modified_base (309)..(309): a, c, t, g, unknown or other
  misc_feature (309)..(309): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacgagggtcctgggcccagtctgccctgactcagcctgcctccgtgtctgggtcctcctggacagtcgatcaccatctcctgcactggaaccngcagtgacggttggtgtatagtatgtctctggtaccaacaaccaccagacaaacgcccccaaactcatgtatttatgnggtacaagtaacgtccggccctcgtacggggtttactaatccgtcttctcgtggtcctcgaagtctggacaacgaccggccctccctcgacctatcctcgtgggccctcgacgtctgaggacgtagttctgtaatttattacttcgtacaacgtctacattagttcgaccgtacgtcggaccgacgtactaacttcgtaaggttcggtttcggggttttaccgggggaccgggggggtaacccgtaagggttcccggtaacccggtttccggttaacgggtcccgaccgggacccccggtaaggtcccccgg

SEQ ID NO: 196690 - DNA, 841 bp, Homo sapiens
  misc_feature: GYAE6OF02F5T3U.14.36.D03.1.454.CMB.1.raw
tcagcgtctagtaccacgaccggtgctcgatttagctgcgtcacgatctctcgttggggggggtctcaggaggcagcgctctcaggacatctccaccatggcctgggctctgctgctcctcaccctcctcactcgagggcacgagggtcctcgggcccagtctcgccctgactcacgcctcgcctccgtgtctgggtctcgtaggacagtcgatccacctatcctcctgcacgtacggaacctgcgtaggtgtacggtttggttaggttaataagtacgtcgtctccgtacgtaaccaaccgtaaccacccgaaggaccaaacccgacccccaaacgtctaacgttagttaacgtttaagtcgggtaaggtacgtaaacgttaaccgtcccggtacccgttacgggttacgggttttaaccttaacgtccgttccttttaccgtcgttccgggttacccttaaccgtaacggttacgtacggtaccctaaacccgccccgggttaccccttacccgtaccggtacccttaaccgtccgtcggtccgggtacccctaccggacggggtacgtacgggaaccggtacggttaccggttaacgttacgtttaaacgttttaacgtttagtacgtccgttaagtccgttaacttacggtttacctaccggttacccgaaccgttacggaccgtaaccgacttaacgttacggttacggttttacggggttcccgggggtttaccggggtaaacccggggggtaaccgttaacggggttacccggttaacccggtacggttaaccggggtacccgaacccggttaacccgggtacgttacccccgg

SEQ ID NO: 196691 - DNA, 695 bp, Homo sapiens
  misc_feature: GYAE6OF02JE28M.14.36.D03.1.454.CMB.1.raw
  modified_base (233)..(233): a, c, t, g, unknown or other
  misc_feature (233)..(233): n is a, c, g, or t
tcagcgtctagtaccacgaccggtgctcgatttagctgcgtcacgatctctcttggggggggtctcaggaggcagcgctctcaggacatctccacatggcctgggctctgctgctcctcaccctcctcactcagggcacagggtcctgggcccagtctgccctgactcagcctgcctcgtgtctgggtcctccgtggacaggttcgatcaccatcctcctgacactggaaccngcagtcgacgttggtgttaactaagtatgtctccgtaggtaaccaacaaccaccacggtacaaacggaccccctaaacgtcactgtaatttagtggacgtactaaggttaactccggtccctaggttacgggtttacctaacgttcggtcctttacgttcgtcggtccttaccgtaaggttccgtacggacctaacccgaccggtcccttacccgtacgtaacctactcgttacggtcgggtcctccggacgtcgtaggtacggaacgtcgtacgtagttattaatttagtcgaacctggtcctagtacgtacgtaccgccgtaccgtacgacgtaacgactaaccgttcgtaggttccggttttaccggggttaccggggtaaaccggggaccgttaaggggtcccgtaacccgtttacgggtaaccgttaccggaccggacccggtaacggttcccccgg

SEQ ID NO: 196692 - DNA, 674 bp, Homo sapiens
  misc_feature: GYAE6OF02ISM27.14.36.D03.1.454.CMB.1.raw
  modified_base (225)..(225): a, c, t, g, unknown or other
  misc_feature (225)..(225): n is a, c, g, or t
  modified_base (239)..(239): a, c, t, g, unknown or other
  misc_feature (239)..(239): n is a, c, g, or t
  modified_base (420)..(420): a, c, t, g, unknown or other
  misc_feature (420)..(420): n is a, c, g, or t
tcagcgtctagtaccacgaccggtgctcgatttagctgcgtcacgatctctcgttgggggggggtctcaggaggcagcgctctcaggacatctccaccatggcctgggctctgctgctcctcaccctcctcactcagggcacagggtcctgggcccagtctcgccctgactcagcctcgcctcgtgtcgtcggtctccgtgacagtcgataccacctatcctccngcactacggaaccngacgaggtgtacgttggtagttaagtagtatgtctcctaggtaaccaacaaccaccaggaccaaaccgaccccaaactcatagtattatcgagtacagttaacgtccgtcgtagtacggttactacgtccgtctttctcgtcgtctacgtaagtcgtacgacgaacgtaccgtcccttccncgacctcgtcctacggtcggtcctacgcgcgtaggacggtacgtgtcgttagacttttagtacgtcgaacgtcgtacctacgttaagtaccgtaccgtaccgtaaccggttaggaacctaacggtaccttaacgtcgttaacgggtttcggggttttaccgggggttacccgggggaccggggtaacgtacgggttaacccggtacccggtttaccggaccggttaccggaacgtaccccggtagtcccccggg

SEQ ID NO: 196693 - DNA, 673 bp, Homo sapiens
  misc_feature: GYAE6OF02H5TM1.14.36.D03.1.454.CMB.1.raw
  modified_base (521)..(521): a, c, t, g, unknown or other
  misc_feature (521)..(521): n is a, c, g, or t
tcagcgtctagtaccacgaccggtgctcgatttagctgcgtcacgatctctcttgggggggggtctcaggaggcagcgctctcaggacatctccaccatggcctgggctctgctgctcctccaccctcctcactcagggcacagggtcctgggcccagtctgccctgactcagcctcgcctccgtcgtcgtcgggtctccgtggacgagtcgactcaccactccgtcctgcctacgtacggaaccaggacaggtcgtacggttgggtagttaataagtatcgttctccgtagtaacccaaaccaccacccgagaaccaaacccgaccccctaaactcagtgtaatttacgaggtaggtactagtaacgtccggtacccgtacggttacgggttactaacgttccgtacctttctaccgtcggtacctacgtaacgttcgtacggaccaaccgtccgtcccctaccgtacgacctcttcgtcggtcggccgtaccgagggtctacgggtaggacgtacgttntacgttactttagttacgtgaccgagtcctataactcgtacgacctcgtacggctaacgactacttagttcggttgggttcggggtttcgggggaccgggtacgtacggtccgttaccggtcggtaccgtacgacgggaccgtacgtccccg

SEQ ID NO: 196694 - DNA, 663 bp, Homo sapiens
  misc_feature: GYAE6OF02IMJNN.14.36.D03.1.454.CMB.1.raw
  modified_base (242)..(242): a, c, t, g, unknown or other
  misc_feature (242)..(242): n is a, c, g, or t
tcagcgtctagtaccacgaccggtgctcgatttagctgcgtcacgatctctcttgggggggggtctcaggaggcagcgctctcaggacatctccaccatggcctgggctctgctgctcctcaccctcctcactcagggcacgacggggtcctcggggcccagtcctgcccctgactcagcctgccctcgtgtcgtgggtcctcctggacagtcgatcaccattcctcctgcacgtggaaccngcagtgacgtggtgtatagtatgtctctagtacaacaccaccgacggaccaaaccgaccccaactcgatagtatttacgtggacgtacaggtaactccggtccctaggttacgggttactaacgtcgtcttccgtactcggtacctacgtaagttccgtagaacctaaccgaacccggtcccttaccgtcgtaacctacgtccgttccgtcggcctaccgaggtcggtacggaacgtacgtacggttctacgtagtttaacttagtcgacgtacgtcttactaatccgtacgccttaaccggcgtacacgggtacctaagtctaaggtttcggggttcgggttaccggggaccgggggtaaccgtacgggtaccggtaccgttaccggttacggtcccggtacggacccggaggttccccg

SEQ ID NO: 196695 - DNA, 597 bp, Homo sapiens
  misc_feature: GYAE6OF02HQVQD.14.36.D03.1.454.CMB.1.raw
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcacccatcctcctgcactggaaccagcagtgacgttggtggtataagtatgtctctggtaccaacaacaccaggacaaacgcccccaaatcatagtactttatgaggttcaagtatccggccctgtacgggtttctaatcgcttctctcggtactcaagtctagacaaccgcggtccctcccgagacctactacgtctcgggaccttcgaaggtctggacggacgagtcgtcgtatttacttattcgtctagtactacctatactacgtcctaaccgtggtaccagacattcctaagttcgggttgggttttaccgggacggggggtaaccgtaagggttaccggtaccggttacccgtacgggtacctacggtacccggtacggtccccgg

SEQ ID NO: 196696 - DNA, 570 bp, Homo sapiens
  misc_feature: GYAE6OF02F3H7L.14.36.D03.1.454.CMB.1.raw
  modified_base (281)..(281): a, c, t, g, unknown or other
  misc_feature (281)..(281): n is a, c, g, or t
  modified_base (293)..(293): a, c, t, g, unknown or other
  misc_feature (293)..(293): n is a, c, g, or t
  modified_base (299)..(299): a, c, t, g, unknown or other
  misc_feature (299)..(299): n is a, c, g, or t
  modified_base (400)..(400): a, c, t, g, unknown or other
  misc_feature (400)..(400): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctctggacagtcgatcaccatctcctgcactggaaccagcagtgacgttggtgttataagtatgtctctgtaccaacaacaccagacaacncccccaatcatnatttangagtcagtactccgcctgtacgggttctaacgtcgtcttctcgtggcctactagtcgtagacaacgccgccctcctcgacctactctcgtcgggtctccgngtcgtcgaggacgtgtctagtatttattgtgactacgtctactagtactcgtacctacgtcgactacgactaatctacgttgggttacggggtttccggggaccgggggtaaccgtacgggtacggtacccggttacgtacggtcgaaccgtacccggtacggtccccgg

SEQ ID NO: 196697 - DNA, 248 bp, Homo sapiens
  misc_feature: GYAE6OF02GPG1G.14.36.D03.1.454.CMB.1.raw
  modified_base (236)..(248): a, c, t, g, unknown or other
  misc_feature (236)..(248): n is a, c, g, or t
tcagcgtctagtaccacgaccggtgctcgatttagctgcgtcacgatctctctggggcttttgatatctggggccaagggacagtggtcaccgtctcttcagcctccaccaaggcccatcggtcttccccctggcaccctcctccaagagcacctctgggggcacagcggccctgggctgcctggtcaaggactacttccgtactagacgctgagcgggctggcaaggcgcatagnnnnnnnnnnnnn

SEQ ID NO: 196698 - DNA, 544 bp, Homo sapiens
  misc_feature: GYAE6OF02HNGCM.14.36.D03.1.454.CMB.1.raw
  modified_base (302)..(302): a, c, t, g, unknown or other
  misc_feature (302)..(302): n is a, c, g, or t
  modified_base (369)..(369): a, c, t, g, unknown or other
  misc_feature (369)..(369): n is a, c, g, or t
  modified_base (418)..(418): a, c, t, g, unknown or other
  misc_feature (418)..(418): n is a, c, g, or t
  modified_base (422)..(422): a, c, t, g, unknown or other
  misc_feature (422)..(422): n is a, c, g, or t
  modified_base (426)..(426): a, c, t, g, unknown or other
  misc_feature (426)..(426): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcaccatcctcctgccactggaaccagcagtgacgttggtggttataagtatgtctctgtaccaacacacccagcaaacgccccaaatcatgatttangagtcagtaatcgcctgagggtttcaatcgcttctctggctccaagtctgacaacacggccctcctnacctatctcgtggcctccgagctaggaggacgagtctgtatttattatnctanctanatatcgctaccgtggcaacgactacgtacgtagttgggttcgggttttccggggacgggggtaaccgtaagggtcgtacccggttacggtaacggtaccgacgtacccgaagtaccgg

SEQ ID NO: 196699 - DNA, 649 bp, Homo sapiens
  misc_feature: GYAE6OF02JQZWL.14.36.D03.1.454.CMB.1.raw
  modified_base (189)..(189): a, c, t, g, unknown or other
  misc_feature (189)..(189): n is a, c, g, or t
  modified_base (207)..(207): a, c, t, g, unknown or other
  misc_feature (207)..(207): n is a, c, g, or t
  modified_base (211)..(211): a, c, t, g, unknown or other
  misc_feature (211)..(211): n is a, c, g, or t
  modified_base (220)..(220): a, c, t, g, unknown or other
  misc_feature (220)..(220): n is a, c, g, or t
  modified_base (243)..(243): a, c, t, g, unknown or other
  misc_feature (243)..(243): n is a, c, g, or t
  modified_base (285)..(285): a, c, t, g, unknown or other
  misc_feature (285)..(285): n is a, c, g, or t
  modified_base (555)..(555): a, c, t, g, unknown or other
  misc_feature (555)..(555): n is a, c, g, or t
tcagcgtctagtaccacgaccggtgctcgatttagctgcgtcacgatctctcttggggggggtctcaggaggcagcgctctcaggacatctccaccatggcctgggctctgctgcctcctcaccctcctcactcagggcacgagggtcctcgggcccacgtctgcccctagactcagcctgccttccgntcgtcggtcctcgtgacncgtnactccaccntcctccgtgtcacgtacgaaccngacgtagtcgttacgggtttgggtaacgttaagtaaacgttnttcgtacccgttccgtaacggtaaaccccaaataaccccgaccggtagaaaaccgaacccccctaccccaaaacttagtacggtaatttttaattacgtaggtacgtacgtaacgtacgtaccggtacctacggttacggttacttacgtcgttcgttctcgtacgtcctacgtacgtacgtcgaccaccgaccgccctcgtcactctctcgtcgtctacgacgtcgtagacgtagtcgtacgtagtattatagtctacactctacactntctactacgtagtacgtacgttaggttacgggtacggtacggtacgtacgtacgtcgtacgtacgtacgtacgacgaccgacgtacgtcgtccg

SEQ ID NO: 196700 - DNA, 755 bp, Homo sapiens
  misc_feature: GYAE6OF02HN1VM.14.36.D03.1.454.CMB.1.raw
  modified_base (239)..(239): a, c, t, g, unknown or other
  misc_feature (239)..(239): n is a, c, g, or t
  modified_base (344)..(344): a, c, t, g, unknown or other
  misc_feature (344)..(344): n is a, c, g, or t
tcagcgtctagtaccacgaccggtgctcgatttagctgcgtcacgatctctcgttggggggggtctcaggaggcagcgctctcaggacatctccaccatggcctgggctctgctgctcctcaccctcctcactcgagggcacgagggtccgtcgggcccagtctgccctgactcagcctgcctcgtgttcgtgggtctccgtggacagtcgatcgaccatctctgcacgtacggaaccngcaggtgtacggtttgggttaggttaataagtattggtcctacgtacgtaaccaaccaaccaaccgaagaccaaaaccgaccccaactctaactagttatttagnggtacgtacgtacgtaagtcccggtacctaggttacgggtttactaacgttccgttcttcgttacgttcggtacccttacgaaacggttcgtacgtaccgaaccgtaacccggttcctcccgttaaccgacttaccggttccttacgggtccggtacctaccggacggttacggtacggaacgggtaacgttacggttcgttaaacggttattttaacgttgttacgggctaacgtccgtaacttagtaacgtccgaccttaccggcgtacgtaccgtagtaaccttcgtaaacggttttcggggtttccggggttaacccgggggtaagggggttaacccgtaaccggggttccggttaacccggttaccggtacggcccggtaacccggaccggttaccggtcccccgg

SEQ ID NO: 196701 - DNA, 697 bp, Homo sapiens
  misc_feature: GYAE6OF02JIK3X.14.36.D03.1.454.CMB.1.raw
  modified_base (218)..(218): a, c, t, g, unknown or other
  misc_feature (218)..(218): n is a, c, g, or t
  modified_base (301)..(301): a, c, t, g, unknown or other
  misc_feature (301)..(301): n is a, c, g, or t
  modified_base (312)..(312): a, c, t, g, unknown or other
  misc_feature (312)..(312): n is a, c, g, or t
tcagcgtctagtaccacgaccggtgctcgatttagctgcgtcacgatctctcttgggggggggtctcaggaggcagcgctctcaggacatcctccaccatggcctgggctctgctgctcctcaccctcctcactcagggcacagggtcctgggcccaggtctgccctgactcagcctgcctccgtgtcgtggtctccgtaggacagtcgatccaaccntcctcgtgcacgtcggaaccagcagtgtacggtgttgtataagtatgtctcgtgtaacacaacaccgagacaacgaccccaancatgtattagngtaggtacaagtacgtccggtacctcggttagggtttacctaacgtccgtacttcctcgtagctaccaggtcgtacggacaaccggtccgtaccccttccgacgtaacctcgttaccgtcgtccgggtctcccgtaagggtcctagggacggtaaacggtgtcttacgttaacttcgttagttcgaccgtaaggtcctaaccgttagttcgtaccgtaccgtaccgttcgacgtacggaacctttacttaccgtaggtttaccgggggtttaacggggttttaccgggggacccggggggtaacgttaaccgggtacccgggttaacccggttacccgggttaacggacccggtaacccggtacccggaaacgggtttcccccgg

SEQ ID NO: 196702 - DNA, 730 bp, Homo sapiens
  misc_feature: GYAE6OF02IAB7H.14.36.D03.1.454.CMB.1.raw
  modified_base (211)..(211): a, c, t, g, unknown or other
  misc_feature (211)..(211): n is a, c, g, or t
  modified_base (235)..(235): a, c, t, g, unknown or other
  misc_feature (235)..(235): n is a, c, g, or t
  modified_base (410)..(410): a, c, t, g, unknown or other
  misc_feature (410)..(410): n is a, c, g, or t
  modified_base (627)..(627): a, c, t, g, unknown or other
  misc_feature (627)..(627): n is a, c, g, or t
tcagcgtctagtaccacgaccggtgctcgatttagctgcgtcacgatctctcgttggggggggtctcaggaggcagcgctctcaggacatctccaccatggcctgggctctgctgctcctccaccctctcacctcacgggcacgagggtccctgggcccagtctgccctgacctcagcctgccctcgtgtcgttcgggtctccgtaggacncggtcactcacctattcctccgtnaaccgagtaccgggaaacccagctaaggtcggttaacgggttgggtttacggttaagtaacggttatcggtttcctaccgtacgggttaaacccaaacaaccgaaccgacgggaaccaaaaccggaacccccctaaacgcctaacgtacgttaagttttacgtaggtaaccggtntaaacggtaacgttaccgggtccccttacgggttacgggttttaacaacgtcgttccgttctacgtcgggtacctacgtaacgtcctaaggtaccaaccgtcccggtaccgtaccctcgtaacctctccggtcgttcgggacctcgaacgtcgtgggaacaccggttgtaccgtagttaattatttagtacggcctagtaccgtataactcggtacnccgtagcggtcagtacaccgtatgttacggttcgggtacgggtaccggggtaacggtccgggtacgtaccggttacgaggtaccgtcgtacggtacgtcccgg

SEQ ID NO: 196703 - DNA, 723 bp, Homo sapiens
  misc_feature: GYAE6OF02G99RL.14.36.D03.1.454.CMB.1.raw
  modified_base (365)..(365): a, c, t, g, unknown or other
  misc_feature (365)..(365): n is a, c, g, or t
tcagcgtctagtaccacgaccggtgctcgatttagctgcgtcacgatctctcttgggggggggtctcaggaggcagcgctctcaggacatctccaccatggcctgggctctgctgctcctcaccctcctcactcagggcacagggtcctgggcccagtctgccctgactcagcctgcctccgtgtctgggtcctcctggacagtcgatcaccatcctcctgcactcggaaccagcagtgtacggttggtaggttaataagtatgtcctcgtgtaaccaacaacaccgaggacaacgaccccaactcatatattagtgtagtacaagtacgccggtccctggtacgggttactaactcgtctttcncgtcggtacctacgtaagtcgtacggaccaaccgtacccggtcccctacccgtacgaccctacgttcccgtcggtaccgggtccctaccggtacggtaccggtacgggtaaacgggtaccggtacggttccgtaaggtttaaccttttaagtttaagttcggaccttacggtcttaaccgtaatttacgacgtacctaccgttcggaacctaacggtacctaagttacgtagggttttcggggtttacggggtttacccggggggaacccgggggtaacggtaaccggggttaccggtacccgggttacccggttacgggtaacccgtacccgggtacccggttaacccggtccccgg

SEQ ID NO: 196704 - DNA, 646 bp, Homo sapiens
  misc_feature: GYAE6OF02FPFLX.14.36.D03.1.454.CMB.1.raw
  modified_base (216)..(216): a, c, t, g, unknown or other
  misc_feature (216)..(216): n is a, c, g, or t
  modified_base (414)..(414): a, c, t, g, unknown or other
  misc_feature (414)..(414): n is a, c, g, or t
tcagcgtctagtaccacgaccggtgctcgatttagctgcgtcacgatctctcttgggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcacatctccngcactcggaaccagcagtgacggttggttgttataagtatcgtctccgtcggtaaccaacaacaccgagacaaacgccccaaactcatgtatttatggagtacagtaactccggtcctacggtagggtttactactccgtacttcgtctcggactaccgtaagttcgtcgaccaacgtcccggccctccgtcgacctntcctcggtcggtcctaccgagtcgtacggacgggtactagttccgtagttactttaagttcgttcggactacgttactacgtactagtacgaccgtaccgtcgggaactacgtaactaattcgttacggttggggttttaccgggggtttcgggggaacccgggggttaacgtaacgggttccggtaccggttcggtaaccggtacggacccgtaccggtaccggtccccgg

SEQ ID NO: 196705 - DNA, 609 bp, Homo sapiens
  misc_feature: GYAE6OF02HWUZ2.14.36.D03.1.454.CMB.1.raw
  modified_base (417)..(417): a, c, t, g, unknown or other
  misc_feature (417)..(417): n is a, c, g, or t
tcagcgtctagtaccacgaccggtgctcgatttagctgcgtcacgatctctcttgggggggggtctcaggaggcagcgctctcaggacatctccaccatggcctgggctctgctgctcctcaccctcctcactcagggcacagggtcctgggcccagtctgccctgactcagcctgcctccgtgtctgggtcctccgtggacagtcgatcacatcctcctgcacgtggaaccagcagtcgtacgttggttagttataagtatcgtctccgtagtacccaacaaccacccgacggaccaaaccgacccccaaactcatgtatttatggagtctagtaacgtccggcctcgtacgggttctaacgtcgtcttctcgtcgctacagtctagacacgccgcctcctacgactactcgtcgnggcctcgagtcgtaggacggactagtcgtagtagttacgttactgacagtccttatagttactcgacctaccgtacgacacgtactaagtctaggttcggttcggggtttaccgggggacgggggtaacgtaaccgggtccggtacccggtaccggttacggacccggtaaccggacccgtaaccggtcccg

SEQ ID NO: 196706 - DNA, 836 bp, Homo sapiens
  misc_feature: GYAE6OF02HSQ0Z.14.36.D03.1.454.CMB.1.raw
tcagcgtctagtaccacgaccggtgctcgatttagctgcgtcacgatctctcgttggggggggtctcaggaggcagcgcctcgtcaggacatctccaccatggcctgggctctgctgctcctcaccctctcactcgaggcacgagggtcctgggcccagtctcgtccctgacctcgacgcctcgccgttccgtggttcgtgggttccttccgtagggactaggtccgtaattccaacctacgttccctccgtacgacctaaccgtaccgaaccacggacgtaacggttcggtacggtttagggttacggtttaagtttaaacggttaggttccggtacttacccggttacggtaaaccccaaaacccgaaaccgaacccggaacggtaaccccgtaaaccgaacccccccgtaaaacgtacctacggttacgttaacgtttaacgtgggtaaccggttagtaaacggttaaccgtccccgggtaccgtttacggggttaacgggtttaaccttaacgtccgttcgttttcgtacgttcggtacctaacgtacggttcgtaccggtaacgaaccggtacccggtaccgttacccgtacgacccgtaaccgttcgtaccgggttggtaccctacggtacgtcggtcggaacggaaccgttcgttacgttacgttaagttttacttaagtttcgacgtagttcctaacgtagttactcggtacctaccgggttcgaccgagtaccaacgttagttcgtttcggggttacgggttaacgggggcggaaccgttacggaccggttaccgtcggtacggaccgtccgacccgtaggtccccg

SEQ ID NO: 196707 - DNA, 621 bp, Homo sapiens
  misc_feature: GYAE6OF02HG35X.14.36.D03.1.454.CMB.1.raw
  modified_base (228)..(228): a, c, t, g, unknown or other
  misc_feature (228)..(228): n is a, c, g, or t
  modified_base (376)..(376): a, c, t, g, unknown or other
  misc_feature (376)..(376): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctctgcactggaaccngcagtgtacgttggtggttataagtatgtctcctaggtacaacaaccacccaggacaaacgcccccaaatcatgtatttatgagtacagtaactccggcctcgtagggttctaactcgctttctctggtctactagtcgtgacaaccnccggcctccctagtacccattccgtacgtcgggtcctaccgacggtccgtaggacgggtacgtacgttacgttacgtaatttaactttattcgactacggttcctactaagtactcggacctaccggtggtaccagtacgtaactcgtaggttcgggtttacggggtttcggggaccgggggtaaccgtaacgggtccgtacccggtttcgtaacggtcccgtaacggacccgtaggtaccccgg

SEQ ID NO: 196708 - DNA, 631 bp, Homo sapiens
  misc_feature: GYAE6OF02FU41S.14.36.D03.1.454.CMB.1.raw
  modified_base (199)..(199): a, c, t, g, unknown or other
  misc_feature (199)..(199): n is a, c, g, or t
  modified_base (309)..(309): a, c, t, g, unknown or other
  misc_feature (309)..(309): n is a, c, g, or t
tcagcgtctagtaccacgaccggtgctcgatttagctgcgtcacgatctctcttgggggggggtctcaggaggcagcgctctcaggacatctccaccatggcctgggctctgctgctcctcaccctcctcactcagggcacagggtcctgggcccagtctcgccctgactcagcctgcctcgtgtctggtctctggacngtcgatccaccatcctcctgccacgtggaaccagcagtgacgttggtgttataagtatgtctctggaccaacaacacccagacaaccgacccccaaatcatgtatttagnggagtacagtaactccggtacctcgtaggggttttacctacgtccgtactttcgtccgtggtacctaccgtaagtccgttacggacctaaaccggccggtaccctcccgtacgacccttacgtccgtcgtcgggtctaccgagtaccgtaggacggtacgtcgttagtacgttattacgttagtgtacctagtcctacgtagtactcgtaccgtcgtagtactacgtacacgtacgttagttcggggtttaccgggtttccgggggaaccgggacgttaacggcgttacccgtcgtacgccgtacggtaccgaggtccccgg

SEQ ID NO: 196709 - DNA, 599 bp, Homo sapiens
  misc_feature: GYAE6OF02GUI2V.14.36.D03.1.454.CMB.1.raw
  modified_base (230)..(230): a, c, t, g, unknown or other
  misc_feature (230)..(230): n is a, c, g, or t
  modified_base (371)..(371): a, c, t, g, unknown or other
  misc_feature (371)..(371): n is a, c, g, or t
  modified_base (504)..(504): a, c, t, g, unknown or other
  misc_feature (504)..(504): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatcctcctgcactggaaccngcagtgacgttggtgttataagtatgtctcctggtaccaacaacaccagacaaacgcccccaaactcactgtatttatgagtcagtaactcgcctcgtaggggttactaagtcgtcttctctggtctacaagtctgcaacnccggcctccctgacctatctcgtcggccttccgacggtcgtaggacggacgtacgttcgtacgttaatttaacgttagttcgtacgtacgtctacgtagtacgtcgtacctacgtcggactacgactaatacnggttaggtttcgggtttacggggaccgggggtaaccgacgggttacgtaccggttaccggttacggtaccgaccggtacccggtaaggtccccgg

SEQ ID NO: 196710 - DNA, 707 bp, Homo sapiens
  misc_feature: GYAE6OF02G1CIH.14.36.D03.1.454.CMB.1.raw
  modified_base (237)..(237): a, c, t, g, unknown or other
  misc_feature (237)..(237): n is a, c, g, or t
  modified_base (317)..(317): a, c, t, g, unknown or other
  misc_feature (317)..(317): n is a, c, g, or t
tcagcgtctagtaccacgaccggtgctcgatttagctgcgtcacgatctctcttggggggggtctcaggaggcagcgctctcaggacatctccaccatggcctgggctctgctgctcctccaccctcctcactcgagggcacgagggtcctgggcccaggtctgccctgactcagcctgcctcgtgtcgtgggtctccgtggacagtcgatcaccatcctctgacacgtcggaaccngcagtcgacgttggtagttaatagtatcgtctcgtagtaaccaacaccaccgagaccaaacgccccaatcatgtattagnggacgtactaagtacgtccggcctacggtacgggtttacactcgtcttcgtcgtcgacttacgagtcgtacgactaaccgcgtccctccgacgtaccgtactaccgtcggtcggtacctaccggaggtacgtagggtaacgggtacgtaggttaccttaggttaactttaagttacgtagtaccgtacgtaccgttaactaagttcgtacccgtaaccgaccgggttaacggaccaacggtaacctagttaccggttacggtttcggggttttaaccgggggtttaccggggaaaccggggggttaacccgttaaggggttaccccggttaacccggttaccggttaacgggtaacccgtacccgggtaaccccggtagggtacccccgg

SEQ ID NO: 196711 - DNA, 653 bp, Homo sapiens
  misc_feature: GYAE6OF02G1RWR.14.36.D03.1.454.CMB.1.raw
  modified_base (315)..(315): a, c, t, g, unknown or other
  misc_feature (315)..(315): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcacgtggaaccagcagtgtacggttggtggttataagtatgtctccgtgtaccaacaaccaccaggaccaaacgaccccaaactcactagtatttangtaggtcaagtaagtccggacctacgtagggttactaacgtcgctttctcgtcgtctacagtctacggacaacgaccggtcccttacccgtgaccctacgttccgtacgttcgggcctccggaggtcgtaggacggtacgtagttcgtataagttatttacgtcgactcgtacttaccgtaatacgttcgacgtaccccgtggaacctagtacctaagtaccgttggtttacggggtttcgggtttaccgggggaccggggggttaacctaacgggggttaccgttacccgggttaccgtaacgggtacccggaaccggtaccccgtaggtcccccgg

SEQ ID NO: 196712 - DNA, 627 bp, Homo sapiens
  misc_feature: GYAE6OF02FRCH1.14.36.D03.1.454.CMB.1.raw
  modified_base (457)..(457): a, c, t, g, unknown or other
  misc_feature (457)..(457): n is a, c, g, or t
tcagcgtctagtaccacgaccggtgctcgatttagctgcgtcacgatctctcttgggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcaccatcctcctgcacgtggaaccagcagtgtacgttggtggttatagtatgtctcctgtaccaacaacacccagacaaacgcccccaaactcaatgatttatggaggtcaagtaacgtccggcctacgtagggtttctaagtcgtcttctcgtggctacgagtcgtggacacgaccgccctccgtacgacctatctcgtacgggctccgaggtcgtagaggacgtacgtcgtagtatttacttagttcgntacgtctactatacgtcgtaccaccgttgaccgaacgtactacttacgttagttacgggttttcgggggtttaccggggaccggggggtaacccggtaagggttacccgggaaccggtttcccgggttaacgggttaccctaccgggtacccccgtaggggtacccccgg

SEQ ID NO: 196713 - DNA, 651 bp, Homo sapiens
  misc_feature: GYAE6OF02JC7ML.14.36.D03.1.454.CMB.1.raw
  modified_base (228)..(228): a, c, t, g, unknown or other
  misc_feature (228)..(228): n is a, c, g, or t
  modified_base (240)..(240): a, c, t, g, unknown or other
  misc_feature (240)..(240): n is a, c, g, or t
  modified_base (264)..(264): a, c, t, g, unknown or other
  misc_feature (264)..(264): n is a, c, g, or t
  modified_base (296)..(296): a, c, t, g, unknown or other
  misc_feature (296)..(296): n is a, c, g, or t
  modified_base (341)..(341): a, c, t, g, unknown or other
  misc_feature (341)..(341): n is a, c, g, or t
tcagcgtctagtaccacgaccggtgctcgatttagctgcgtcacgatctctcttgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccngcagtgagttgngttatagtatgtctctagaccaanaacaccagaccaacgccccaatcatgatttanagtagtacagtaatccggcctcgtagggtttcaatccgactttcncgtaggctaccagtctaggaccaacgacggtaccctccgtacgacctaactcgtacgtcgggtacctccgaggtccgtagacgggtaccgtaacgtcgttcggtaactttaacgtttaacgtttcgggacttacgggtaccttcgtaaagtttaccgtacggtaaaccgtttcgggaactaacggtacaacgttcgttagtttcgggtttaccgggtttacgggggtaccggggtaaccttaacgggtccggtaaccgtttcggtaacggggttccaacgggtaccccttaagggtcccttacccccggg

SEQ ID NO: 196714 - DNA, 252 bp, Homo sapiens
  misc_feature: GYAE6OF02J1W3Q.14.36.D03.1.454.CMB.1.raw
  modified_base (238)..(252): a, c, t, g, unknown or other
  misc_feature (238)..(252): n is a, c, g, or t
tcagcgtctagtaccacgaccggtgctcgatttagctgcgtcacgatctctcttggggcttttgatatctgggccaagggacagtggtcaccgtctcttcagcctccaccaagggcccatcggtcttccccctggcaccctcctccaagagcacctctggggcacagcggccctgggctgcctggtcaaggactacttccggtactagacgctagagcgggctggacaggcgcatagnnnnnnnnnnnnnnn

SEQ ID NO: 196715 - DNA, 641 bp, Homo sapiens
  misc_feature: GYAE6OF02GFX3Q.14.36.D03.1.454.CMB.1.raw
  modified_base (230)..(230): a, c, t, g, unknown or other
  misc_feature (230)..(230): n is a, c, g, or t
  modified_base (314)..(314): a, c, t, g, unknown or other
  misc_feature (314)..(314): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatccaccatctcctgcactggaaccngcagtgacgttggtggttataagtatgtctcgtacgtaccaacaaccaccagaccaaacgacccccaaactcaatgtatttagnggtacggtcaagtaactccggcccgtagtacgggtttactaacgttccgtactttctctcggtcctacgtaagtcgtagaccaaccgaccggtccctacccgtcgaacctactccgttccgtcgggcctaccgtaggtcgtaggacggtacgagttacgtattacgttattagtcgctacgtctacgtatactcgaccgtaacgtggacacgtacacgttgtaggtttcgggtttcggggttaacccgggacggggtaacgtaccgggttaccgtaacccggttcggtaaccggtcccgtaaccggtaccccgtaacggtcccccgg

SEQ ID NO: 196716 - DNA, 249 bp, Homo sapiens
  misc_feature: GYAE6OF02HF1BD.14.36.D03.1.454.CMB.1.raw
  modified_base (237)..(249): a, c, t, g, unknown or other
  misc_feature (237)..(249): n is a, c, g, or t
tcagcgtctagtaccacgaccggtgctcgatttagctgcgtcacgatctctcttgggcttttgatatctggggccaagggacagtggtcaccgtctcttcagcctccaccaagggcccatcggtcttccccctggcaccctcctccaagagcacctctgggggcacagcggccctgggctgcctggtcaaggactacttccgtactagacgctgagcgggctggcaaggcgcatagnnnnnnnnnnnnn

SEQ ID NO: 196717 - DNA, 799 bp, Homo sapiens
  misc_feature: GYAE6OF02I07G2.14.36.D03.1.454.CMB.1.raw
tcagcgtctagtaccacgaccggtgctcgatttagctgcgtcacgatctctcgttggggggggtctcaggaggcagcgctctcaggacatctccaccatggcctgggctctgctgctctcacctcctcactcaggcacgagggtcctcgggcccagtctgccctgactcacgcctcgcctccgtgtcgtcgggtctcctggacagtcgatcacctatctcctcgccacgtcggaaccacgctacgtagtacggttggttaggttaataagttattcgttccgttccgttacggtaacctaaacgtaaacccgtacccgaacggtaacccgaaacccgaacccccctaaaacttccgtaagttacgttaaacgttttacgacggtaacggttaccgtaacgttaaccgttcccggttacccgtttcgggtaacgggttttaacctaacgttaccgttcctttcgtacgttcggtaccttaccgtaacgttcgtacggaacaccgtaccgtaccctaccgttacgaaccgttacttcgtacggtccggtcgttaccgtacggtcgtacgggacgttacgtacgttcttaaggtactttagttaacccgttgtaccgtcgttacctacgttaatcgtaccggttaccgaccgtcgaacgtaccgtaacgtaccttacgtttacggtttcgggttttccgggggttaacggggtaacccggggggttaactaccggggttaccgttaacccgggttacggtacccggtacccggtaacggttaccccggaaggttacccccgg

SEQ ID NO: 196718 - DNA, 677 bp, Homo sapiens
  misc_feature: GYAE6OF02JSGHZ.14.36.D03.1.454.CMB.1.raw
  modified_base (200)..(200): a, c, t, g, unknown or other
  misc_feature (200)..(200): n is a, c, g, or t
  modified_base (210)..(210): a, c, t, g, unknown or other
  misc_feature (210)..(210): n is a, c, g, or t
  modified_base (222)..(222): a, c, t, g, unknown or other
  misc_feature (222)..(222): n is a, c, g, or t
  modified_base (228)..(228): a, c, t, g, unknown or other
  misc_feature (228)..(228): n is a, c, g, or t
  modified_base (255)..(255): a, c, t, g, unknown or other
  misc_feature (255)..(255): n is a, c, g, or t
  modified_base (505)..(505): a, c, t, g, unknown or other
  misc_feature (505)..(505): n is a, c, g, or t
tcagcgtctagtaccacgaccggtgctcgatttagctgcgtcacgatctctcgttggggggggtctcaggaggcagcgctctcaggacatctccaccatggcctgggctctgctgctcctcaccctcctcactcagggcacgaggtcctgggcccagtctcgccctgactcagcctgcctcgtgtctgggtctcgtgacngtcgatcacntctcctgctacngaaccngctagtgtacgtggtagttactaagtntgtctccgtcggtaccaacgaaccaccgagaacctaacccgaccccaaactcgattgtaactttagaggacggtactaggtaaactccggtccccttcggtacgggttacttacgtcgttcctttgtccgtcgtccgttacgacgttcgtacggacctaaccgtaccgtccccgtacctacgtactacctccgtcgtccggcttccgaggcgttacgggacgacggtcgtattactaggtttatagttcncgtaacgtcctagtaactcgtaccgtcgtccgtacggacagtactacgttacgtaacggtttcgggtttccggggttaccggggtaacggggtaaccgtaaaccggggttccgttacccggttacgttaccgggtaaaccggtcccgtaccgggtaaccgttccccccgggg

SEQ ID NO: 196719 - DNA, 765 bp, Homo sapiens
  misc_feature: GYAE6OF02GKRDO.14.36.D03.1.454.CMB.1.raw
  modified_base (242)..(242): a, c, t, g, unknown or other
  misc_feature (242)..(242): n is a, c, g, or t
  modified_base (643)..(643): a, c, t, g, unknown or other
  misc_feature (643)..(643): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctcgccctgactcagcctcgcctccgtgtcgtgggtcctccgtggactagtcgactccaccatcctccgtgctacgtggaaccancgtaggtgtacggtttggttaggttaattaagttacgttcgtccttccgtacggtaaccctaaaccaaccgaacccccgaggaaccctaaaacccggaccccccctaaaagtacctaagttacgttaacttttagtagggtacgggttaacctaaggttaaccgtcccgggtaccccttacgggttaacggggttttaacctaacgtccgttccgtttaccgtcgtacggtacctccgtaaggttcgtacggaccaaccgtacccggtcccttcccgtacgtacccttactcccggtttcgaccgggtcctacggaggtccggtaggaacgggtaacgtgttccgttattaacgtttagttagttcgatccgtattacgttaatgttacgaccgtttacgngaccgtaagtccgaaacttcgtaaggtttcgggtttacggggtttaccggggccgggggtaaacgtccggggttaccgtacgggttaccgtaacggtccgaaccggtcccgtacggtccccg

SEQ ID NO: 196720 - DNA, 681 bp, Homo sapiens
  misc_feature: GYAE6OF02G7XH4.14.36.D03.1.454.CMB.1.raw
  modified_base (236)..(236): a, c, t, g, unknown or other
  misc_feature (236)..(236): n is a, c, g, or t
  modified_base (264)..(264): a, c, t, g, unknown or other
  misc_feature (264)..(264): n is a, c, g, or t
  modified_base (307)..(307): a, c, t, g, unknown or other
  misc_feature (307)..(307): n is a, c, g, or t
  modified_base (425)..(425): a, c, t, g, unknown or other
  misc_feature (425)..(425): n is a, c, g, or t
  modified_base (540)..(540): a, c, t, g, unknown or other
  misc_feature (540)..(540): n is a, c, g, or t
tcagcgtctagtaccacgaccggtgctcgatttagctgcgtcacgatctctcttggggggggtctcaggaggcagcgctctcaggacatctccaccatggcctgggctctgctgctctcacctcctcactcagggcacagggtcctgggcccagtctcgccctagactcagcctgcccttccgtgtctgggtctccgtggacacgtcgatcaccgatcctctgcacgtaggaaccngcagtcgtacgttggtaggttataagtntgtctccgtacgaccaacaactaccagacaaccaccccctaanctactagtacttatcggtacgtactagtacgccggtcccgtcgtaagggtttctaacgttcgtcctttcgtcgtcggtcctaccgtaagtcgtcgactacggccgtccctacgcgacntacctcgggtacgtcctccggagtcgtacggacgtagtcgtactaggttacttagttacgttcgactacggtacccttagaaccgtttacgacggtttccgaacgtttacccggngtaaccggtactaaccgtacggttacgtttaacggggtttccgggtttaacccggggcggggggttaaaccgtacgggttcccggttaacccggttcggtaccggttaccggaccgggtaccccggttacgtacccccggg

SEQ ID NO: 196721 - DNA, 737 bp, Homo sapiens
  misc_feature: GYAE6OF02FQ2YA.14.36.D03.1.454.CMB.1.raw
  modified_base (322)..(322): a, c, t, g, unknown or other
  misc_feature (322)..(322): n is a, c, g, or t
  modified_base (427)..(427): a, c, t, g, unknown or other
  misc_feature (427)..(427): n is a, c, g, or t
tcagcgtctagtaccacgaccggtgctcgatttagctgcgtcacgatctctcttgggggggggtctcaggaggcagcgctctcaggacatctccaccatggcctgggctctgctgctcctcaccctcctcactcagggcacagggtcctgggcccagtctgccctgactcagcctgcctccgtgtcgtgggtcctcctggacagtcgatccaccatcctcctgcacgtcggaaccagcagtgtacggttggtggttaataagtatgtctccgtggtaaccaacaaccacccaggacaaaccgcccccaaatcatgtattagnggagtacagtaacgtccggacccttgagggtttactaatcgtcctttctcgtggccttaaccgagttccgtggaccaaccgacccggtccctaccctgaaccctntaccgtccggtcggtcctcccgaggtcgtaggacgggtacggtcgttacgtagttacgtttaattcgttagccgtacggtccttactaaagttcggtccctaccggttaacccggtcggaacccgtacggtaaccgtacgtttacgtacgggttttacggggtttttccggggggtttaaccggggggtaaccccgggggggttaacgtaaaccggggtttaaccggggttacccccgggttaacccgggtttcgggtaaaccccggtacccccggggttaaccccggggtaacccgggttccccccggg

SEQ ID NO: 196722 - DNA, 773 bp, Homo sapiens
  misc_feature: GYAE6OF02GYCUF.14.36.D03.1.454.CMB.1.raw
  modified_base (230)..(230): a, c, t, g, unknown or other
  misc_feature (230)..(230): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatcctcctgcactggaaccngcagtcgtagttggtggttaataagtagtcgttactccgtacggtaaccaacaaccacccgaggaacctaaaccgaaccccctaaacgtacaattgtaattttagtacggaggtacgtaacgtacgtaccggtcccgtacggttaacgggtttcctaaacgtccggttcctttcgttccgttagggtacccttaccgtaacggttcgtacgggaaccctaccggaacccggtccccttaccgtaccggtaacctaacgttcccgttaccgggtaccggtccgttacccggagggtaccgtaacgggtacgggtaacgtaaccggtttcgttaaacggtactttttaacgttcgttaacgtaccgtaacggttccttaaccgttaataacgttacgttacgttaacgtcgtaaacggtttacgttcgggtttaccggggtttaccgggacgggtaacgggtacgtaaccgggttcggtaacccggttacgtacggtacgttaccggacccggacgggtacccttcccggtaccccgtttaccgg

SEQ ID NO: 196723 - DNA, 945 bp, Homo sapiens
  misc_feature: GYAE6OF02HZJCE.14.36.D03.1.454.CMB.1.raw
tcagcgtctagtaccacgaccggtgctcgatttagctgcgtcacgatctctcttgggggggggtctcaggaggcagcgctctcaggacatctccaccatggcctgggctctgctgctcctccacctcctcactccgagggcacgacgggtccgtcgggcccgtacgtcgtcgtccctggaccttcgacgccctcgccctccggtcgtcggtcgggttcctccgtggacacggtctactacaccacttctcctcgactacgtaggaaccagcgtaggtcggtacggttggttaggttaacttaagtacttcgttccgtaccggtacggtaaaccaaaccgaaccgaacccggtaacgaaccgaaaccccgtaaccccctaaaactactacgttagttaacgttttaacgacggaacggttaccgttaagtaaccggttccggtacccttaaccgggttagggttttaacaacgttccggttactttccggtactccgggtaccttacgtaacggtcgttacgaaccctaaccggtaccgtacccgtttccggtacttaaacggcctttaaccgggttccgggtaccgggtacccgttaccggtaaacgggttcccgggtaaacgggtaaccgggttaaaccggtacccgtttaacgtttagggtttaaaaccctttttaagggttacgtttaccggtaaccgtaccgggttaaacttaaccgtttaacggttaaacccgttccggtaaccgggtaaacccgttcggaaaccgttactaacccttaagttaccggtaacggggtttttttccgggttcccggggggggggtttaaacggaacccggggggaaccggtttaaaccgtttcccgggggaaccggttttaacccggtaaggggttaacccccaacggggttaaaccccggcccggttttaaacccccggg

SEQ ID NO: 196724 - DNA, 654 bp, Homo sapiens
  misc_feature: GYAE6OF02F3TW7.14.36.D03.1.454.CMB.1.raw
  modified_base (223)..(223): a, c, t, g, unknown or other
  misc_feature (223)..(223): n is a, c, g, or t
  modified_base (237)..(237): a, c, t, g, unknown or other
  misc_feature (237)..(237): n is a, c, g, or t
  modified_base (504)..(504): a, c, t, g, unknown or other
  misc_feature (504)..(504): n is a, c, g, or t
tcagcgtctagtaccacgaccggtgctcgatttagctgcgtcacgatctctcgttgggggggggtctcaggaggcagcgctctcaggacatctccaccatggcctgggctctgctgctcctcaccctcctcactcagggcacgagggtcctagggcccagtctgccctgactcagcctgcctcgtgtcgtggtctccgtggacaggtcatcacctatcctccngccagtacgaaccngcgagtcggtacgttggtaggttataagtattcgtctcgtcgtaccaacacaccgagacaacctaccccaaatcatgtatttagcgtaggtctaagtacgtcgtaccgtacgtaggtttacacgtcgtacttctcgtcggtcctacgtaactcgtaccggactaacccggtaccgtccctacccgctaaccgtacttccgtccgggtcggtacctaccgacgggtcgtgggaacggcgtacgttcgtacttaatttactgggttacnctacgtcgataacgttcgtcgaccgtccgtacggactacggtactacggtcttaacgggttgggtttaacgggggttcgggaccgggggtaaccgtacgtaccgggacccggtttacggacttaccggaccgttacccggagtaccccgg

SEQ ID NO: 196725 - DNA, 604 bp, Homo sapiens
  misc_feature: GYAE6OF02HYJK8.14.36.D03.1.454.CMB.1.raw
  modified_base (226)..(226): a, c, t, g, unknown or other
  misc_feature (226)..(226): n is a, c, g, or t
  modified_base (317)..(317): a, c, t, g, unknown or other
  misc_feature (317)..(317): n is a, c, g, or t
tcagcgtctagtaccacgaccggtgctcgatttagctgcgtcacgatctctcttgggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcatcacatctctgcactggaaccngcagtcgacgttggtaggttataagtatgttctcctaggtaaccaaaccaacacccaggaccaaacgacccccaaactccatagtatttanggagtcagtaatccggtcctcgtacgggttactaacgtcgtcttctcgtgctacagtctgacaacgcgcctacccgtcacctactcgtcgtcggcctcgacggcgtaggacggacgagttcgttataagttttattagttgctagtcctacgtatactcgtacctaccgtcggacacgtactacttacgtaagttcgggttcgggttttaccggggcgggggtaacccggtaacgggtccggtacccgtacggttaccggtacggaccgtacccgtacggtacccgg

SEQ ID NO: 196726 - DNA, 658 bp, Homo sapiens
  misc_feature: GYAE6OF02INMSQ.14.36.D03.1.454.CMB.1.raw
  modified_base (311)..(311): a, c, t, g, unknown or other
  misc_feature (311)..(311): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcacgtggaaccagcagtgacgttggtgttataagtatgtctctgtaccaacaacaccgagacaaacgcccccaaactcatgtattatgagtanagtaagtcggacctcgtagggttactagtctcttactcgtcgtactaccgtaagtcgtacgacaacgtaccgtccctaccgtacgacctacttcgtccgtggacctccgagggtcctaggacgggaacgtacgttacgtacgttatttaacgtttacgttacgacgtacgtacgttactaagttacgtccgaccgttacccgtagggtaccaaggtacctaattccggtaagtttcgggtttacgggggttttacccgggaacggggggtaaccgtaacggggttaccggttacccggttaaccggttacggtaacccggaccggtacccggtaacggtacccccgg

SEQ ID NO: 196727 - DNA, 748 bp, Homo sapiens
  misc_feature: GYAE6OF02JMW61.14.36.D03.1.454.CMB.1.raw
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacgtaggggtcctcgggcccaagtcctgccctgactcagcctgcctccgtgtcgtggtctccgtaggacagtcgatccaaccattcctcctgaccacgtacggaaccagacagtgtacgttggttggtataagtatcgtactccgtggtaaccaacaacaccgaggaccaaacgacccccaaaacgtccaattacgtaatttagtacggtacggttacgaacgttaaacgtcccggaccccttacggtaacggggttttaacctaaagttccggtaccttttctaccgttcggacccttaccgtaaggttccgtaggaccctaacggtaccccggtccttacccgtacgaacccgtattccgtacggtcgggtcctaccggagtaccgttacggaaacggtcgtaacgttcgttagtaatttaccgttatcggaactcggtaccttacgaattaccggtgtacccttaacggtgtaaccgaaacgtccgtaaattcgtaacgttgggttttaacccggggtttacgggaccgggggttaaaccgtacgggttaccggtaccccggttacggtaaccggtaccgaaccgggtaccccgtaagggtccccgg

SEQ ID NO: 196728 - DNA, 737 bp, Homo sapiens
  misc_feature: GYAE6OF02GXA3S.14.36.D03.1.454.CMB.1.raw
  modified_base (297)..(297): a, c, t, g, unknown or other
  misc_feature (297)..(297): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctcgtgtctggtctcctggacagtcgatcacatctctgcactggaaccagcagtgacgttggtgttataagtatgtctctgtaccaacaacaccagacaacgccccaaactcatgatttangagtacagtaactcggccctacgtagggtttactaacgtcgtactttcgtccgtggtaccctaccgtaacggttccgtacggtaccaaaccggtacccggtccccttaccccgtacgtaaccctaacgttccgttccgttcggggtccctacccggtacgggtaccttacgggaacgggaccggtaacgttcgtacggttaacttttaacgtttagttccgtacgtacgtacccttaactaagtttacgtacgtacctaacccggttcggaccaaacggtaacctaacgttaccgtacgttttacgggggtttacggggtttttacccggggggaaccggggggtaaacccgttaacggggttaccggttaacccccgggttaccggtttaaccgggttaccccgtaaccgggtacccccggtaaaccgggttcccccgg

SEQ ID NO: 196729 - DNA, 792 bp, Homo sapiens
  misc_feature: GYAE6OF02I5FNM.14.36.D03.1.454.CMB.1.raw
tcagcgtctagtaccacgaccggtgctcgatttagctgcgtcacgatctctcttggggggggtctcgaggaggcagcgctctcaggacatctccaccatggcctgggctctgctgctcctcaccctcctcactcaggcacgagggtcctcggccagtctcgccctgactcgacgcctcgcctcgtgtcgtgggtcctccgtggacacgtcgactccaccgacttccttccgtgacctacgtacggaaccagctaaggtcggttacgttggttagttaagtaagttacgttcgtccgttacgtacggtaaccaacgaacctacccgaacggaaccaaaccgaaccccctaaagtactagttaacgtaatttacgacggttacgtacctaacgttaacgtcccggtaccgttacggttacgggtttacttaacgttccgttacctttaccggttccgttacggtacccttaacggtaacggttacctacgggaaacccgtaacccggtacccggtaccccttaacccgtaccgtacccgttacgttcccggtcggtccgggtaccgttacccggtaggtaccgggtaggtaaccggtacgttaccgttacgttattacgtttacgttcgtcgtacgtacgttctacgtactacgtcgtaccgtaccgtcgacgtagtacgtactacgttacggtttacgggttacggggtttaccgggaccggggtaaacggtacgggtaccggttaaccggtcggtaaccggttaccgtaccggtaccggaccggttccccgg

SEQ ID NO: 196730 - DNA, 757 bp, Homo sapiens
  misc_feature: GYAE6OF02JSIHB.14.36.D03.1.454.CMB.1.raw
tcagcgtctagtaccacgaccggtgctcgatttagctgcgtcacgatctctcgttgggggggggtctcaggaggcagcgctctcaggacatctccaccatcggcctgggctctgctgctcctccaccctcctcactcgagggcacgacgggtccgtcgggccctacgtctcgtccctgacctcgcgtcctcgccgtccgtgtcgtcggtctccgtggactacgtcgactccaccacttcctccgtgacacgtacggaaccgagaccgtagttacggtcggtttaggtacggttaaataagtgtcggttcctacgttacgaacccaacacccacgaacggtaccaaacccgcccctaaagtctagttactagtttacgacggtacgtacgtaacggtacgtcccggtcccgttagggttacggttacctactccgttctttccgacggttactccttaaccgagttcgacggtaaccaacccgtccggttaccctaccgaccgtaccgtcgtacgtcggtcgtccgtaccggtacgtacgtacggtacggtacgtacgtacgttacgttacgtttagttacgttacgtcgtacgtacttactacgtacgtaccgtacgtaccggtcgacgtacgtacgtacgttacgttacggttacgggttcggggttaaccggggtacggggtaaccggtccgggtaaaaaccggttccggtaccggttaccggttaccggaccggtacccggtaccggtccccgg

SEQ ID NO: 196731 - DNA, 678 bp, Homo sapiens
  misc_feature: GYAE6OF02GA5GD.14.36.D03.1.454.CMB.1.raw
  modified_base (181)..(181): a, c, t, g, unknown or other
  misc_feature (181)..(181): n is a, c, g, or t
  modified_base (207)..(207): a, c, t, g, unknown or other
  misc_feature (207)..(207): n is a, c, g, or t
  modified_base (316)..(316): a, c, t, g, unknown or other
  misc_feature (316)..(316): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctcgntctggtctctggacagtcgatcaccntctcctgcactggaaccagcagtcgtagttggtgttataagtatgtcctccgtagtaaccaacaaccacccgaaggaccaaaccgcccccaaactcagtcgtatttagngtagtcaagttaacgtccgtaccctacgtacgggtttactaactccgtactttctcgtcggctccgtaagtctacggacaaccgacggtccctaccgtacgtaccctacgttccgttccgacgggtcccttaccggaggtaccgttacgggaacgggtaaccggtacggtttacctacggtttaatttaacgtttaagtccgtactaccgtactacctaagtaccgttcgaccttaaccgggtcgtacgacgtaaccgtaacttcggtaagttcggggtttacggggttaccggggtaaccggggtaaacgtcgggtacgtacccggtcggtaacggaccggaccgtacccggagtccccgg

SEQ ID NO: 196732 - DNA, 578 bp, Homo sapiens
  misc_feature: GYAE6OF02F9ZHL.14.36.D03.1.454.CMB.1.raw
  modified_base (400)..(400): a, c, t, g, unknown or other
  misc_feature (400)..(400): n is a, c, g, or t
  modified_base (422)..(422): a, c, t, g, unknown or other
  misc_feature (422)..(422): n is a, c, g, or t
  modified_base (434)..(434): a, c, t, g, unknown or other
  misc_feature (434)..(434): n is a, c, g, or t
  modified_base (444)..(444): a, c, t, g, unknown or other
  misc_feature (444)..(444): n is a, c, g, or t
  modified_base (453)..(453): a, c, t, g, unknown or other
  misc_feature (453)..(453): n is a, c, g, or t
tcagcgtctagtaccacgaccggtgctcgatttagctgcgtcacgattcgtcgtcttggggggggtctcaggaggccagcgctctcaggacatctccaccatggcctgggctctgctgctcctcaccctcctcactcagggcacagggtcctgggcccagtctgccctgactcagcctgcctccgtgtctgggtctcctggacagtcgataaccatctcctgcactggaaccagcaggtgacgttggtgttataagtatgtctctgtaccaacacacccaggcaaacgcccccaaactcaatgtatttagcggtagtcaggttaactccggcccttgtacggggtttctaatccgtcttactctggccttccaagtctaggacaacgccggacctcccgngaccatctcgtcgggtcctcgnggcgtagacggngactgttagntttaagttnttgactgtctcatatgaccaccgtggcctaagcaagtctagttggttcgggtttcgggaccggggaaccgtagggttaccggtcgttccggtacggtaccgtaccggacccgaggccttacccgg

SEQ ID NO: 196733 - DNA, 818 bp, Homo sapiens
  misc_feature: GYAE6OF02F0P8N.14.36.D03.1.454.CMB.1.raw
tcagcgtctagtaccacgaccggtgctcgatttagctgcgtcacgatctctcttgggggggggtctcaggaggcagcgctctcaggacatctccaccatggcctgggctctgctgctcctcaccctcctcactcagggcacgagggtcctggggcccagtctcgcccctgacctcgagccctgccctccgtgtcgtgggtctctggacctagtcgatccaccatctcctgcacgtaggaaccagcagtggtcggtttggttaggttaataagtattcgtccttccgtacggtaacccaaacctaaccgaccccgaacggaccaaacccgacccccctaaactcgaatcgtactttagtacggaggtactaagttaacgttccggtacccgttacggttagggggtttacttaacgttccgtaccgtttccttcggtcggtaccttaccgtaacgttccggtacgacccgaaccgtacccgggtaccccttacccgttccgaccctacgttccgtccggttaccgggtccgttacccgacgggtccggtaggtaaccgggtaccgtacggttacggttacgttacgttttaacgttagttccgtacgtacgtaccgttacgtaacgtttacgtcggtacccttaccggtacggaccgtaacgtaccgtaaccgtacgtttaacggtttcggggtttttaccgggggttacccgggggggttaaccggggtaaaccgggttaaccgggttccgggtaaccccgggttaccggttaccgggaccggtaacccgggttaccccggtaagggttccccccggg

SEQ ID NO: 196734 - DNA, 751 bp, Homo sapiens
  misc_feature: GYAE6OF02FRZR3.14.36.D03.1.454.CMB.1.raw
  modified_base (129)..(129): a, c, t, g, unknown or other
  misc_feature (129)..(129): n is a, c, g, or t
  modified_base (149)..(149): a, c, t, g, unknown or other
  misc_feature (149)..(149): n is a, c, g, or t
  modified_base (233)..(233): a, c, t, g, unknown or other
  misc_feature (233)..(233): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctnactcagggcaccagggtccngggcccagtctcgccctgactcacgcctgaccctccgtgttctcgggtctccgtgacgtacgtcgaatccaaccagtccttccnggcctagtcgaaccagccaagtgacgttggtaggttactaaatgttctcgttccgttaggtaaccaaaccaaaccgtaccccaagggacctaaaaaccggtaacccccccaaaattcgtaacgttcagttttaacaacgggtacggtactaaggtaacgtaccgggtccccttaggttacgggtttaccttaaactccgtctttaccgttcgtacgtccgttaaccacgggttacaggaccttaaaccccgggacggtcccctttaacccgtcggaccttacgtacctaccggtcgggacccttaccgacggttcgcggtaaacgccggttaacggttccgatttaacgtttaaacttcggttacgtacgtacgtctactagttacgtccgccgttaaaccgtcgaccgtgaacctagtagtaaccgttgggtttaccgggtttaccggggggaccggttacggtaacggtccggtaacggttcgtaccggtacgtacggggtacccaaccggtcccg

SEQ ID NO: 196735 - DNA, 812 bp, Homo sapiens
  misc_feature: GYAE6OF02HBUU4.14.36.D03.1.454.CMB.1.raw
  modified_base (453)..(453): a, c, t, g, unknown or other
  misc_feature (453)..(453): n is a, c, g, or t
tcagcgtctagtaccacgaccggtgctcgatttagctgcgtcacgatctctcgttggggggggtctcaggaggcagcgctctcgaggacatctccacatcggccgtgggctctgctcgcctcctccaccctcctcactcagggcacggacgggtcctcgggccagtctcgaccctgactcgacgtcctcgtccgtccgtgttcgtcgggttacctccgtaggaccgtagtcgtactaccaacctcttcctcgtcgacgtaacgtaccgaacacgcaggtagtacggttggttagttaagtaagtatcgtccttacggtacgtaaaccaacgaaccgaccaagggacccaaaacccgacccctaactactaagtacgttaatttacggtagtaacgtacctaagtaccgttccggacccttaaaggggttcgtttaacacgttcgtctttaccncgtcgtaaccacgttacggtacgtaccgaactaaccggtccctacccgtcgtacccacgtacctaccgttcggtaccggtctacgggtaccgtacggaacggtaagtaaccgggacggttaattacgggtttaaacttagttaacgttccgtaaacgcggtacttaccgttaatacgtacgtacccgtaacggtcgtaacgtaaacgtaacgttacgtaccttaggggtttttacccgggtacggggtttaccgggggaaccgggtaaccgggttaaaccgggttacccggtaaaccgggttttaccggaaccgggtttacccgggaaacccggttaaccggtcggtttaaccccccgg

SEQ ID NO: 196736 - DNA, 743 bp, Homo sapiens
  misc_feature: GYAE6OF02I9G0R.14.36.D03.1.454.CMB.1.raw
tcagcgtctagtaccacgaccggtgctcgatttagctgcgtcacgatctctcgttgggggggggtctcaggaggcagcgctctcaggacatctccaccatggcctgggctctgctgctcctcaccctcctcactcgagggcacgacgggtcctgggcccagtctgccctgactcagcctgcctccgtgtcgtgggtcctcctaggacaggtacgactccaacctactcctaaacctcgacacgtacggaaacctagtaggtgtacggtttaggtttatttaagttaattttcgtccttccgtacggtaccaacgacgaccgaacccgacgaccaaacccgaccccctaaattcctaatttaactttagtacgaaggttaacaaagttaaccgtccgtacccgtacgaacggtttactttacgtaactccgtaccttctcgttcggtaccttacgtaagtccgttacggaaccgtaaccgtaccggtacccttacccgtagacgtcctacgttccgtacggtccgggtaccgtcgtacgggtacttacggggaaccgggtcggtaacggttacgttaacgttacgttttaaccgacttcggaacgtcttacgtaccttattaacgtacttaatacggactaacggtacgttgggtttacggttaccggggagtacggtaacgtacggtaccggtcgtacgtacgtaccgaccgaccggacgtcccgttaccgtccccggtaccg

SEQ ID NO: 196737 - DNA, 792 bp, Homo sapiens
  misc_feature: GYAE6OF02FIT9C.14.36.D03.1.454.CMB.1.raw
  modified_base (225)..(225): a, c, t, g, unknown or other
  misc_feature (225)..(225): n is a, c, g, or t
  modified_base (238)..(238): a, c, t, g, unknown or other
  misc_feature (238)..(238): n is a, c, g, or t
tcagcgtctagtaccacgaccggtgctcgatttagctgcgtcacgatcgtctcttggggggggtctcaggaggcagcgctctcaggacatctccacatggcctgggctctgctgctcctcaccctcctcactcgagggcacgagggtcctgggcccagtctgccctgactcagcctgccctcgtgtctgggtcctccgtggacagtccgatccacctatcctccngcacgtggaaccnggccagtgacgttggtgttataagtactgtcttccgtggtaaccctaaccgaaccaccccgagtaccgaaaacgtcccccaaacttcgattgtaacttttagtggtaacggtcaacggttaaactccgggtaccccttacgtacgggggttttacctaaacgttccggtacctttcgtccgttcgggtcccttaccgtaaacgtcttacgggaccctaaaccgaccgggtcccctcccgtacgacccgtaactccgttccgtaacgggggtcccttaccgaaacgggttccgttacgggaaccgggtaccggtacggttaccgttacggttaatttacggtttaagtttcggacctacggtacctacgtaacgttaacgttacggtaccctaccggtacggtccgaaacgggtcctaaaccgttccgaacggtttcgggtttacggggttttacccggggggaccggggggtaaacccttaacgggggtaccggtaaccccggttcccggttaaacgggtaccaccgggttaccccggaacgggtttcccccgg

SEQ ID NO: 196738 - DNA, 615 bp, Homo sapiens
  misc_feature: GYAE6OF02FL3Z8.14.36.D03.1.454.CMB.1.raw
  modified_base (219)..(219): a, c, t, g, unknown or other
  misc_feature (219)..(219): n is a, c, g, or t
  modified_base (228)..(228): a, c, t, g, unknown or other
  misc_feature (228)..(228): n is a, c, g, or t
  modified_base (253)..(253): a, c, t, g, unknown or other
  misc_feature (253)..(253): n is a, c, g, or t
  modified_base (271)..(271): a, c, t, g, unknown or other
  misc_feature (271)..(271): n is a, c, g, or t
  modified_base (320)..(320): a, c, t, g, unknown or other
  misc_feature (320)..(320): n is a, c, g, or t
  modified_base (366)..(366): a, c, t, g, unknown or other
  misc_feature (366)..(366): n is a, c, g, or t
  modified_base (386)..(386): a, c, t, g, unknown or other
  misc_feature (386)..(386): n is a, c, g, or t
tcagcgtctagtaccacgaccggtgctcgatttagctgcgtcacgatctctcttgggggggtctcaggaggcagcgctctcaggacatctccaccatggcctgggctctgctgctcctcaccctcctcactcagggcacagggtcctgggccagtctgccctgactcagcctgcctccgtgtcctggtctcctggacagtcgatcaccatctcctgccntggaacccngtccagtgacgttggtgtatagatnctcctgtacaacacaccngcaaagcccccaaactcatgattatgaggtcaagtaactcggacccctnacggggtttctaatcgcttctctggccttaccagtactggcaaacnccgggtcctccgtcgaccancgtctagggcctcccgaggacctcggaacggaaccggtaggtactacgggttaactttaatttaactttggtaccgaggtctaccgtaataacgttagtacccaacccggttcgaccgaacggcctaaattccgaatcgggtttaacgggtttttcggggacccggggggggtaacctacgggtacggtaaccgtacccgtaggttacgacggcccggtaaggtacccg

SEQ ID NO: 196739 - DNA, 717 bp, Homo sapiens
  misc_feature: GYAE6OF02HFF4V.14.36.D03.1.454.CMB.1.raw
  modified_base (229)..(229): a, c, t, g, unknown or other
  misc_feature (229)..(229): n is a, c, g, or t
  modified_base (341)..(341): a, c, t, g, unknown or other
  misc_feature (341)..(341): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacgagggtccgtgggcccagtctcgccctgactcagcctgcctccgtgtcgtcggtcctccgtggactagtcgactccacctactcctccngccacgtacggaaccagcagtgtacggttggtagttataagtatcgtctcgtacgtaccaacacgaccgacggaccaacccgacccctaaactctaacgtagttattaacgnggtacgtacgtaaggtaactccggtcctacggttacgggtttacctacgttccgtctttaccggtcgtcgttacccgtaccgtaaggttccgtacggtaaccgtaaccggtacccggtaccccttcgtaaccgaccttacgtccgtcggtccggtaccgtaccgtacgggacgtacggacgggtaaccgttacggttattacggtttattaagttcgtcgaccgttacgtcgtaactacttacgaccgtaccgacgttacgacgacgtacctagttaccttcgggtttcgggtttacgggttccgggggaccggtaacggtaccggtacgtccggttacgtaacggttacggacccgtacccggagtacccccggg

SEQ ID NO: 196740 - DNA, 593 bp, Homo sapiens
  misc_feature: GYAE6OF02G7YMD.14.36.D03.1.454.CMB.1.raw
  modified_base (198)..(198): a, c, t, g, unknown or other
  misc_feature (198)..(198): n is a, c, g, or t
  modified_base (432)..(432): a, c, t, g, unknown or other
  misc_feature (432)..(432): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctcgtgtctggtctcctggacngtcgatcaccatcctcctgccacgtggaaccagcagtgacgttggtggttataagtatgtctcctggtaccaacaacacccgagacaaacgtcccccaaatcatgtatttatgaggtcagtaatccgccctcgtagggtttctaactcgtcttctcgtgctcaagtctgacctaacgaccggtccctcccgtcgaccctatcgtccgtgggcctccgaggtctaggacggacgngttctgtatttatattgacagtctactactagtcgactaccgtggaccagtactaactcgtagtttcgggtttacggggtttcggggaccgggggtaaccgtacgggtaccgtacccggttccggtacggtacccgtaccggtacccgtacggtaccccgg

SEQ ID NO: 196741 - DNA, 751 bp, Homo sapiens
  misc_feature: GYAE6OF02HH6NV.14.36.D03.1.454.CMB.1.raw
tcagcgtctagtaccacgaccggtgctcgatttagctgcgtcacgatctcgtcgttggggggggtctcaggaggcagcgctctcaggacatctccaccatggcctgggctctgctgctcctcaccctctcactcagggcacagggtcctggcccagtctgccctgactcagcctgcctccgtgtcgtgggtcctacctggaccaggttccgaatccaccgatcctcccgtgcctacgtacggaaccacgtcgtaggtcgttacggtttgggttaggtttaaagttaaggtacttcggttaccttccgttacggtaacccaacgaaccaaccgacggaaccaacccggaaccccctaactactacgttacgtaagtttagacggtaggttacaacgttaaccgtcccgggtacccgttacgggttacgggtttactaacgtccggttcctttcgtcgtccgtaccgtaacgacgttcgtacgaccgtaaactcccggtaccctcgtaccgactaccttcgtcggtaccggtccgtacgtcggacgttcgggaacgtacggttacttacgtagtttactttaagttcgtacgtcgtactcctacgtacgttacgccgtaccgtacgtcgaacctgtaactcgtgtttaacgggtttggggtttacggggtttaaccgggggacggggttaaccggaacggtttccggaccggtttccggaacggttccggaccggtaccggtaccgttcccgg

SEQ ID NO: 196742 - DNA, 738 bp, Homo sapiens
  misc_feature: GYAE6OF02FX4Z4.14.36.D03.1.454.CMB.1.raw
  modified_base (221)..(221): a, c, t, g, unknown or other
  misc_feature (221)..(221): n is a, c, g, or t
tcagcgtctagtaccacgaccggtgctcgatttagctgcgtcacgatctctcgttgggggggggtctcaggaggcagcgctctcaggacatctccacatggcctgggctctgctgctcctcaccctcctcactcgagggcacgagggtcctgggcccagtcctgccctgactcgacgcctgcctccggtgtcgtgggtcctcctggacaggtcatccaccntcctcctgcctacgtcggaaccgtccaggtcggtacgttggtggttaatagtagtcgtccgttcctacggttaccaaaccaaccgaccccgacggaccaaacccggaccccctaaactcgtagtagtatttagtaggacggtcaagttaaccgtccggtcccgtacgttacgggtttacctacttcgtaccttctaccggttgtaccctacgtaacgtcgtacgggaacctaacccgcggtcccctcccggtaccgtacctaccgtccgttaccgcgggttcccgtaccgtaacgggtcgtaacgggtacggtaaccggtaacgttaccgttacggttaaacgtttactttaagttccgtacggtacgttacccggtaattactttaacggttccgacccgttaccggtcggaacttcgggaactactcgttaggttcgggtacggggtttccgggacggggtaccctaggttaccggtcgtaccgtacggtacgaccgttacggaccgttacccgg

SEQ ID NO: 196743 - DNA, 783 bp, Homo sapiens
  misc_feature: GYAE6OF02H3BRW.14.36.D03.1.454.CMB.1.raw
  modified_base (765)..(765): a, c, t, g, unknown or other
  misc_feature (765)..(765): n is a, c, g, or t
tcagcgtctagtaccacgaccggtgctcgatttagctgcgtcacgatctctcgttgggggggggtctcaggaggcagcgctctcgaggacatctccaccatcggcctggggctctgctgcctcctccaccctcctcgacctcgagggccacgacggggttcccgtcggggccctaggttcctcggtcccctgtaccttcaacgcccgtcgccgttccggtgtcgtcggggttacctccgttgggaaccaggttccgactaccaacgtactcccgttacgtcgaccaaccggtacgggaaaccacgtacgagttagggtacggtttcgggttaggttaacgtaagttacgtcgttacctccgtaacggttaaccaaccgaaccaccgtaacggacaaaccccgtaaccctaactacgtaactagttaacttagtggtacgtacgtaagtaacgtccggtacccgtagttacgggtttacaacctccgttctacgtgtaccgttactaccgacgttcgagtaccaaccggtaccgtacctaccgtcgaaccgtactccgtacggcgtaccgtacggacggtcgtacggcgggtaacgtacgtcgttaagttattaattacgtacgaccgttagccttaagttacgtcttaacgttacgtacgtactaacggtacgttacgggtttcgggttaccggacggggtaacggtaacggtaccggggtacgtaccgtaacgttacggccgtaaccggacccgacggttcccnccggttacccccgtccgg

SEQ ID NO: 196744 - DNA, 654 bp, Homo sapiens
  misc_feature: GYAE6OF02HQMIH.14.36.D03.1.454.CMB.1.raw
  modified_base (232)..(232): a, c, t, g, unknown or other
  misc_feature (232)..(232): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctctcactcagggcacgaggtcctgggcccagtcctcgccctgactcagcctgcctcgtgtctggtctcctggacagtcgatcaccatctcctgcacgtgaaccagtgngtacgtttgttaattattaattttcgtcttccgtaggtaaccaacgacgtccaccgaggaccaaaaccgaccccctaaatccttaatttatttagtacggtaacggttacaaagttaaccgtcccggaccttcgtacggttactttacgtaacttccgtcttctcgttacggcctttacaaggtacgtacggtacctaacggcccgtcctaccgtagtacactacgtccgttacgtcggtacctcgtacgacgtgaacggacgacgtcgtagttattactacgtcgtacacgctatacgtaactattactacgacgtagttacgttggttacgggttacgaacggggtacggtaacgtacggtacgtacccgttaccgtacggtccgtaacgcccgaaggtccctaccggtccccgtaccgg

SEQ ID NO: 196745 - DNA, 783 bp, Homo sapiens
  misc_feature: GYAE6OF02FHJ07.14.36.D03.1.454.CMB.1.raw
  modified_base (237)..(237): a, c, t, g, unknown or other
  misc_feature (237)..(237): n is a, c, g, or t
  modified_base (267)..(267): a, c, t, g, unknown or other
  misc_feature (267)..(267): n is a, c, g, or t
  modified_base (594)..(594): a, c, t, g, unknown or other
  misc_feature (594)..(594): n is a, c, g, or t
tcagcgtctagtaccacgaccggtgctcgatttagctgcgtcacgatctctcgttggggggggtctcaggaggcagcgctctcaggacatctccaccatggcctgggctctgctgctcctcaccctcctcactcagggcacgagggtcctgggcccagtctgccctgactcgagcctgcctccggtgtcgtggtctcgtcggactgtcgatccactctcctcgagcacgtacgaacngctagtggcggttggtagtaactagtcgtntcttcgtacgaaccaacaaccgaccgacggaacctaaacccgacccctaactacagttacgttaattagtacggtaacggtactaacgttaaccggtcccgtacccgtttacggttacggtttacttacgttacctccgttacgtccgttacgtaccgtacgtacggtacgtacggaacctaaccggtcccggttccacggttaccacccgttacgtccgttagggtccccggtaccgtaccggtcgtaccgggtaacggtaacgggtaccgttggttaaccgtaagttttacgtttacgttacgttacaaccggtttacgtacctntttaacgttaccgtaccgtaccggttaaccgtacggacaacgttccgtaaagttccggtttaggttacccgggggttttcggggttaacccggggggaacccgggttacgggttaacccgggttaccggttaccccggtacggtttaacccggccggtaaccgggtacccggtaccccgttaccccggg

SEQ ID NO: 196746 - DNA, 621 bp, Homo sapiens
  misc_feature: GYAE6OF02JI2LH.14.36.D03.1.454.CMB.1.raw
  modified_base (232)..(232): a, c, t, g, unknown or other
  misc_feature (232)..(232): n is a, c, g, or t
  modified_base (255)..(255): a, c, t, g, unknown or other
  misc_feature (255)..(255): n is a, c, g, or t
  modified_base (303)..(303): a, c, t, g, unknown or other
  misc_feature (303)..(303): n is a, c, g, or t
  modified_base (316)..(316): a, c, t, g, unknown or other
  misc_feature (316)..(316): n is a, c, g, or t
tcagcgtctagtaccacgaccggtgctcgatttagctgcgtcacgatctctcttggggggggtctcaggaggcagcgctctcaggacatctccaccatggcctgggctctgctgctcctcaccctcctcactcagggcacgagggtcctgggcccagtctgccctgactcagcctgcctccgtgtctgggtctcctggacagtcgatcaccatcctcctgcacgtggaaccngcagtgcgttggtggtataagtntgtctcgtgtaccaacacaccgagtacaacgccccaatcatgtattangtagtcaagtacncgcctagtaggttctactcgtctttctcgtaggctaccgtagtccgtaggaccaacggccggtccctccgtacgaccctacttaccgtccgtcggggtacccttaccggaacgggtcgttagggacggtacggtaacgtccgttagtaactttagttgtacgcgtaagtacgtctaactacgtcgtaccgtaccgttacggactaagactaacttcgtagttcgggtttacgggttaccggggacggggtaacctagggttaccggaccgttaccggacgttacgacgtacccggtagtaccccg

SEQ ID NO: 196747 - DNA, 744 bp, Homo sapiens
  misc_feature: GYAE6OF02HH4RK.14.36.D03.1.454.CMB.1.raw
  modified_base (257)..(257): a, c, t, g, unknown or other
  misc_feature (257)..(257): n is a, c, g, or t
  modified_base (413)..(413): a, c, t, g, unknown or other
  misc_feature (413)..(413): n is a, c, g, or t
tcagcgtctagtaccacgaccggtgctcgatttagctgcgtcacgatctctcttgggggggggtctcagggaggcagcgctctcaggacatctccaccatggcctgggctctgctgcctcctccaccctcctcacctcgagggccacgtaggggtccctggggcccaggtctcggccctagactcagtcctgcccttcgtgttcgtcgggtcctccgtggacaggtcgatccacctatcctcctgccacgtcggacngacagtgtagttcggtggttaacttaagtatcgtacctcgtaccgtaaccgtaacaacccgtaccgacggaaccaaaacccgtacccccgaaaccttactaactaggttaactttaacggtacggacggttacgaacggttaccgtcggtaccccngttaacggtcgttaacctaagtccggttcttcggtcctggtaccctaccgtaaacgtcgtaacgcaaccggtccgtacccgtccgtaacggtcgaccgtcgtccgtacggtacggttccgtaacgggtcggtacacgggagtaaccgggactagggttacctagtttaacgttccgaacggtctaccgtacgtactacgttaaccttaagtagttaccgaatccggttaaaggtccggtttagggttaccggagggtacccggtaaagtccgggttaacggcccttagggaacctcggtaacccgacccggttacccggcttacccccggg

SEQ ID NO: 196748 - DNA, 258 bp, Homo sapiens
  misc_feature: GYAE6OF02JIRMG.14.36.D03.1.454.CMB.1.raw
  modified_base (243)..(258): a, c, t, g, unknown or other
  misc_feature (243)..(258): n is a, c, g, or t
tcagcgtctagtaccacgaccggtgctcgatttagctgcgtcacgatctctcttgggcttttgatatctggggccaagggacagtggtcaccgtctcttcagcctccaccaagggcccatcggtcttccccctggccaccctcctccaagacgcacctcgtgggggcacagcggccctgggctgcctggtacaaggactacttccgtactagacgtctgaggcgggctggcaaggcgcatagnnnnnnnnnnnnnnnn

SEQ ID NO: 196749 - DNA, 276 bp, Homo sapiens
  misc_feature: GYAE6OF02F9JZN.14.36.D03.1.454.CMB.1.raw
  modified_base (248)..(276): a, c, t, g, unknown or other
  misc_feature (248)..(276): n is a, c, g, or t
tcagcgtctagtaccacgaccggtgctcgatttagctgcgtcacgatctctcttgggcttttgatatctggggccaagggacagtggtcaccgtctcttcagcctccaccaagggcccatcggtcttccccctggcaccctcctccaagagcacctctgggggcacagcggccctgggctgcctggtcaaggactacttccgtactagaccgtctgagccgggtctcggacaagggccgacatacggnnnnnnnnnnnnnnnnnnnnnnnnnnnnn

SEQ ID NO: 196750 - DNA, 706 bp, Homo sapiens
  misc_feature: GYAE6OF02FS8O2.14.36.D03.1.454.CMB.1.raw
  modified_base (241)..(241): a, c, t, g, unknown or other
  misc_feature (241)..(241): n is a, c, g, or t
  modified_base (455)..(455): a, c, t, g, unknown or other
  misc_feature (455)..(455): n is a, c, g, or t
  modified_base (462)..(462): a, c, t, g, unknown or other
  misc_feature (462)..(462): n is a, c, g, or t
  modified_base (467)..(467): a, c, t, g, unknown or other
  misc_feature (467)..(467): n is a, c, g, or t
  modified_base (604)..(604): a, c, t, g, unknown or other
  misc_feature (604)..(604): n is a, c, g, or t
tcagcgtctagtaccacgaccggtgctcgatttagctgcgtcacgatctctcttgggggggggtctcaggaggcagcgctctcaggacatctccaccatggcctgggctctgctgctcctcacctcctcactcagggcacagggtcctgggcccagtcgtcgccctggactcagcctgcctccgtgtcgtcgggtctccgtggacagtcgactcacctatctcctcgccacgtacggaccngacgagtggaccggttggtaggttaacgtaagtagtcgtacttccgtaggtaacccaacaaccgacccacggaccgaaaccgacccccaaactcgaacttgtaatttacgtaggacgttacgagttacgtccggcccgtacggtcgggtttactacgtcgtcgttacgtctcgtacgtacgtacgtcgtacgaccaacgccgtcccgtccgtanactacgnttccncggtcggtaccgtcgtacggtccgtaacggtacggcgtacggacgttgtaaagtttcgttaacgcggtacacggtctcctaacttagtaccttaagggttacaccttaacggtacgttcgggttcgggttaaccggnggggtaaccggtaaccgggttaacggttcccgggtaacccgttccggtaaccgggtaccgtaccgggtaccggtacgggttcccgtacccgttacccccggg

SEQ ID NO: 196751 - DNA, 738 bp, Homo sapiens
  misc_feature: GYAE6OF02HKW1C.14.36.D03.1.454.CMB.1.raw
  modified_base (184)..(184): a, c, t, g, unknown or other
  misc_feature (184)..(184): n is a, c, g, or t
  modified_base (602)..(602): a, c, t, g, unknown or other
  misc_feature (602)..(602): n is a, c, g, or t
  modified_base (620)..(620): a, c, t, g, unknown or other
  misc_feature (620)..(620): n is a, c, g, or t
tcagcgtctagtaccacgaccggtgctcgatttagctgcgtcacgatctctcgttgggggggggtctcaggaggcagcgctctcaggacatctccaccatcggcctgggctctgctcgcctcctcctaccctcctcactcgacgggcacgacgggtccgtcgggcccagtctcgcctcgactcncgcctcgcctccgtcgtcgtcggtctcgcggacacgtcgactcacctacgttcctccgtcaccgacgtacggaacctaggcgtagtacggttacggttggttacggtttaagtaagttcgttcgttaccgttccggtaaccggtaaccaaaccgtaaccgaacccgaacggaacccgaaaccgaaccccctaactacgtaattacgttatttacggtacgtaacggtacgtaacgttaaccgtccggtaccgttacggttacggttacctacgttcgttacttcgttcgtacgtcctacgtaacggtacgacgtaccaccggtaccgtcctacgactacctcgtccgtcgggttccgcgtacgacggtacgtaacggacgggtattacggttctagttacgtttcgttgtaccgactntaccgtactacggttacnccggtaaccttcgaacggtacacgacttacgtacgttagggtttccggttacgggccggggtaaggacggtaacggttacgcgttaccgggtacgccggtacgaccgttaccgaccgg

SEQ ID NO: 196752 - DNA, 785 bp, Homo sapiens
  misc_feature: GYAE6OF02JEGD3.14.36.D03.1.454.CMB.1.raw
  modified_base (227)..(227): a, c, t, g, unknown or other
  misc_feature (227)..(227): n is a, c, g, or t
  modified_base (294)..(294): a, c, t, g, unknown or other
  misc_feature (294)..(294): n is a, c, g, or t
tcagcgtctagtaccacgaccggtgctcgatttagctgcgtcacgatctctcgttgggggggtctcaggaggcagcgctctcgaggacatctccaccgatcggccgtgggctctgctcgcctcctccaccctcctacactcgacgggcacgacgggtccgtcgggccctagtccgtcgccctagacctcacgtcctcgtccgtcgtgtcgtcggtcctcgtggaacngtcgataccactctcctcgtcgacacgtcgaactgactaggtgtacggttggttacgttaataagtnttcgtaccgttcgtaacgtaaccaaaccaccgaccgaagaaccctaacccgaccctaatctaagttagtacgttagtacggacgtagtaaccgtcgtccggtaccgttagggttacgtttacacggtccttcgttacgtcgtcggtacctacggtacgtcgtagaccaaccgttccgtacccgtactacgacgttctaccgtcgtaaccgggtctacggaacggttcgaccggttacggaactacggtttacgttacgtttagtttacgttacggtacacggttaacctgttaaccggttaacgtcccgttaaccgtaaccgtttaccccggataaacccggtaacccgttaattccgtacgtttttcgggggtttaacgggtttcgggggtaaacccgggtacgggtaacccgggtttaaccggtcccggttaccggttacggaacccggttacccgaaccggggttaccccgtttacccggaaccccgg

SEQ ID NO: 196753 - DNA, 190 bp, Homo sapiens
  misc_feature: GYAE6OF01BFBSD.44.62.F07.1.454.CMB.1.raw
  modified_base (155)..(190): a, c, t, g, unknown or other
  misc_feature (155)..(190): n is a, c, g, or t
tcagacagtatatacacgaccggtgctcgatttagtagtcgcataaagggaaagggacacgacttgagattaagcgaactgtggctgcaccatctgtcttcatcttacccgccatctgatatatactgtctgagcgggctggcaaggcgcatagnnnnnnnnnnnnnnnnnnnnnnnnnnnnnnnnnnnn

SEQ ID NO: 196754 - DNA, 154 bp, Homo sapiens
  misc_feature: GYAE6OF01D8KJQ.44.62.F07.1.454.CMB.1.raw
  modified_base (154)..(154): a, c, t, g, unknown or other
  misc_feature (154)..(154): n is a, c, g, or t
tcagacagtatatacacgaccggtgctcgatttagtagtcgcataaagggaaagggacacgacttgagattaagcgaactgtggctgcaccatctgtcttcatcttcccgccatctgatatatactgtctgagcgggctggcaaggcgcatagn

SEQ ID NO: 196755 - DNA, 158 bp, Homo sapiens
  misc_feature: GYAE6OF01D1F3X.44.62.F07.1.454.CMB.1.raw
  modified_base (154)..(158): a, c, t, g, unknown or other
  misc_feature (154)..(158): n is a, c, g, or t
tcagacagtatatacacgaccggtgctcgatttagtagtcgcataaagggaaagggacacgacttgagattaagcgaactgtggctgcaccatctgtcttcatcttcccgccatctgatatatactgtctgagcgggctggcaaggcgcatagnnnnn

SEQ ID NO: 196756 - DNA, 157 bp, Homo sapiens
  misc_feature: GYAE6OF01AIUTD.44.62.F07.1.454.CMB.1.raw
  modified_base (154)..(157): a, c, t, g, unknown or other
  misc_feature (154)..(157): n is a, c, g, or t
tcagacagtatatacacgaccggtgctcgatttagtagtcgcataaagggaaagggacacgacttgagattaagcgaactgtggctgcaccatctgtcttcatcttcccgccatctgatatatactgtctgagcgggctggcaaggcgcatagnnnn

SEQ ID NO: 196757 - DNA, 414 bp, Homo sapiens
  misc_feature: GYAE6OF01E5UEF.37.42.D09.1.454.CMB.1.raw
  modified_base (413)..(414): a, c, t, g, unknown or other
  misc_feature (413)..(414): n is a, c, g, or t
tcagtagtgtagatcacgaccggtgctcgatttagacacatacgcagggaagggactggattggattgggtatatccattacagtgggaggaccaactacaacccctccctcaagagtcgagtcaccatatcagtagacacgtccaagaaccagttctccctgaagctgagctctgtgaccgctgcggacacggccgtatattactgtgcgagaaaccaacccttctactactacatggacgtctggggcaaggggaccacggtcaccgtctcctcagcctccaccaagggcccatcggtctcccctgccaccctcctccaagacgcacctcgtggggcacgagcggccctgggctgcctggtcaaggactacttccatctacactactgagcgggctggcaaggcgcatagnn

SEQ ID NO: 196758 - DNA, 455 bp, Homo sapiens
  misc_feature: GYAE6OF01ATM7T.37.42.D09.1.454.CMB.1.raw
  modified_base (424)..(455): a, c, t, g, unknown or other
  misc_feature (424)..(455): n is a, c, g, or t
tcagtagtgtagatcacgaccggtgctcgatttagacacatacgcaggggtaagggggactggattgggattgggtatatccagttacagtgggaggaccaactacaaccccgtccctcaagagtcgagtcaccatatcagtagacacgtccaagaaccagttcgtccctgaagctgagctctgtgaccgctgcggacacgggccgtatattactgtgcgagaaaccaaccttctactactacatggacgtctgggcaaggggaccacggtcaccgtctcctcagcctccaccaagggcccatacggtcttccccctggccaccctcctccaagagcacctctgggggcacgagcggccctggggctgcctggtcaaggctacttccatctacactactgagcgggctggcaaggcgcatagcnnnnnnnnnnnnnnnnnnnnnnnnnnnnnnnn

SEQ ID NO: 196759 - DNA, 420 bp, Homo sapiens
  misc_feature: GYAE6OF01B0RN5.37.42.D09.1.454.CMB.1.raw
  modified_base (414)..(420): a, c, t, g, unknown or other
  misc_feature (414)..(420): n is a, c, g, or t
tcagtagtgtagatcacgaccggtgctcgatttagacacatacgcagggaaagggactggattggattgggtatatccattacagtgggaggaccaactacaacccctccctcaagagtcgagtcaccatatcagtagacacgtccaagaaccagttctccctgaagctgagctctgtgaccgctgcggacacggccgtatattactgtgcgagaaaccaacccttctactactacatggacgtctggggcaaggggaccacggtcaccgtctcctcagcctccaccaagggcccatcggtcttccccctggcaccctcctccaagagcacctctggggacacagcggccctgggctgcctggtcaaggactacttccatctacactactgagcgggctggcaaggcgcatagnnnnnnn

SEQ ID NO: 196760 - DNA, 415 bp, Homo sapiens
  misc_feature: GYAE6OF01BY6K8.37.42.D09.1.454.CMB.1.raw
  modified_base (413)..(415): a, c, t, g, unknown or other
  misc_feature (413)..(415): n is a, c, g, or t
tcagtagtgtagatcacgaccggtgctcgatttagacacatacgcagggaaagggactggattggattgggtatatccattacagtgggaggaccaactacaacccctccctcaagagtcgagtcaccatatcagtagacacgtccaagaaccagttctccctgaagctgagctctgtgaccgctgcggacacggccgtatattactgtgcgagaaaccaacccttctactactacatggacgtctggggcaaggggaccacggtcaccgtctcctcagcctccaccaagggcccatcggtcttccccctggcaccctcctccaagagcacctctggggcacagcggccctgggctgcctggtcaaggactacttccatctacactactgagcgggctggcaaggcgcatagnnn

SEQ ID NO: 196761 - DNA, 432 bp, Homo sapiens
  misc_feature: GYAE6OF01E3MQQ.37.42.D09.1.454.CMB.1.raw
  modified_base (426)..(432): a, c, t, g, unknown or other
  misc_feature (426)..(432): n is a, c, g, or t
tcagtagtgtagatcacgaccggtgctcgatttagacacatacgcagggaagggactggattggattgggtatatccattacagtgggaggaccaactacaacccctccctcaagagtcgagtcaccatatcagtagacacgtccaagaaccagttctccctgaagctgagctctgtgaccgctgcggacacggccgtatattactgtgcgaacgaaacctaacccttctactactacatggacgtcgtgggcaaggggaccacggtcaccgtctcctcagcctccaccaacgggccatcggtccttccccctggccaccctcctccaagacgccacctcgtgggggcacgacgccggcccgtgggctcgcctggtcaaggactacttccatctacactactgagcggctggcgaaggcgcatagnnnnnnn

SEQ ID NO: 196762 - DNA, 421 bp, Homo sapiens
  misc_feature: GYAE6OF01BB7SN.37.42.D09.1.454.CMB.1.raw
  modified_base (411)..(411): a, c, t, g, unknown or other
  misc_feature (411)..(411): n is a, c, g, or t
  modified_base (417)..(421): a, c, t, g, unknown or other
  misc_feature (417)..(421): n is a, c, g, or t
tcagtagtgtagatcacgaccggtgctcgatttagacacatacgcagggaagggactggattggattgggtatatccattacagtgggaggaccaactacaacccctccctcaagagtcgagtcaccatatcagtagacacgtccaagaaccagttctccctgaagctgagctctgtgaccgctgcggacacggccgtatattactgtgcgagaaaaccaacccttctaactactacatggacgtctgggggcaaaggggaccacgggtcaccgtctcctcagcctccaccaagggcccatcggtcttccccctggccacccctcctccaagacgcacctctggggcacagcgccctgggctgcctggtcaaggactactccatctacactactgagcggctggcaaggcncatagnnnnn

SEQ ID NO: 196763 - DNA, 417 bp, Homo sapiens
  misc_feature: GYAE6OF01EINE8.37.42.D09.1.454.CMB.1.raw
  modified_base (414)..(417): a, c, t, g, unknown or other
  misc_feature (414)..(417): n is a, c, g, or t
tcagtagtgtagatcacgaccggtgctcgatttagacacatacgcagggaagggactggattggattgggtatatccattacagtgggaggaccaactacaacccctccctcaagagtcgagtcaccatatcagtagacacgtccaagaaccagttctccctgaagctgagctctgtgaccgctgcggacacggccgtatattactgtgcgagaaaccaacccttctactactacatggacgtctggggcaaggggaccacggtcaccgtctcctcagcctccaccaagggcccatcggtcttccccctggcacccctcctccaagagcacctctgggggcacagcggccctgggctgcctggtcaaggctacttccatctacactactgagcgggctgggcaaggcgcatagnnnn

SEQ ID NO: 196764 - DNA, 439 bp, Homo sapiens
  misc_feature: GYAE6OF01CT1CL.37.42.D09.1.454.CMB.1.raw
  modified_base (414)..(414): a, c, t, g, unknown or other
  misc_feature (414)..(414): n is a, c, g, or t
  modified_base (420)..(439): a, c, t, g, unknown or other
  misc_feature (420)..(439): n is a, c, g, or t
tcagtagtgtagatcacgaccggtgctcgatttagacacatacgcagggaagggactggattggattgggtatatccattacagtgggaggaccaactacaacccctccctcaagagtcgagtcaccatatcagtagacacgtccaagaaccagttctccctgaagctgagctctgtgaccgctggcggacacggccgtatattactgtgcgagaaaccacccttctactactacatggacgtctggggcaagggggccacggtcaccgtctcctcagcctccaccaagggcccatcggtccttccccctggccacccctcctcccaagacgcaccgtctgggggcacagcggcccgtgggctgcctggtcaaaggctacttccatctacactactgagcgggctggcaaggcncatagnnnnnnnnnnnnnnnnnnnn

SEQ ID NO: 196765 - DNA, 417 bp, Homo sapiens
  misc_feature: GYAE6OF01C0KQV.37.42.D09.1.454.CMB.1.raw
  modified_base (415)..(417): a, c, t, g, unknown or other
  misc_feature (415)..(417): n is a, c, g, or t
tcagtagtgtagatcacgaccggtgctcgatttagacacatacgcagggaagggactggattggattgggtatatccattacagtgggaggaccaactacaacccctccctcaagagtcgagtcaccatatcagtagacacgtccaagaaccagttctccctgaagctgagctctgtgaccgctgcggacacggccgtatattactgtgcgagaaaccaacccttctactactacatggacgtctggggcaaggggaccacggtcaccgtctcctcagcctccaccaagggcccatcggtcttccccctggcacccctcctccaacgagcacctctgggggcacagcggccctgggctgcctggtcaaggactacttccatctacactactgagcgggctggcaaggcgcatagnnn

SEQ ID NO: 196766 - DNA, 441 bp, Homo sapiens
  misc_feature: GYAE6OF01DEQBS.37.42.D09.1.454.CMB.1.raw
  modified_base (406)..(406): a, c, t, g, unknown or other
  misc_feature (406)..(406): n is a, c, g, or t
  modified_base (412)..(441): a, c, t, g, unknown or other
  misc_feature (412)..(441): n is a, c, g, or t
tcagtagtgtagatcacgaccggtgctcgatttagacacatacgcagggaagggactggatggattgggtatatccattacagtgggaggaccaactacaaccccctcctcaagagtcgagtcaccatatcagtagacacgtccaagaaccagttctccctgaagctgagctctgtgaccgctgcggacacggccgtatattactgtgcgaggaaaccaacccttctactactacatggacgtctggggcaaggggaccacggtccacgtctcctcagcctccaccaagggcccatcggtctccccctggcaccctcctccaagagcacctcgtggggcacagcggccctagggctgcctggtcaaggactacttcatctacactctgaggcggctggcaaggccncatagnnnnnnnnnnnnnnnnnnnnnnnnnnnnnn

SEQ ID NO: 196767 - DNA, 415 bp, Homo sapiens
  misc_feature: GYAE6OF01C9TGR.37.42.D09.1.454.CMB.1.raw
  modified_base (414)..(415): a, c, t, g, unknown or other
  misc_feature (414)..(415): n is a, c, g, or t
tcagtagtgtagatcacgaccggtgctcgatttagacacatacgcagggaaagggactggattggattgggtatatccattacagtgggaggaccaactacaacccctccctcaagagtcgagtcaccatatcagtagacacgtccaagaaccagttctccctgaagctgagctctgtgaccgctgcggacacggccgtatattactgtgcgagaaaccaacccttctactactacatggacgtctggggcaaggggaccacggtcaccgtctcctcagcctccaccaagggcccatcggtcttccccctggcaccctcctccaagagcacctctgggggcacagcggccctgggctgcctggtcaaggactacttccatctacactactgagcgggctggcaaggcgcatagnn

SEQ ID NO: 196768 - DNA, 455 bp, Homo sapiens
  misc_feature: GYAE6OF01DAT6Y.37.42.D09.1.454.CMB.1.raw
  modified_base (185)..(185): a, c, t, g, unknown or other
  misc_feature (185)..(185): n is a, c, g, or t
  modified_base (267)..(267): a, c, t, g, unknown or other
  misc_feature (267)..(267): n is a, c, g, or t
  modified_base (325)..(325): a, c, t, g, unknown or other
  misc_feature (325)..(325): n is a, c, g, or t
  modified_base (374)..(374): a, c, t, g, unknown or other
  misc_feature (374)..(374): n is a, c, g, or t
  modified_base (404)..(404): a, c, t, g, unknown or other
  misc_feature (404)..(404): n is a, c, g, or t
  modified_base (410)..(410): a, c, t, g, unknown or other
  misc_feature (410)..(410): n is a, c, g, or t
  modified_base (412)..(413): a, c, t, g, unknown or other
  misc_feature (412)..(413): n is a, c, g, or t
  modified_base (416)..(455): a, c, t, g, unknown or other
  misc_feature (416)..(455): n is a, c, g, or t
tcagtagtgtagatcacgaccggtgctcgatttagacacatacgcaggggaaggggactgggattggattgggtatatccattacagtgggaggaccaactacaacccctcctcaagagtcgagtcaccatatcagtagacacgtccaagaaccagttctccctgaagctgagctctgtgaccgntgcggacacgggcctatattactgtgcgagaaaacccacccttgtaactactacatgggacgtctgggggcaagggggaccngggtcacgtctcctcagcctccacaagggccatcggtctcccctggcacctcctcagngccacctctggggcacagcgcctgggctgcctggtcaggtctacgttcntctacactactgaggcggctggcaaggtcncatagnannagnnnnnnnnnnnnnnnnnnnnnnnnnnnnnnnnnnnnnnnn

SEQ ID NO: 196769 - DNA, 418 bp, Homo sapiens
  misc_feature: GYAE6OF01CKC7R.37.42.D09.1.454.CMB.1.raw
  modified_base (412)..(418): a, c, t, g, unknown or other
  misc_feature (412)..(418): n is a, c, g, or t
tcagtagtgtagatcacgaccggtgctcgatttagacacatacgcagggaagggactggattggattgggtatatccattacagtgggaggaccaactacaacccctccctcaagagtcgagtcaccatatcagtagacacgtccaagaaccagttctccctgaagctgagctctgtgaccgctgcggacacggccgtatattactgtgcgagaaaccacccttctactactacatggacgtctggggcaaggggaccacggtcaccgtctcctcagcctccaccaagggcccatcggtcttccccctggcacccctcctccaagagcacctctggggcacagcggccctgggctgcctggtcaaggactacttccatctacactactgagcgggctggcaaggcgcatagnnnnnnn

SEQ ID NO: 196770 - DNA, 602 bp, Homo sapiens
  misc_feature: GYAE6OF01BMDSN.37.42.D09.1.454.CMB.1.raw
  modified_base (575)..(602): a, c, t, g, unknown or other
  misc_feature (575)..(602): n is a, c, g, or t
tcagtagtgtagatcacgaccggtgctcgatttagacacatacgcagggaagggactggattggattgggtatatccattacagtgggaggaccaaactacaaaccccctcccatacaagagtcgagtccaccatatcagtagacaccgtaccaaacgaacctagttcctcccgtagaacgctggacgtcctctggtacggacccgcgtcggaccggaccgaccgggtccgttaattaactttacgtggtcggaccgaaacgaaaacccctaaccctttctaacctaactacagtcgggtaccgtcggtggggacggaacggggaccacggtccaccgtcctcctcacgccctacccaaccgaacgggcccacgtccggttccccttcccccgtggccctacccctccctaccgaagcgccaccgtcgggtcgggggaccacgacgggcccggtccccggtgggtcctcggtcccgttcgggtaccgaaacgggtacccttaccgttaccacttacctaacctaacttacgtaggacgggccgggtcgtacgggacgaacgggccgactagtagnnnnnnnnnnnnnnnnnnnnnnnnnnnn

SEQ ID NO: 196771 - DNA, 421 bp, Homo sapiens
  misc_feature: GYAE6OF01BX5DW.37.42.D09.1.454.CMB.1.raw
  modified_base (226)..(226): a, c, t, g, unknown or other
  misc_feature (226)..(226): n is a, c, g, or t
  modified_base (414)..(421): a, c, t, g, unknown or other
  misc_feature (414)..(421): n is a, c, g, or t
tcagtagtgtagatcacgaccggtgctcgatttagacacatacgcagggaagggactggattggattgggtatatccattacagtgggaggaccaactacaacccccccctcaagagtcgagtcaccatatcagtagacacgtccaagaaccagttctccctgaagctgagctctgtgaccgctgcggacacggccgtatattactgtgcgagaaaccaacccttntactactacatggacgtctggggcaaggggaccacggtcaccgtctcctcagcctccaccaagggcccatcggtcttccccctggcaccctcctccaagacgcacctctgggggcacagcggccctgggctgcctggtcaaggactacttccatctacactactgagcgggctggcaaggcgcatagnnnnnnnn

SEQ ID NO: 196772 - DNA, 421 bp, Homo sapiens
  misc_feature: GYAE6OF01AF4CV.37.42.D09.1.454.CMB.1.raw
  modified_base (415)..(421): a, c, t, g, unknown or other
  misc_feature (415)..(421): n is a, c, g, or t
tcagtagtgtagatcacgaccggtgctcgatttagacacatacgcagggaaagggactggattggattgggtatatccattacagtgggaggaccaactacaacccctccctcaagagtcgagtcaccatatcagtagacacgtccaagaaccagttctccctgaagctgagctctgtgaccgctgcggacacggccgtatattactgtgcgagaaaccaacccttctactactacatggacgtctgggggcaaggggaccacggtcaccgtctcctcagcctccaccaagggcccatcggtcttccccctggcaccctcctccaagagcacctctggggacacagcggccctgggctgcctggtcaaggactacttccatctacactactgagcgggctggcaaggcgcatagnnnnnnn

SEQ ID NO: 196773 - DNA, 437 bp, Homo sapiens
  misc_feature: GYAE6OF01B2N6I.37.42.D09.1.454.CMB.1.raw
  modified_base (423)..(437): a, c, t, g, unknown or other
  misc_feature (423)..(437): n is a, c, g, or t
tcagtagtgtagatcacgaccggtgctcgatttagacacatacgcagggaagggactggattggattgggtatatccattacagtgggaggaccaactacaacccctccctcaagagtcgagtcaccatatcagtagacacgtccaagaaccagttctccctgaagctgagctctgtgaccgctgcggacacggccgtatattactgtgcgagaaaccaacccttctactactacatggactcgtggggcaagggggaccacggtcaccgtctcctcagcctccaccaagggcccatcggtcttccccctggccacccctcctccaagacgccacctcgtgggggccacgagccggccctgggctgcctggtcaaggactacttccatctacactactgagcgggctggcaaggcgcagtagnnnnnnnnnnnnnnn

SEQ ID NO: 196774 - DNA, 416 bp, Homo sapiens
  misc_feature: GYAE6OF01DFFE5.37.42.D09.1.454.CMB.1.raw
  modified_base (410)..(416): a, c, t, g, unknown or other
  misc_feature (410)..(416): n is a, c, g, or t
tcagtagtgtagatcacgaccggtgctcgatttagacacatacgcagggaagggactggattggattgggtatatccattacagtgggaggaccaactacaacccctccctcaagagtcgagtcaccatatcagtagacacgtccaagaaccagttctccctgaagctgagctctgtgaccgctgcggacacggccgtatattactgtgcgagaaaccaacccttctactactacatggacgtctggggcaaggggaccacggtcaccgtctcctcagcctccaccaagggcccatcggtcttcccctggcaccctcctccaagagcacctctggggcacagcggccctgggctgcctggtcaaggactacttccatcacactactgagcgggctggcaaggcgcatagnnnnnnn

SEQ ID NO: 196775 - DNA, 420 bp, Homo sapiens
  misc_feature: GYAE6OF01DWXE3.37.42.D09.1.454.CMB.1.raw
  modified_base (412)..(420): a, c, t, g, unknown or other
  misc_feature (412)..(420): n is a, c, g, or t
tcagtagtgtagatcacgaccggtgctcgatttagacacatacgcagggaagggactggattggattgggtatatccattacagtgggaggaccaactacaacccccccctcaagagtcgagtcaccatatcagtagacacgtccaagaaccagttctccctgaagctgagctctgtgaccgctgcggacacggccgtatattactgtgcgagaaaccaacccttctactactacatggacgtcgtgggggcaagggggaccacgggtcaccgtctcctcagcctccaccaagggcccatcggtcttccccctggcaccctcctccaagagcacctctggggcacagcggcctggctgctggtcaaggactacttcatctacactactgagcggctggcaaggcgcagtagnnnnnnnnn

SEQ ID NO: 196776 - DNA, 422 bp, Homo sapiens
  misc_feature: GYAE6OF01D7WVM.37.42.D09.1.454.CMB.1.raw
  modified_base (412)..(422): a, c, t, g, unknown or other
  misc_feature (412)..(422): n is a, c, g, or t
tcagtagtgtagatcacgaccggtgctcgatttagacacatacgcagggaagggactggattggattgggtatatccattacagtgggaggaccaactacaacccctccctcaagagtcgagtcaccatatcagtagacacgtccaagaaccagttctccctgaagctgagctctgtgaccgctgcggacacggccgtatattactgtgcgagaaaccaacccttctactactacatggacgtcgtggggcaaggggaccacggtcaccgtctcctcagcctccaccaagggccatcggtcttccccctggccaccctcctccaagacgcacctctgggggcacagccggccctgggctgcctggcaaggactactcatctacactactgagcggctggcaaggcgcatagnnnnnnnnnnn

SEQ ID NO: 196777 - DNA, 498 bp, Homo sapiens
  misc_feature: GYAE6OF01BX0TJ.37.42.D09.1.454.CMB.1.raw
  modified_base (263)..(263): a, c, t, g, unknown or other
  misc_feature (263)..(263): n is a, c, g, or t
  modified_base (478)..(498): a, c, t, g, unknown or other
  misc_feature (478)..(498): n is a, c, g, or t
tcagtagtgtagatcacgaccggtgctcgatttagacacatacgcagggaagggactggattggattgggtatatccattacagtgggaggaccaactacaaccccctccctcaagagtcgagtcaccatatcagtagacacgtccaagaaccagttctccctgaagctgagctctgtgaccgctgcggacacggccgtatattactgtgcgaagaaaccaacccttctactactacatggacgtctggggcaagggggaccncggtcaccgtctcctcagcctccaccaaggcccatcggtcttccccctggccacccctcctcccaagacgccacctccgtgggggcacgacggccggccccgtggggcctcggcccgtgggttacgaaacgggaccttaccgttccaacttcctaaccgaccttacgtcgacggccggggcgtacgggacaacgggccgaccgtaagtaggcagnnnnnnnnnnnnnnnnnnnnn

SEQ ID NO: 196778 - DNA, 425 bp, Homo sapiens
  misc_feature: GYAE6OF01BM7MZ.37.42.D09.1.454.CMB.1.raw
  modified_base (420)..(425): a, c, t, g, unknown or other
  misc_feature (420)..(425): n is a, c, g, or t
tcagtagtgtagatcacgaccggtgctcgatttagacacatacgcagggaagggactggattggattgggtatatccattacagtgggaggaccaactacaacccctccctcaagagtcgagtcaccatatcagtagacacgtccaagaaccagttctccctgaagctgagttctgtgaccgctgcggacacggccgtatattactgtgcgagaaacccaacccttctactactacatggacgtctggggcaaggggaccacggtcaccgtctcctcagcctccaccaagggcccatcggtcttccccctggccaccctcctccaaacgacgccacctctgggggcacacgcggccctgggctgcctggtcaagactacttccatcctacactactgacgcggctggcaaggcgcatagnnnnnn

SEQ ID NO: 196779 - DNA, 505 bp, Homo sapiens
  misc_feature: GYAE6OF01BBF1U.37.42.D09.1.454.CMB.1.raw
  modified_base (425)..(425): a, c, t, g, unknown or other
  misc_feature (425)..(425): n is a, c, g, or t
  modified_base (427)..(427): a, c, t, g, unknown or other
  misc_feature (427)..(427): n is a, c, g, or t
  modified_base (436)..(436): a, c, t, g, unknown or other
  misc_feature (436)..(436): n is a, c, g, or t
  modified_base (441)..(441): a, c, t, g, unknown or other
  misc_feature (441)..(441): n is a, c, g, or t
  modified_base (446)..(446): a, c, t, g, unknown or other
  misc_feature (446)..(446): n is a, c, g, or t
  modified_base (450)..(450): a, c, t, g, unknown or other
  misc_feature (450)..(450): n is a, c, g, or t
  modified_base (453)..(454): a, c, t, g, unknown or other
  misc_feature (453)..(454): n is a, c, g, or t
  modified_base (458)..(458): a, c, t, g, unknown or other
  misc_feature (458)..(458): n is a, c, g, or t
  modified_base (461)..(461): a, c, t, g, unknown or other
  misc_feature (461)..(461): n is a, c, g, or t
  modified_base (468)..(468): a, c, t, g, unknown or other
  misc_feature (468)..(468): n is a, c, g, or t
  modified_base (474)..(474): a, c, t, g, unknown or other
  misc_feature (474)..(474): n is a, c, g, or t
  modified_base (476)..(476): a, c, t, g, unknown or other
  misc_feature (476)..(476): n is a, c, g, or t
  modified_base (478)..(478): a, c, t, g, unknown or other
  misc_feature (478)..(478): n is a, c, g, or t
  modified_base (481)..(481): a, c, t, g, unknown or other
  misc_feature (481)..(481): n is a, c, g, or t
  modified_base (488)..(490): a, c, t, g, unknown or other
  misc_feature (488)..(490): n is a, c, g, or t
  modified_base (492)..(493): a, c, t, g, unknown or other
  misc_feature (492)..(493): n is a, c, g, or t
  modified_base (495)..(495): a, c, t, g, unknown or other
  misc_feature (495)..(495): n is a, c, g, or t
  modified_base (497)..(497): a, c, t, g, unknown or other
  misc_feature (497)..(497): n is a, c, g, or t
  modified_base (499)..(500): a, c, t, g, unknown or other
  misc_feature (499)..(500): n is a, c, g, or t
  modified_base (503)..(503): a, c, t, g, unknown or other
  misc_feature (503)..(503): n is a, c, g, or t
  modified_base (505)..(505): a, c, t, g, unknown or other
  misc_feature (505)..(505): n is a, c, g, or t
tcagtagtgtagatcacgaccggtgctcgatttagacacatacgcaggggaagggactggattggattgggtatagtccattacaagtgggaggaccaactacaacccctccctcaagagtcgagtcaccatatcagtagacacgtcaagaaccagttctcctgaagctgagctctgtgaccgctgcggacacggccgtatattactgtgcgaagaaaccaccttctactactacatggactagtggggcaaggggaccacggtcaccgtctcctcagcctcaccaaggccatcggtcttcccctggccaccctcctccaagcgcacctcgtcggggacacgagccggcctgggactcgccgtggtcaacggactactccatctacactactgacgcggctcggacgaacggcgacacgtaaggnangtagcagancgttnctagntacncanngacnctncgtctcngcgagngngnganacgacannncnncncncnnctngn

SEQ ID NO: 196780 - DNA, 426 bp, Homo sapiens
  misc_feature: GYAE6OF01BKIZH.37.42.D09.1.454.CMB.1.raw
  modified_base (422)..(426): a, c, t, g, unknown or other
  misc_feature (422)..(426): n is a, c, g, or t
tcagtagtgtagatcacgaccggtgctcgatttagacacatacgcagggaagggactggattggattgggtatatccattacagtgggaggaccaactacaacccctccctcaagagtcgagtcaccatatcagtagacacgtccaagaaccagttctccctgaagctgagctctgtgaccgctgcggacacggccgtatattactgtgcgagaaacccaacccttctactactacatggacgtcgtggggcaagggggaccacggtcaccgtctcctcagcctccaccaagggcccatcggtcttcccccctggccacccctcctcccaagacgcacctctgggggcacagcggccctgggctgcctggtcaaggactacttccatctacgactactgagcgggctggcaaggcgcatagnnnnn

SEQ ID NO: 196781 - DNA, 451 bp, Homo sapiens
  misc_feature: GYAE6OF01AQRI5.37.42.D09.1.454.CMB.1.raw
  modified_base (433)..(434): a, c, t, g, unknown or other
  misc_feature (433)..(434): n is a, c, g, or t
  modified_base (436)..(451): a, c, t, g, unknown or other
  misc_feature (436)..(451): n is a, c, g, or t
tcagtagtgtagatcacgaccggtgctcgatttagacacatacgcagggaagggactggattggattgggtatatccattacagtgggaggaccaactacaacccctccctcaagagtcgagtcaccatatcagtagacacgtccaaagaaccagttctccctgaagctgagctctgtgaccgctgcggacacggccgtatattactgtgcgaagaaaaccaaccctttctactactacatggacgtctggggcaagggggacccacggtcaccgtctcctcagcctccaccaagggcccatcggtccttccccctggccacccctcctccaagacgcaccctcgtcgggggcacacggcggcccctgggctcgcctggtcaaggactacttccatctacactactgagcgggctggcgaaggcgacagtagnncnnnnnnnnnnnnnnnn

SEQ ID NO: 196782 - DNA, 554 bp, Homo sapiens
  misc_feature: GYAE6OF01BZN9E.37.42.D09.1.454.CMB.1.raw
  modified_base (502)..(502): a, c, t, g, unknown or other
  misc_feature (502)..(502): n is a, c, g, or t
  modified_base (504)..(504): a, c, t, g, unknown or other
  misc_feature (504)..(504): n is a, c, g, or t
  modified_base (507)..(507): a, c, t, g, unknown or other
  misc_feature (507)..(507): n is a, c, g, or t
  modified_base (510)..(510): a, c, t, g, unknown or other
  misc_feature (510)..(510): n is a, c, g, or t
  modified_base (519)..(539): a, c, t, g, unknown or other
  misc_feature (519)..(539): n is a, c, g, or t
  modified_base (541)..(554): a, c, t, g, unknown or other
  misc_feature (541)..(554): n is a, c, g, or t
tcagtagtgtagatcacgaccggtgctcgatttagacacatacgcagggaaaggggactggattggattgggtatatccattacagtgggaggaccaactacaaccccctccctcaagagtcgagtcaccatatcagtagacacgtccaagaaccagttctccctgaagctgagctctgtgaccgctgcggacaccgggccgtatacgttacctgtgacgaacgaaaaccaccccttctaactactacatggacgtcgtggggcaaggggaccacggtccaccgtctccgtccacgccctccaaccgaacgggcccagtccggtccttcccccgtggcccacccctcctacccaacgacgccaccctcgtcgggggccacgacggccggcccgtgggccgtcgcccgtggtaccgaacgggtacccttacttccacgtcctaaccgacttaccgtacggaacggcccgggtacgtacgggacgaacggtcgactaagtacgnanagnagngctgacgtnnnnnnnnnnnnnnnnnnnnngnnnnnnnnnnnnnn

SEQ ID NO: 196783 - DNA, 561 bp, Homo sapiens
  misc_feature: GYAE6OF01B9E3I.37.42.D09.1.454.CMB.1.raw
  modified_base (184)..(184): a, c, t, g, unknown or other
  misc_feature (184)..(184): n is a, c, g, or t
  modified_base (234)..(234): a, c, t, g, unknown or other
  misc_feature (234)..(234): n is a, c, g, or t
  modified_base (258)..(258): a, c, t, g, unknown or other
  misc_feature (258)..(258): n is a, c, g, or t
  modified_base (520)..(520): a, c, t, g, unknown or other
  misc_feature (520)..(520): n is a, c, g, or t
  modified_base (522)..(561): a, c, t, g, unknown or other
  misc_feature (522)..(561): n is a, c, g, or t
tcagtagtgtagatcacgaccggtgctcgatttagacacatacgcagggaagggactggattggattgggtatatccattacagtgggaggaccaactaccaaccccccccctaagagtcgagtcaccatatcagtagacacgtccaaagaccagttctccctgaagctgagctctgtgaccgntggcggacacggccttatattactgtgacgaacgaaaccctaaccctttnaactactacagtgggaccgttcgngggggacaagggggcccacgggtccaccgtctcctcacgcctccacgaacgggcccagtccggtccttcccccgtcggcctaccccctcctccgaagacgcctacccgtcggtcgggggaccacgacgcccgggtcccgtgggcctcgtccgtcgggtaccaacgggtacctttacccgttaccactttaccctaaccgtaaccttacggtggaccgggcggggtccgttacgggaccgaacggggccgacgtacgtaggcncnnnnnnnnnnnnnnnnnnnnnnnnnnnnnnnnnnnnnnnn

SEQ ID NO: 196784 - DNA, 482 bp, Homo sapiens
  misc_feature: GYAE6OF01AOAF7.37.42.D09.1.454.CMB.1.raw
  modified_base (317)..(317): a, c, t, g, unknown or other
  misc_feature (317)..(317): n is a, c, g, or t
  modified_base (446)..(446): a, c, t, g, unknown or other
  misc_feature (446)..(446): n is a, c, g, or t
  modified_base (454)..(482): a, c, t, g, unknown or other
  misc_feature (454)..(482): n is a, c, g, or t
tcagtagtgtagatcacgaccggtgctcgatttagacacatacgcagggaagggactggattggattgggtatatccattacagtgggaggaccaactacaacccctccctcaagagtcgagtcaccatatcagtagacacgtccaagaaccagttctccctgaagctgagctctgtgaccgctgcggacacggccgtatattactgtgcgaagaaacccacccttctaactactacagtggactcgtggggcaaggggaccacggtccaccgctcctcagccctccaccaacgggccctatccggtccttcccccnggtcccacccctccctccaagacgccacctcgtgggggcacgacggccggcccgtgggcctcggccgtggtacgaaaggtcctaccgttcactctacactcgtgacggtcgggctaggcgaaggccganagtagcgnnnnnnnnnnnnnnnnnnnnnnnnnnnnn

SEQ ID NO: 196785 - DNA, 461 bp, Homo sapiens
  misc_feature: GYAE6OF01BSLQH.37.42.D09.1.454.CMB.1.raw
  modified_base (447)..(461): a, c, t, g, unknown or other
  misc_feature (447)..(461): n is a, c, g, or t
tcagtagtgtagatcacgaccggtgctcgatttagacacatacgcagggaagggactggattggattgggtatatccattacagtgggaggaccaactacaacccctccctcaagagtcgagtcaccatatcagtagacacgtccaagaaccagttctccctgaagctgagctctgtgaccgctgcggacacggccgtatattactgtgcgagaaaccaacccttctactactacatggacgtcgtgggcaaggggaccacggtcaccgtctcctcacgcctccaccgacgggcccatcggtccttcccccgtggcctacccctcctacccaagacgccacccgtcggtcgggggccacgaggcccggcccgtggggctcgcctggtacaacggacttactccatctactactactggacgccggctcgggacgaggccgcaatagnnnnnnnnnnnnnnn

SEQ ID NO: 196786 - DNA, 446 bp, Homo sapiens
  misc_feature: GYAE6OF01ATLBY.37.42.D09.1.454.CMB.1.raw
  modified_base (425)..(446): a, c, t, g, unknown or other
  misc_feature (425)..(446): n is a, c, g, or t
tcagtagtgtagatcacgaccggtgctcgatttagacacatacgcagggaagggactggattggattgggtatatccattacagtgggaggaccaactacaacccctccctcaagagtcgagtcaccatatcagtagacacgtccaagaaccagttctccctgaagctgagctctgtgaccgctgcggacacggccgtatattactgtgcgagaaaccacccttctactactacatggacgtctggggcaaggggacccacggtcaccgtctcctcagcctccaccaaggggcccatcggtcttcccccctggccacccctcctccaagagcacctcgtgggggccacagcgacccgtgggctgcctggtcgaacggactacttccatcctacactactgacgcgggcgtggcaaggcgcatagnnnnnnnnnnnnnnnnnnnnnn

SEQ ID NO: 196787 - DNA, 700 bp, Homo sapiens
  misc_feature: GYAE6OF01EA8O2.37.42.D09.1.454.CMB.1.raw
  modified_base (627)..(627): a, c, t, g, unknown or other
  misc_feature (627)..(627): n is a, c, g, or t
  modified_base (655)..(656): a, c, t, g, unknown or other
  misc_feature (655)..(656): n is a, c, g, or t
  modified_base (659)..(659): a, c, t, g, unknown or other
  misc_feature (659)..(659): n is a, c, g, or t
  modified_base (662)..(700): a, c, t, g, unknown or other
  misc_feature (662)..(700): n is a, c, g, or t
tcagtagtgtagatcacgaccggtgctcgatttagacacatacgcaggggaagggactggattggattgggtatatccattacaatgggaggaccaactaccaaccccctccctcaagagtcgagtccaccatatcagtagaccacgtccaaagaacctagttcctccctagaagtctgacgtctctggtcgaccgtcgtcgggaccggaacggaccggtaccgttaatttaacgttcgtggtacggaccgaaaaccgtaaaaccccttaccttacctaacctactacgtacggttcgggacggttcgggtacgggggacgggtaaccggggacctaccggtcctacccgtccttcccgacgacccgccccgttaaccccggaaccggtaacccgggtcccttaaccggttccccggttccccccgtttcccccggtacccggtaccccctacccccgtccccgtaaccgaaccggtacccgcccggttcccggtaccgggggacggggaacccaccgggtacccggggtccccgccgggtcgggtacccgtccggtacccggtaccgtaaccggtaaccttacccgttaccctacctacgtcctaaccgtacgtcggacgggcggnggtacgtacggacggccgacgtagtagnngtncgnnnnnnnnnnnnnnnnnnnnnnnnnnnnnnnnnnnnnnn

SEQ ID NO: 196788 - DNA, 478 bp, Homo sapiens
  misc_feature: GYAE6OF01BI0HM.37.42.D09.1.454.CMB.1.raw
  modified_base (191)..(191): a, c, t, g, unknown or other
  misc_feature (191)..(191): n is a, c, g, or t
  modified_base (455)..(455): a, c, t, g, unknown or other
  misc_feature (455)..(455): n is a, c, g, or t
  modified_base (457)..(478): a, c, t, g, unknown or other
  misc_feature (457)..(478): n is a, c, g, or t
tcagtagtgtagatcacgaccggtgctcgatttagacacatacgcagggaagggactggattggattgggtatatccattacagtgggaggaccaactacaacccctccctcaagagtcgagtcaccatatcagtagacacgtccaagaaccagttctccctgaagctgagctctgtgaccgctgcggacncggccgtatattactgtgcgacgaaaccaacccttctactactacatggacgtcgtgggcgaaggggaccacggtccaccgtcctcctcacgccctccaccgaacgggcccactccggtccttccccccgtcggccacccctcctccaacgcgccacctcggtcggggcacgcgccggccgtcgggctcgccgtcggacacggacttacctacctactctactactactggacggcggcgtggaccgaacgggcgaccgatagnannnnnnnnnnnnnnnnnnnnnn

SEQ ID NO: 196789 - DNA, 459 bp, Homo sapiens
  misc_feature: GYAE6OF01A50FO.37.42.D09.1.454.CMB.1.raw
  modified_base (371)..(371): a, c, t, g, unknown or other
  misc_feature (371)..(371): n is a, c, g, or t
  modified_base (447)..(459): a, c, t, g, unknown or other
  misc_feature (447)..(459): n is a, c, g, or t
tcagtagtgtagatcacgaccggtgctcgatttagacacatacgcagggaagggactggattggattgggtatatccattacagtgggaggaccaactacaacccctccctcaagagtcgagtcaccatatcagtagacacgtccaagaaccagttctccctgaagctgagctctgtgaccgctgcggacacggccgtatattactgtgcgaagaaacccaacccttctaactactacatggacgtcgtggggccaagggggaccacgggtcaccgtctcctcgagcctccgaccaagggcccatccgggtccttccccctcggccacccctcctcccaagacgccacctcgtggggcacgagccggcccngggcctgccctcggtcaacggacgtaccttcccattctacacctactggaggcggcgtgggcgaaggcgcagtagnnnnnnnnnnnnn

SEQ ID NO: 196790 - DNA, 417 bp, Homo sapiens
  misc_feature: GYAE6OF02F2QLX.37.42.D09.1.454.CMB.1.raw
  modified_base (413)..(417): a, c, t, g, unknown or other
  misc_feature (413)..(417): n is a, c, g, or t
tcagtagtgtagatcacgaccggtgctcgatttagacacatacgcagggaagggactggattggattgggtatatccattacagtgggaggaccaactacaacccctccctcaagagtcgagtcaccatatcagtagacacgtccaagaaccagttctccctgaagctgagctctgtgaccgctgcggacacggccgtatattactgtgcgagaaaccaacccttctactactacatggacgtctggggcaaggggaccacggtcaccgtctcctcagcctccaccaagggcccatcggtcttccccctggcaccctcctccaagagcacctctgggggcacagcggccctgggctgcctggtcaaggactacttccatctacactactgagcgggctggcaaggcgcatagnnnnn

SEQ ID NO: 196791 - DNA, 411 bp, Homo sapiens
  misc_feature: GYAE6OF02GYL3M.37.42.D09.1.454.CMB.1.raw
  modified_base (409)..(411): a, c, t, g, unknown or other
  misc_feature (409)..(411): n is a, c, g, or t
tcagtagtgtagatcacgaccggtgctcgatttagacacatacgcagggaaagggactggattggattgggtatatccattacagtgggaggaccaactacaacccctccctcaagagtcgagtcaccatatcagtagacacgtccaagaaccagttctccctgaagctgagctctgtgaccgctgcggacacggccgtatattactgtgcgagaaaccaacccttctactacatggacgtctgggcgaagggacgacggtcaccgtctcctcagcctccaccaaggccactcggtcttccccctcggcaccctcctccaagagcacctctggggcgacagcggccctgggctgcctggtcaaggactacttccatctacactactgagcgggctgcaaggcgcatagnnn

SEQ ID NO: 196792 - DNA, 413 bp, Homo sapiens
  misc_feature: GYAE6OF02FO914.37.42.D09.1.454.CMB.1.raw
  modified_base (403)..(403): a, c, t, g, unknown or other
  misc_feature (403)..(403): n is a, c, g, or t
  modified_base (409)..(413): a, c, t, g, unknown or other
  misc_feature (409)..(413): n is a, c, g, or t
tcagtagtgtagatcacgaccggtgctcgatttagacacatacgcagggaagggactggattggattgggtatatccattacagtgggaggaccaactacaacccctccctcaagagtcgagtcaccatatcagtagacacgtccaagaaccagttctccctgaagctgagctctgtgaccgctgcggacacggccgtatattactgtgcgagaaaccaacccttctactactacatggacgtcgtgggcaaggggaccacggtcaccgtctcctcagcctccaccaagggcccatcggtcttcccctggcaccctcctccagagcacctctggggcacagcggccctgggctgcctggtcaaggctacttccatctacactactgagcgggctggcaaggcncatagnnnnn

SEQ ID NO: 196793 - DNA, 418 bp, Homo sapiens
  misc_feature: GYAE6OF02GMR2O.37.42.D09.1.454.CMB.1.raw
  modified_base (414)..(418): a, c, t, g, unknown or other
  misc_feature (414)..(418): n is a, c, g, or t
tcagtagtgtagatcacgaccggtgctcgatttagacacatacgcagggaaagggactggattggattgggtatatccattacagtgggaggaccaactacaacccctccctcaagagtcgagtcaccatatcagtagacacgtccaagaaccagttctccctgaagctgagctctgtgaccgctgcggacacggccgtatattactgtgcgagaaaccaacccttctactactacatggacgtctggggcaaggggaccacggtcaccgtctcctcagcctccaccaagggcccatcggtcttccccctggcaccctcctccaagagcacctctgggggcacagcggccctgggctgcctggtcaaggactacttccatctacactactgagcgggctggcaaggcgcatagnnnnn

SEQ ID NO: 196794 - DNA, 438 bp, Homo sapiens
  misc_feature: GYAE6OF02G58TP.37.42.D09.1.454.CMB.1.raw
  modified_base (412)..(412): a, c, t, g, unknown or other
  misc_feature (412)..(412): n is a, c, g, or t
  modified_base (418)..(438): a, c, t, g, unknown or other
  misc_feature (418)..(438): n is a, c, g, or t
tcagtagtgtagatcacgaccggtgctcgatttagacacatacgcagggaagggactggattggattgggtatatccattacagtgggaggaccaactacaacccctccctcaagtagtcgagtcaccatatcagtagacacgtccaagaaccagttctccctgaagctgagctctgtgaccgctgccggacacggccgtatattactgtgcgagaaaccaacccttctactactacatggacgtctggggcaaggggccacgggtcaccgtcgtcctcagcctccaccaagggcccatcggtcttccccctggcaccctcctccaagagcacctctgggggcacagcggcccctggggcctgcctggtcaaggctacttccatctacactactgagcgggctggcaaggcncatagnnnnnnnnnnnnnnnnnnnnn

SEQ ID NO: 196795 - DNA, 415 bp, Homo sapiens
  misc_feature: GYAE6OF02I7MWH.37.42.D09.1.454.CMB.1.raw
  modified_base (413)..(415): a, c, t, g, unknown or other
  misc_feature (413)..(415): n is a, c, g, or t
tcagtagtgtagatcacgaccggtgctcgatttagacacatacgcagggaagggactggattggattgggtatatccattacagtgggaggaccaactacaacccctccctcaagagtcgagtcaccatatcagtagacacgtccaagaaccagttctccctgaagctgagctctgtgaccgctgcggacacggccgtatattactgtgcgagaaaccaacccttctactactacatggacgtctggggcaaggggaccacggtcaccgtctcctcagcctccaccaagggccccatcggtcttccccctggcaccctcctccaagagcacctctgggggcacagcggccctgggctgcctggtcaaggactacttccatctacactactgagcggctggcaaggcgcatagnnn

SEQ ID NO: 196796 - DNA, 418 bp, Homo sapiens; identical to SEQ ID NO: 196793
  misc_feature: GYAE6OF02GN9K2.37.42.D09.1.454.CMB.1.raw
  modified_base (414)..(418): a, c, t, g, unknown or other
  misc_feature (414)..(418): n is a, c, g, or t

SEQ ID NO: 196797 - DNA, 418 bp, Homo sapiens
  misc_feature: GYAE6OF02G7DMG.37.42.D09.1.454.CMB.1.raw
  modified_base (413)..(418): a, c, t, g, unknown or other
  misc_feature (413)..(418): n is a, c, g, or t
tcagtagtgtagatcacgaccggtgctcgatttagacacatacgcagggaagggactggattggattgggtatatccattacagtgggaggaccaactacaacccctccctcaagagtcgagtcaccatatcagtagacacgtccaagaaccagttctccctgaagctgagctctgtgaccgctgcggacacggccgtatattactgtgcgagaaaccaaccttctactactacatggacgtctggggcaaggggaccacggtcaccgtctcctcagcctccaccaagggcccatcggtcttcccccctggcaccctcctccaagacgcacctctgggggcacagcggccctgggctgcctggtcaaggctacttccatctacactactgagcgggctggcaaggcgcatagnnnnnn

SEQ ID NO: 196798 - DNA, 439 bp, Homo sapiens
  misc_feature: GYAE6OF02IRUPE.37.42.D09.1.454.CMB.1.raw
  modified_base (184)..(184): a, c, t, g, unknown or other
  misc_feature (184)..(184): n is a, c, g, or t
  modified_base (226)..(226): a, c, t, g, unknown or other
  misc_feature (226)..(226): n is a, c, g, or t
  modified_base (405)..(439): a, c, t, g, unknown or other
  misc_feature (405)..(439): n is a, c, g, or t
tcagtagtgtagatcacgaccggtgctcgatttagacacatacgcaggggaagggactggattggattgggtatatccattacagtgggaggaccaactacaacccctccctcaagagtcgagtcaccatatcagtagacacgtccaagaaccagttctccctgaagctgagctctgtgaccgntgcggacacggccgtatattactgtgcgagaaaccaaccttnactactacatggacgtctgggggcaaggggccaggtcaaccgtctcctcagcctccaccaagggcccatcggtcttccccctggcaccctcctccaagagcacctctggggcacagcgcctggctgctggtcaaggctacttcatctacactactgagcgggctggcaaggcgcatagnnnnnnnnnnnnnnnnnnnnnnnnnnnnnnnnnnn

SEQ ID NO: 196799 - DNA, 416 bp, Homo sapiens
  misc_feature: GYAE6OF02IMFNZ.37.42.D09.1.454.CMB.1.raw
  modified_base (227)..(227): a, c, t, g, unknown or other
  misc_feature (227)..(227): n is a, c, g, or t
  modified_base (410)..(416): a, c, t, g, unknown or other
  misc_feature (410)..(416): n is a, c, g, or t
tcagtagtgtagatcacgaccggtgctcgatttagacacatacgcagggaaagggactggattggattgggtatatccattacagtgggaggaccaactacaacccctccctcaagagtcgagtcaccatatcagtagacacgtccaagaaccagttctccctgaagctgagctctgtgaccgctgcggacacggccgtatattactgtgcgagaaaccaacccttntactactacatggacgtctggggcaaggggaccacggtcaccgtctcctcagcctccaccaaggcccatcggtcttccccctggcaccctcctccaagacgcacctcgtggggcacagcggcctggctgcctggtcaaggactactccatctacactactgagcggctggcaaggcgcatagnnnnnnn

SEQ ID NO: 196800 - DNA, 422 bp, Homo sapiens
  misc_feature: GYAE6OF02F8PZW.37.42.D09.1.454.CMB.1.raw
  modified_base (414)..(422): a, c, t, g, unknown or other
  misc_feature (414)..(422): n is a, c, g, or t
tcagtagtgtagatcacgaccggtgctcgatttagacacatacgcagggaagggactggattggattgggtatatccattacagtgggaggaccaactacaacccctccctcaagagtcgagtcaccatatcagtagacacgtccaagaaccagttctccctgaagctgagctctgtgaccgctgcggacacggccgtatattactgtgcgagaaaccaacccttctactactacatggacgtctggggcaaggggaccacggtcaccgtctcctcagcctccaccaagggccccatcggtcttcccccctggcaccctcctccaagagcacctctgggggcacagcggccctgggctgcctggtcaaggactacttccatctacactactgagcgggctggcaggcgcatagnnnnnnnnn

SEQ ID NO: 196801 - DNA, 473 bp, Homo sapiens
  misc_feature: GYAE6OF02JQKWF.37.42.D09.1.454.CMB.1.raw
  modified_base (218)..(218): a, c, t, g, unknown or other
  misc_feature (218)..(218): n is a, c, g, or t
  modified_base (404)..(404): a, c, t, g, unknown or other
  misc_feature (404)..(404): n is a, c, g, or t
  modified_base (423)..(423): a, c, t, g, unknown or other
  misc_feature (423)..(423): n is a, c, g, or t
  modified_base (431)..(431): a, c, t, g, unknown or other
  misc_feature (431)..(431): n is a, c, g, or t
  modified_base (435)..(435): a, c, t, g, unknown or other
  misc_feature (435)..(435): n is a, c, g, or t
  modified_base (437)..(438): a, c, t, g, unknown or other
  misc_feature (437)..(438): n is a, c, g, or t
  modified_base (441)..(473): a, c, t, g, unknown or other
  misc_feature (441)..(473): n is a, c, g, or t
tcagtagtgtagatcacgaccggtgctcgatttagacacatacgcaggggaaagggacgtggagttgggacttgggtagttatccatttacagtgggagggaccaactacaacccctccctcaagagtcgagtcaccatatcagtagactaggtccaagaaccagttctccctgaagctgtagctctgtgaccgctgcggacacggccgtatattacnggtgcgagaaacccaccttctacgtctacatggactctgggggcaaggggaccacggtcaccgtctcctcagctccaccaagggcccatcggcttccccctggcaccctcctccaacgagcgacctcgtgggggcacagcggccctgggcctgcctggtcaaggactacttccatctacactactnaggcggactggcaagggcncataggcntagntnngcnnnnnnnnnnnnnnnnnnnnnnnnnnnnnnnnn

SEQ ID NO: 196802 - DNA, 421 bp, Homo sapiens
  misc_feature: GYAE6OF02FVA51.37.42.D09.1.454.CMB.1.raw
  modified_base (417)..(421): a, c, t, g, unknown or other
  misc_feature (417)..(421): n is a, c, g, or t
tcagtagtgtagatcacgaccggtgctcgatttagacacatacgcagggaagggactggattggattgggtatatccattacagtgggaggaccaactacaacccctccctcaagagtcgagtcaccatatcagtagacacgtccaagaaccagttctccctgaagctgagctctgtgaccgctgcggacacggccgtatattactgtgcgagaaaccaacccttctactactacatggacgtctggggcaaggggaccacggtcaccgtctcctcagcctccaccaagggccccatcggtcttcccccctggcacccctcctccaagagcacctctgggggcacagcggccctggggctgcctggtcaaggactacttccatctacactactgagcgggctggcaaggcgcatagnnnnn

SEQ ID NO: 196803 - DNA, 438 bp, Homo sapiens
  misc_feature: GYAE6OF02I3JRI.37.42.D09.1.454.CMB.1.raw
  modified_base (413)..(417): a, c, t, g, unknown or other
  misc_feature (413)..(417): n is a, c, g, or t
  modified_base (419)..(438): a, c, t, g, unknown or other
  misc_feature (419)..(438): n is a, c, g, or t
tcagtagtgtagatcacgaccggtgctcgatttagacacatacgcagggaagggactggattggattgggtatatccattacagtgggaggaccaactacaacccctccctcaagagtcgagtcaccatatcagtagacacgtccaagaaccagttctccctgaagctgagctctgtgaccgctgcggacacggccgtatattactgtgcgagaaaccaaccttctactactacatggacgtctgggcaaggggaccacggtcaccgtctcctcagcctccaccaagggcccatcggtcttccccctggcacccctcctccaagagcacctcgtgggggcacagcggccctggggctgcctggcaaggactacttccatctacactactgagcgggctggcaaggcgcatagnnnnnannnnnnnnnnnnnnnnnnnn

SEQ ID NO: 196804 - DNA, 415 bp, Homo sapiens
  misc_feature: GYAE6OF02IR1JO.37.42.D09.1.454.CMB.1.raw
  modified_base (412)..(415): a, c, t, g, unknown or other
  misc_feature (412)..(415): n is a, c, g, or t
tcagtagtgtagatcacgaccggtgctcgatttagacacatacgcagggaagggactggattggattgggtatatccattacagtgggaggaccaactacaacccctccctcaagagtcgagtcaccatatcagtagacacgtccaagaaccagttctccctgaagctgagctctgtgaccgctgcggacacggccgtatattactgtgcgagaaaccaacccttctactactacatggacgtctggggcaaggggaccacggtcaccgtctcctcagcctccaccaagggcccatcggtcttcccccctggcaccctcctccaagagcacctctggggcacagcggccctggcctgcctggtcaaggactacttccatctacactactgagcggctggcaaggcgcatagnnnn

SEQ ID NO: 196805 - DNA, 487 bp, Homo sapiens
  misc_feature: GYAE6OF02IZXPN.37.42.D09.1.454.CMB.1.raw
  modified_base (423)..(423): a, c, t, g, unknown or other
  misc_feature (423)..(423): n is a, c, g, or t
  modified_base (427)..(427): a, c, t, g, unknown or other
  misc_feature (427)..(427): n is a, c, g, or t
  modified_base (433)..(436): a, c, t, g, unknown or other
  misc_feature (433)..(436): n is a, c, g, or t
  modified_base (439)..(439): a, c, t, g, unknown or other
  misc_feature (439)..(439): n is a, c, g, or t
  modified_base (441)..(441): a, c, t, g, unknown or other
  misc_feature (441)..(441): n is a, c, g, or t
  modified_base (443)..(443): a, c, t, g, unknown or other
  misc_feature (443)..(443): n is a, c, g, or t
  modified_base (447)..(447): a, c, t, g, unknown or other
  misc_feature (447)..(447): n is a, c, g, or t
  modified_base (450)..(450): a, c, t, g, unknown or other
  misc_feature (450)..(450): n is a, c, g, or t
  modified_base (453)..(453): a, c, t, g, unknown or other
  misc_feature (453)..(453): n is a, c, g, or t
  modified_base (455)..(455): a, c, t, g, unknown or other
  misc_feature (455)..(455): n is a, c, g, or t
  modified_base (458)..(459): a, c, t, g, unknown or other
  misc_feature (458)..(459): n is a, c, g, or t
  modified_base (461)..(461): a, c, t, g, unknown or other
  misc_feature (461)..(461): n is a, c, g, or t
  modified_base (465)..(476): a, c, t, g, unknown or other
  misc_feature (465)..(476): n is a, c, g, or t
  modified_base (478)..(479): a, c, t, g, unknown or other
  misc_feature (478)..(479): n is a, c, g, or t
  modified_base (481)..(482): a, c, t, g, unknown or other
  misc_feature (481)..(482): n is a, c, g, or t
  modified_base (484)..(486): a, c, t, g, unknown or other
  misc_feature (484)..(486): n is a, c, g, or t
tcagtagtgtagatcacgaccggtgctcgatttagacacatacgcagggaagggactggattggatttgggtatatccattacagtgggaggtaccaactacaacccctccctcaagagtcgagtcaccatatcagtagacacgtccaagaaccagttctccctgaagctgagctctgtgaccgctgcggacacggccgtatattactgtgcgagaaacctaaccctttctactactacatggaacgtctggggcaaggggccacggtcaccgtctcctcaagcctccaccaagggccccatcgtctcccctggcaccctcctccaacgacgcaccgtctgggggcacagcggcctggctgcctggtcaaggactactccatctacactactgacgcgggctggcgaaaggcgacgataggcngacntacgcnnnnatncncncacncgnagngngannanacannnnnnnnnnnncnncnncnnnc

SEQ ID NO: 196806 - DNA, 420 bp, Homo sapiens
  misc_feature: GYAE6OF02H5ZPQ.37.42.D09.1.454.CMB.1.raw
  modified_base (410)..(420): a, c, t, g, unknown or other
  misc_feature (410)..(420): n is a, c, g, or t
tcagtagtgtagatcacgaccggtgctcgatttagacacatacgcagggaagggactggattggattgggtatatccattacagtgggaggaccaactacaacccctccctcaagagtcgagtcaccatatcagtagacacgtccaagaaccagttctccctgaagctgagctctgtgaccgctgcggacacggccgtatattactgtgcgagaaaccaacccttctactactacatggacgtctggggcaaggggaccacggtcaccgtctcctcagcctccaccaagggcccatcggtcttccccctggcaccctcctccaagagcacctctggggcacagcggcctgggctgcctggtcaaggactactcatctacactactgagcggctggcaaggcgcaatacgnnnnnnnnnnn

SEQ ID NO: 196807 - DNA, 420 bp, Homo sapiens
  misc_feature: GYAE6OF02H8FCH.37.42.D09.1.454.CMB.1.raw
  modified_base (191)..(191): a, c, t, g, unknown or other
  misc_feature (191)..(191): n is a, c, g, or t
  modified_base (403)..(403): a, c, t, g, unknown or other
  misc_feature (403)..(403): n is a, c, g, or t
  modified_base (409)..(420): a, c, t, g, unknown or other
  misc_feature (409)..(420): n is a, c, g, or t
tcagtagtgtagatcacgaccggtgctcgatttagacacatacgcagggaagggactggattggattgggtatatccattacagtgggaggaccaactacaacccctccctcaagagtcgagtcaccatatcagtagacacgtccaagaaccagttctccctgaagctgagctctgtgaccgctgcggacncggccgtatattactgtgcgagaaaccaacccttctactactacatggactctggggcaaggggaccacggtcaccgtctcctcagcctccaccaaggcccatcggtcttccccctggcacccctcctccaagagcacctctggggcacagcggccctgggctgcctggtcaaggactacttccatctacactactgagcggctggcaggcncatagnnnnnnnnnnnn

SEQ ID NO: 196808 - DNA, 436 bp, Homo sapiens
  misc_feature: GYAE6OF02I10WX.37.42.D09.1.454.CMB.1.raw
  modified_base (183)..(183): a, c, t, g, unknown or other
  misc_feature (183)..(183): n is a, c, g, or t
  modified_base (206)..(206): a, c, t, g, unknown or other
  misc_feature (206)..(206): n is a, c, g, or t
  modified_base (405)..(405): a, c, t, g, unknown or other
  misc_feature (405)..(405): n is a, c, g, or t
  modified_base (423)..(423): a, c, t, g, unknown or other
  misc_feature (423)..(423): n is a, c, g, or t
  modified_base (428)..(436): a, c, t, g, unknown or other
  misc_feature (428)..(436): n is a, c, g, or t
tcagtagtgtagatcacgaccggtgctcgatttagacacatacgcagggaagggactggattggattgggtatatccattacagtgggaggaccaactacaacccctccctcaagagtcgagtcaccatatcagtagacacgtccaagaaccagttctccctgaagctgagctctgtgaccgntgcggacacggccgtatattacngtgcgagaaaccaacccttctactactacatggacgtctggggcaaggggaccacggtcaccgtctcctcagcctccaccaacggcccatcggtcttccccctggccacccctcctaccaagacgccaccctcgtggggccacgacgccggcccgtgggcgtcgccgtcggtcaaaggcctacttccactctacactcngagcggctggcgaaggcnatagnnnnnnnnn

SEQ ID NO: 196809 - DNA, 425 bp, Homo sapiens
  misc_feature: GYAE6OF02H1MAA.37.42.D09.1.454.CMB.1.raw
  modified_base (226)..(226): a, c, t, g, unknown or other
  misc_feature (226)..(226): n is a, c, g, or t
  modified_base (383)..(383): a, c, t, g, unknown or other
  misc_feature (383)..(383): n is a, c, g, or t
  modified_base (411)..(425): a, c, t, g, unknown or other
  misc_feature (411)..(425): n is a, c, g, or t
tcagtagtgtagatcacgaccggtgctcgatttagacacatacgcagggaagggactggattggattgggtatatccattacagtgggaggaccaactacaacccctccctcaagagtcgagtcaccatatcagtagacacgtccaagaaccagttctccctgaagctgagctctgtgaccgctgcggacacggccgtatattactgtgcgagaaaccaacccttntactactacatggacgtcgtggggcaaggggaccacggtcaccgtctcctcagcctccaccaagggcccatcggtcttccccctggcacccctcctccaagagcacctctggggcacagcggcctgggctgcctggtcaaggactacttcatctacnctactgagcggctggcaaggcgcatagnnnnnnnnnnnnnnn

SEQ ID NO: 196810 - DNA, 419 bp, Homo sapiens
  misc_feature: GYAE6OF02IKAP6.37.42.D09.1.454.CMB.1.raw
  modified_base (416)..(419): a, c, t, g, unknown or other
  misc_feature (416)..(419): n is a, c, g, or t
tcagtagtgtagatcacgaccggtgctcgatttagacacatacgcagggaagggactggattggattgggtatatccattacagtgggaggaccaactacaacccctccctcaagagtcgagtcaccatatcagtagacacgtccaagaaccagttctccctgaagctgagctctgtgaccgctgcggacacggccgtatattactgtgcgagaaaccaacccttctactactacatggacgtctggggcaaggggaccacggtcaccgtctcctcagcctccaccaagggcccatcggtcttcccccctggccaccctcctccaagacgcacctctgggggcacacgcggccctgggctgcctggtcaaggctacttccatctacactactgagcgggctggcaaggcgcatagnnnn

SEQ ID NO: 196811 - DNA, 425 bp, Homo sapiens
  misc_feature: GYAE6OF02I8GTH.37.42.D09.1.454.CMB.1.raw
  modified_base (400)..(400): a, c, t, g, unknown or other
  misc_feature (400)..(400): n is a, c, g, or t
  modified_base (416)..(425): a, c, t, g, unknown or other
  misc_feature (416)..(425): n is a, c, g, or t
tcagtagtgtagatcacgaccggtgctcgatttagacacatacgcagggaaagggactggattggattgggtatatccattacagtgggaggaccaactacaacccctcctcaagagtcgagtcaccatatcagtagacacgtccaagaaccagttctccctgaagctgagctctgtgaccgctgcggacacggccgtatattactgtgcgagaaaccaacccttctactactacatggacgtctggggcaaggggaccacggtcacccgtctcctcagcctccaccaagggcccatcggtccttccccctggcacccctcctccaacgagcaacctcgtcgggggcacgagcgccctgggctgcctggtcaggactacgttccatctacactactgagnggctgcaggcgcatannnnnnnnnn

SEQ ID NO: 196812 - DNA, 429 bp, Homo sapiens
  misc_feature: GYAE6OF02G1BBM.37.42.D09.1.454.CMB.1.raw
  modified_base (308)..(308): a, c, t, g, unknown or other
  misc_feature (308)..(308): n is a, c, g, or t
  modified_base (416)..(429): a, c, t, g, unknown or other
  misc_feature (416)..(429): n is a, c, g, or t
tcagtagtgtagatcacgaccggtgctcgatttagacacatacgcagggaagggactggattggattgggtatatccattacagtgggaggaccaactacaacccctccctcaagagtcgagtcaccatatcagtagacacgtccaagaaccagttctccctgaagctgagctctgtgaccgctgcggacacggccgtatattactgtgcgagaaaccaacccttctactactacatggacgtctggggcaaggggaccacggtcaccgtctcctcagcctccaccaagggcccatcggtcttccccnggccaccctcctccaacgagccacctcgtcgggggcacagcggccctgggctgcctggtcaaggactacttccatctacactactgagcggctggcaaggcgcatagnnnnnnnnnnnnnn

SEQ ID NO: 196813 - DNA, 488 bp, Homo sapiens
  misc_feature: GYAE6OF02HMLP4.37.42.D09.1.454.CMB.1.raw
  modified_base (452)..(456): a, c, t, g, unknown or other
  misc_feature (452)..(456): n is a, c, g, or t
  modified_base (458)..(488): a, c, t, g, unknown or other
  misc_feature (458)..(488): n is a, c, g, or t
tcagtagtgtagatcacgaccggtgctcgatttagacacatacgcagggaagggactggattggattgggtatatccattacagtgggaggaccaactacaacccctccctcaagagtcgagtcaccatatcagtagacacgtccaagaaccagttctccctgaagctgagctctgtgaccgctgcggacacggccgtatattactgtgcgagaaaccacccttctactactacatggacgtcgtggggcaaggggaccacggtcaccgtctcctcagcctccaccaagggcccatcggtcttccccctggcacccctcctccaacgagccaccctcgtcgggggcacgacggccggccccgtggggcctgcccgttggtccaaagggtacctacgtttcccattcctactacctactcgagccgggtactcggacgaaggccgcaagtagnnnnncnnnnnnnnnnnnnnnnnnnnnnnnnnnnnnn

SEQ ID NO: 196814 - DNA, 427 bp, Homo sapiens
  misc_feature: GYAE6OF02HJSOT.37.42.D09.1.454.CMB.1.raw
  modified_base (397)..(397): a, c, t, g, unknown or other
  misc_feature (397)..(397): n is a, c, g, or t
  modified_base (412)..(427): a, c, t, g, unknown or other
  misc_feature (412)..(427): n is a, c, g, or t
tcagtagtgtagatcacgaccggtgctcgatttagacacatacgcagggaagggactggattggattgggtatatccattacagtgggaggaccaactacaacccctccctcaagagtcgagtcaccatatcagtagacacgtccaagaaccagttctccctgaagctgagctctgtgaccgctgcggacacggccgtatattactgtgcgagaaaccaacccttctaactactacatggacgtctggggcaaggggaccacggtcaccgtctcctcagcctccaccaagggcccatcggtcttccccctggcaccctcctccaagagcacctctgggggcacagcggccctgggctgcctggcaaggactacttccatctacactactgagcgggntggcaggcgcatagnnnnnnnnnnnnnnnn

SEQ ID NO: 196815 - DNA, 480 bp, Homo sapiens
  misc_feature: GYAE6OF02FH0I1.37.42.D09.1.454.CMB.1.raw
  modified_base (208)..(208): a, c, t, g, unknown or other
  misc_feature (208)..(208): n is a, c, g, or t
  modified_base (432)..(433): a, c, t, g, unknown or other
  misc_feature (432)..(433): n is a, c, g, or t
  modified_base (435)..(435): a, c, t, g, unknown or other
  misc_feature (435)..(435): n is a, c, g, or t
  modified_base (441)..(441): a, c, t, g, unknown or other
  misc_feature (441)..(441): n is a, c, g, or t
  modified_base (444)..(449): a, c, t, g, unknown or other
  misc_feature (444)..(449): n is a, c, g, or t
  modified_base (451)..(480): a, c, t, g, unknown or other
  misc_feature (451)..(480): n is a, c, g, or t
tcagtagtgtagatcacgaccggtgctcgattttagacacatacgcagggaagggactggattggattgggtatatccattacagtgggaggacccaactacaacccctccctcaagagtcgagtcaccatatcagtagacacgtccaagaaccagttctccctgaagctgagctctgtgaccgctgcggacacggccgtatattacngtgcgagaaacccaccgttctactactacatggacgtctgggggacaaggggcccacggtccaccgtctcctcagcctccaccaagggccccatcggtcttccccccgtggccaccctccctccaacgacgcacctcgtggggggcacgagccggccctgggctgcctggtcaaggactacttccatctacactactgagcgggctggcgaaggcgacatagtnnancatcanagnnnnnnannnnnnnnnnnnnnnnnnnnnnnnnnnnnn

SEQ ID NO: 196816 - DNA, 426 bp, Homo sapiens
  misc_feature: GYAE6OF02FMCB2.37.42.D09.1.454.CMB.1.raw
  modified_base (415)..(426): a, c, t, g, unknown or other
  misc_feature (415)..(426): n is a, c, g, or t
tcagtagtgtagatcacgaccggtgctcgatttagacacatacgcagggaagggactggattggattgggtatatccattacagtgggaggaccaactacaacccctccctcaagagtcgagtcaccatatcagtagacacgtccaagaaccagttctccctgaagctgagctctgtgaccgctgcggacacggccgtatattactgtgcgagaaaccaacccttctactactacatggacgtctggggcaaggggaccacggtcaccgtctcctcagcctccaccaagggccccatcggtcttccccctggcaccctcctccaagagcacctctgggggcacagcggccctggggctgcctggtcaaggactacttccatctacactactgagcgggctggcaaggcgcatagnnnnnnnnnnnn

SEQ ID NO: 196817 - DNA, 698 bp, Homo sapiens
  misc_feature: GYAE6OF02JWN81.37.42.D09.1.454.CMB.1.raw
  modified_base (643)..(643): a, c, t, g, unknown or other
  misc_feature (643)..(643): n is a, c, g, or t
  modified_base (647)..(647): a, c, t, g, unknown or other
  misc_feature (647)..(647): n is a, c, g, or t
  modified_base (656)..(656): a, c, t, g, unknown or other
  misc_feature (656)..(656): n is a, c, g, or t
  modified_base (658)..(659): a, c, t, g, unknown or other
  misc_feature (658)..(659): n is a, c, g, or t
  modified_base (662)..(662): a, c, t, g, unknown or other
  misc_feature (662)..(662): n is a, c, g, or t
  modified_base (664)..(664): a, c, t, g, unknown or other
  misc_feature (664)..(664): n is a, c, g, or t
  modified_base (666)..(667): a, c, t, g, unknown or other
  misc_feature (666)..(667): n is a, c, g, or t
  modified_base (669)..(669): a, c, t, g, unknown or other
  misc_feature (669)..(669): n is a, c, g, or t
  modified_base (671)..(671): a, c, t, g, unknown or other
  misc_feature (671)..(671): n is a, c, g, or t
  modified_base (673)..(674): a, c, t, g, unknown or other
  misc_feature (673)..(674): n is a, c, g, or t
  modified_base (676)..(694): a, c, t, g, unknown or other
  misc_feature (676)..(694): n is a, c, g, or t
  modified_base (696)..(698): a, c, t, g, unknown or other
  misc_feature (696)..(698): n is a, c, g, or t
tcagtagtgtagatcacgaccggtgctcgatttagacacatacgcagggaaagggactggattggattgggtatatccattacagtgggaggaccaactacaacccctccctcaagagtcgagtcaccatatcagtagacagtccaagaaccagttctccctgaagctgagctctgtgaccgctcggcggacaccggccgttatatttactgtgcgtaacgaaaaccctaacccttctaactacttaacagttacgggaaccgttccgtaggggggaccaaacgggggggtaccctaacgggttccaaccccggttccgttcccgttaccgacggtaccccttaccccgaaccgtaaaccggggaccccaaacgttcccggggttccctttccccccccggttcggtccccgtaccccccgttacccctccccgtaaaaccggaccggacctaccccgtaccgtccgggggggccctaaccggtaccgggcccgggtaccccggtcgggggtcctccggtcccgtcggggttaccaaacggggtaaccttacccgttaccgacgtttacccaacgttaaccctaagtccggaacgggtccgggtacgtcgggtaccgaacggggcctaacggacgtaagcgancgtngcagctagncnnctncncnncncngnngnnnnnnnnnnnnnnnnnnncnnn

SEQ ID NO: 196818 - DNA, 430 bp, Homo sapiens
  misc_feature: GYAE6OF02F4EOU.37.42.D09.1.454.CMB.1.raw
  modified_base (419)..(430): a, c, t, g, unknown or other
  misc_feature (419)..(430): n is a, c, g, or t
tcagtagtgtagatcacgaccggtgctcgatttagacacatacgcagggaaagggactggattggattgggtatatccattacagtgggaggaccaactacaacccctccctcaagagtcgagtcaccatatcagtagacacgtccaagaaccagttctccctgaagctgagctctgtgaccgctgcggacacggccgtatattactgtgcgagaaaccaacccttctaactactacatggacgtctggggcaaggggaccacggtcaccgtctcctcagcctccaccaagggccccatcggtcttcccccctggcacccctcctccaagagccacctctggggcacgagcggcccgtggctgccgtggtcaaggactacttccatctacactactgagcggctggcgaggcgcatagnnnnnnnnnnnn

SEQ ID NO: 196819 - DNA, 420 bp, Homo sapiens
  misc_feature: GYAE6OF02FMTJU.37.42.D09.1.454.CMB.1.raw
  modified_base (415)..(420): a, c, t, g, unknown or other
  misc_feature (415)..(420): n is a, c, g, or t
tcagtagtgtagatcacgaccggtgctcgatttagacacatacgcagggaagggactggattggattgggtatatccattacagtgggaggaccaaactacaacccctccctcaagagtcgagtcaccatatcagtagacacgtccaaagaaccagttctccctgaagctgagctctgtgaccgctgcggacacggcctatattactgtgcgagaaaaccaacccttctactactacatggacgtctggggcaaggggaccacggtcaccgtctcctcagcctccaccaagggcccatcggtcttccccctggcaccctcctccaagagcacctctgggggcacgagcggccctgggctgcctggtcaaggctacttccatctacactactgagcgggctggcaaggcgcatagnnnnnn

SEQ ID NO: 196820 - DNA, 463 bp, Homo sapiens
  misc_feature: GYAE6OF02GUD3N.37.42.D09.1.454.CMB.1.raw
  modified_base (183)..(183): a, c, t, g, unknown or other
  misc_feature (183)..(183): n is a, c, g, or t
  modified_base (333)..(333): a, c, t, g, unknown or other
  misc_feature (333)..(333): n is a, c, g, or t
  modified_base (415)..(415): a, c, t, g, unknown or other
  misc_feature (415)..(415): n is a, c, g, or t
  modified_base (427)..(463): a, c, t, g, unknown or other
  misc_feature (427)..(463): n is a, c, g, or t
tcagtagtgtagatcacgaccggtgctcgatttagacacatacgcagggaagggactggattggattgggtatatccattacagtgggaggaccaactacaacccctccctcaagagtcgagtcaccatatcagtagacacgtccaagaaccagttctccctgaagctgagctctgtgaccgntgcggacacggccgtatattactgtgcgaagaaaccaacccttctaactactacatggacgtcgtgggggcaaaggggaccacggtcaccgtcgtcctcagcctccaccaaggccatcgtcttcccctgcaccctcctccagacgcaccnctggggcacagcgccgtgggctgcctggtcaaggacctacgtccatcctacactatagaggacgggcgtggcaagggtccgngtaaacgtagannnnnnnnnnnnnnnnnnnnnnnnnnnnnnnnnnnnn

SEQ ID NO: 196821 - DNA, 575 bp, Homo sapiens
  misc_feature: GYAE6OF02FPO9G.37.42.D09.1.454.CMB.1.raw
  modified_base (215)..(215): a, c, t, g, unknown or other
  misc_feature (215)..(215): n is a, c, g, or t
  modified_base (464)..(464): a, c, t, g, unknown or other
  misc_feature (464)..(464): n is a, c, g, or t
  modified_base (515)..(516): a, c, t, g, unknown or other
  misc_feature (515)..(516): n is a, c, g, or t
  modified_base (518)..(518): a, c, t, g, unknown or other
  misc_feature (518)..(518): n is a, c, g, or t
  modified_base (521)..(522): a, c, t, g, unknown or other
  misc_feature (521)..(522): n is a, c, g, or t
  modified_base (524)..(525): a, c, t, g, unknown or other
  misc_feature (524)..(525): n is a, c, g, or t
  modified_base (527)..(530): a, c, t, g, unknown or other
  misc_feature (527)..(530): n is a, c, g, or t
  modified_base (533)..(533): a, c, t, g, unknown or other
  misc_feature (533)..(533): n is a, c, g, or t
  modified_base (536)..(536): a, c, t, g, unknown or other
  misc_feature (536)..(536): n is a, c, g, or t
  modified_base (538)..(538): a, c, t, g, unknown or other
  misc_feature (538)..(538): n is a, c, g, or t
  modified_base (541)..(541): a, c, t, g, unknown or other
  misc_feature (541)..(541): n is a, c, g, or t
  modified_base (544)..(544): a, c, t, g, unknown or other
  misc_feature (544)..(544): n is a, c, g, or t
  modified_base (551)..(551): a, c, t, g, unknown or other
  misc_feature (551)..(551): n is a, c, g, or t
  modified_base (554)..(561): a, c, t, g, unknown or other
  misc_feature (554)..(561): n is a, c, g, or t
  modified_base (563)..(565): a, c, t, g, unknown or other
  misc_feature (563)..(565): n is a, c, g, or t
  modified_base (567)..(569): a, c, t, g, unknown or other
  misc_feature (567)..(569): n is a, c, g, or t
  modified_base (571)..(573): a, c, t, g, unknown or other
  misc_feature (571)..(573): n is a, c, g, or t
tcagtagtgtagatcacgaccggtgctcgatttagacacatacgcagggaagggactgattggattgggtatatccattacagtgggaggaccaaactacaacccctccctcaagagtcgagtcaccatatcagtagacacgtccaagaaccagttcctccctagaagctgagctctgtgaccgctgcggacacggccgtatattactgtgcganaacctaacccttctactactacagtcggacgtcgtggggacgaacggggaccgaccggtccaccgtcctcctcagcctaccaccgaacgggcccgactccggtcctttccccccgtggccctacccctcctccaacgtacgccaccctccggttcgggggccacgacgcccggcccgtcggggcgttcgccgtacggtaccgaaacggtaccttaccttccaaccttccaaccttacttaccgtacggngggcccggggtccgtacgggaccggtacgggtacgctaacgtaggactgcnncnganncnncnnnncgntgntnganacncacgcanacnnnnnnnnannncnnncnnncg

SEQ ID NO: 196822 - DNA, 585 bp, Homo sapiens
  misc_feature: GYAE6OF02JK549.37.42.D09.1.454.CMB.1.raw
  modified_base (355)..(355): a, c, t, g, unknown or other
  misc_feature (355)..(355): n is a, c, g, or t
  modified_base (457)..(457): a, c, t, g, unknown or other
  misc_feature (457)..(457): n is a, c, g, or t
  modified_base (463)..(463): a, c, t, g, unknown or other
  misc_feature (463)..(463): n is a, c, g, or t
  modified_base (469)..(469): a, c, t, g, unknown or other
  misc_feature (469)..(469): n is a, c, g, or t
  modified_base (473)..(473): a, c, t, g, unknown or other
  misc_feature (473)..(473): n is a, c, g, or t
  modified_base (499)..(499): a, c, t, g, unknown or other
  misc_feature (499)..(499): n is a, c, g, or t
  modified_base (508)..(508): a, c, t, g, unknown or other
  misc_feature (508)..(508): n is a, c, g, or t
  modified_base (580)..(580): a, c, t, g, unknown or other
  misc_feature (580)..(580): n is a, c, g, or t
  modified_base (583)..(583): a, c, t, g, unknown or other
  misc_feature (583)..(583): n is a, c, g, or t
tcagtagtgtagatcacgaccggtgctcgatttagacacatacgcagggaagggactggattggattgggtatatccattacagtgggaggaccaactacaacccctcctcaagagtcgagtcaccatatcagtagacacgtccaagaaccagttcctcctgaagctgagctctcgtgaccgcgtgcggacacggccgtatattactgtacgcgaacgaaacctacccttctactactacatcggacgtcgtcggggacgtaaggggaccacggtcaccgtcctctacgacgcctaccgaaccgacggacctagtccggtcccttccccgtcgaccacccgtccgtacaacgacnccactcggtacgggcacgcgccgccgtcggctcgccgtcggtacgaacgtacttactaccgatactacaccgtacgtggacgcggcgtgacgtacgccgtanagcganctacgnacgnacgtactgtcaatcgctcggccgtancgacgtacncacgtacacgactacgtacgtcgacgacgcgtacgaagtacgtacgacgaccgtcgtactacgacacgtcgngcncg

SEQ ID NO: 196823 - DNA, 520 bp, Homo sapiens
  misc_feature: GYAE6OF01B9M81.39.81.H04.1.454.CMB.1.raw
tcagtcgcactagtcacgaccggtgctcgatttagtagtgtagattcgcggggacccaaaaccacacccctccttgggagaatcccctagatcacagctcctcaccatggactggacctggagcatcctttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatggggatggatcagcgcttacaatggtcacacaaactatgcacagaacctccagggcagagtcaccatgaccacagacacatccacgagcacggcctacatggacctgaggagcctgagatctgacgacacggccgtgtacttactgtgcgagagatcggggaaatgtttgacttggtaccctctttgacttacgtggggcctagggaccctcggg

SEQ ID NO: 196824 - DNA, 609 bp, Homo sapiens
  misc_feature: GYAE6OF01BK6LZ.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggccctggacaagggcttgagtggatgggatggatcagcgcttacaatggtcacacaaactatgcacagaacctccaggcagagtcaccatgaaccacagacacactccaacgacgacacggcctaacactacggacctggaacgggacaccgtagagtagtcctacggaaccgaacgaaccgggccgtagttaatttaccgtggttacgccggaaggtaacgagttaaccgggggtaaaattacgttttaggaccgtttacgggtacccctttagtttacgtacgttaaccgtacggggacccgtaacgggggtaaccccgttacggg

SEQ ID NO: 196825 - DNA, 532 bp, Homo sapiens
  misc_feature: GYAE6OF01EM97B.39.81.H04.1.454.CMB.1.raw
  modified_base (498)..(498): a, c, t, g, unknown or other
  misc_feature (498)..(498): n is a, c, g, or t
tcagtcgcactagtcacgaccggtgctcgatttagtagtgtagattcgcgggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggccctggacaagggcttgagtggatgggatggatcagcgcttaacaatggtacacaacaaaactatgcacagaacctccagggcagagtcaccatgaaccacagacacatccacgagacacgacctacatggacctggagagcctgagatcgtagacgacgacggcgtagtattactgtgcgagagagtacgggaaattagtttgacttggtaccctntttacgacttacgtgggaccagggtacccgtcgg

SEQ ID NO: 196826 - DNA, 512 bp, Homo sapiens
  misc_feature: GYAE6OF01BNF1Y.39.81.H04.1.454.CMB.1.raw
  modified_base (487)..(487): a, c, t, g, unknown or other
  misc_feature (487)..(487): n is a, c, g, or t
tcagtcgcactagtcacgaccggtgctcgatttagtagtgtagattcgcggggacccaaaaccacacccctccttgggagaatcccctagatcacagctcctcaccatggactggacctggagcatcctttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactatgcacagaacctccagggcagagtcaccatgaccacagacacatccacgagcacggctacatggacctgaggagcctgagatctgacgacacggccgtgtattactgtgcgtagagatacggggaaatagtttgactggtaccctnttgactactgggccagggaccctgg

SEQ ID NO: 196827 - DNA, 534 bp, Homo sapiens
  misc_feature: GYAE6OF01CFLAP.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactatgcacagaacctcagggcagagtcaccatgaccacagacacatccacgagcacggcctacatggacctgaggagcctgagatctagacgacgacggcgtgtacttactgtgcgagagagtacggggaaattagtttagacttggtacccttcgtttacgacttacggtcgggtccagggtaccccgtcggg

SEQ ID NO: 196828 - DNA, 616 bp, Homo sapiens
  misc_feature: GYAE6OF01AW76M.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggccctggacaagggcttgagtggatgggatggatcgagcgcttacaagtggtacacacaactatgacacagacctcgagggcagacgtcaccatcgaaccacagacacactaccacgagacgaccggcctaacacgtcggacctaggaggacgcctaggaacgactccgtaggaaccggaccgacccgggtacgttacgttatttaaccgtggtacggacggaaggacggtaggtaacggggtaaatttggttttacgacgtttcgggttaaccccttgtttacggtaaccgttacgggtacgggggacccgtaacggggtaaccccgttcgggg

SEQ ID NO: 196829 - DNA, 549 bp, Homo sapiens
  misc_feature: GYAE6OF01CI16E.39.81.H04.1.454.CMB.1.raw
  modified_base (214)..(214): a, c, t, g, unknown or other
  misc_feature (214)..(214): n is a, c, g, or t
  modified_base (274)..(274): a, c, t, g, unknown or other
  misc_feature (274)..(274): n is a, c, g, or t
  modified_base (345)..(345): a, c, t, g, unknown or other
  misc_feature (345)..(345): n is a, c, g, or t
  modified_base (351)..(351): a, c, t, g, unknown or other
  misc_feature (351)..(351): n is a, c, g, or t
  modified_base (360)..(360): a, c, t, g, unknown or other
  misc_feature (360)..(360): n is a, c, g, or t
  modified_base (373)..(373): a, c, t, g, unknown or other
  misc_feature (373)..(373): n is a, c, g, or t
  modified_base (396)..(396): a, c, t, g, unknown or other
  misc_feature (396)..(396): n is a, c, g, or t
  modified_base (416)..(416): a, c, t, g, unknown or other
  misc_feature (416)..(416): n is a, c, g, or t
  modified_base (437)..(437): a, c, t, g, unknown or other
  misc_feature (437)..(437): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctnagtgaaggtctcctgcaaggcttctggttacacctttaccaatatggtatcagttggtgngacaggccctggacgaagggcttgagtggatgggatggatcgagcgcttacaagtggcaacaacaaaactntgacanaacgaaccnccgagggacagancaaccatcgaaccagagacacanccagagacacggccaacgancggactaggagagcctagganagtcagacgacgcggaccgttgtattacgtgtgtaggagagtaggtacggtaaattgtttgaacttcggtacccttgtttagactacggtggggcctaaagggacccttggg

SEQ ID NO: 196830 - DNA, 649 bp, Homo sapiens
  misc_feature: GYAE6OF01CMBY0.39.81.H04.1.454.CMB.1.raw
  modified_base (343)..(343): a, c, t, g, unknown or other
  misc_feature (343)..(343): n is a, c, g, or t
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacaggccctggacaagggcttggagtggatgggatggatcagcgcttacaatggtcacacaaactntgcacacgaacctccgagggcaggagtcaaccatcgaccacacgacacactaccacgacgacgaccggacctaacgacgttacgggaaccgttaggaacgggacgtacccgtaggacgtacgtcgtacggaaccggaaccgacccgggtaccgttagttaacgttacgtggtacggacggaaggtaacggtacggttaccgggggtaaaattttaggttttacggtaaccgtttaccggttacccctttacgttttacggaaccgtttaccgggcgggggtaacccgtaacggggtaaacccccgg

SEQ ID NO: 196831 - DNA, 553 bp, Homo sapiens
  misc_feature: GYAE6OF01C0HLC.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactatgcacagaacctccaggcagagtcacatgaccacagacacactccacgacgcacggcctaacatcgggacctggacggagccgtgacgtataccgtgaacgaccgacgggtccgtagtattacgtgtcgcgagagagtacggggaaattagtttgacgttggtaccccttgtttacgaccttacggtgggaccgaggggtaccctacggg

SEQ ID NO: 196832 - DNA, 510 bp, Homo sapiens
  misc_feature: GYAE6OF01B9VJJ.39.81.H04.1.454.CMB.1.raw
  modified_base (401)..(401): a, c, t, g, unknown or other
  misc_feature (401)..(401): n is a, c, g, or t
  modified_base (504)..(504): a, c, t, g, unknown or other
  misc_feature (504)..(504): n is a, c, g, or t
tcagtcgcactagtcacgaccggtgctcgatttagtagtgtagattcgcggggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacacctacttgaattggtttcagcagaggccaggccaatctccaaggcgacctaatttataaggtttctaaccgggactcgtggggtcccagacagattcagcggcagtggtcaggcactgaatcacactgaaatcagcaggtggagcgtgagngtgttgggtttatacgtgcatgacaagaacacacgtgacctcgtactacgttcggcgacgggaccagcgtaggacgtatacgaaacgagtgagctagacactntcgtcg

SEQ ID NO: 196833 - DNA, 581 bp, Homo sapiens
  misc_feature: GYAE6OF01BCAQW.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactatgcacagaacctccgagggcagagtcaccatgaccacagacacatccacgacgcacggcctacatcggaccgtgaggacgccgtgacgatctaggacgaccgacggccgttagtacttacgtgtgcggagagacgtacggggtaaattagttttaggacgttcgggttaaccccttcgttttacggtaaccgttaccggtacgggggtacccgtaacgggggtaaccccgttacgggg

SEQ ID NO: 196834 - DNA, 558 bp, Homo sapiens
  misc_feature: GYAE6OF01BDBGQ.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcgagcgcttacaatggtcacacaaactatgcacagaacctccgagggcagagtcaccatcgaccacagacacatccacgagcacggcctacatcggacctggacgacgctgagatcgtgacgacgacggccgtagtacttacgtgtgcgagagagtacggggaaattagttttaggacgttcgggttaccccttcgtttacgtaccttacggtacggggccctaaggggtacccctacgggg

SEQ ID NO: 196835 - DNA, 623 bp, Homo sapiens
  misc_feature: GYAE6OF01BQVF7.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttggtgcgacaggccctggacaagggcttggagtggatgggatggatcgagcgtcttacaagtggtacaacaacaaactatcgacaacaagaaccctccgaaggggcaagacgtacaccatcgaaccacacgacacataccacgagcacggcctacacgtggacctggaacggacgccgtagagtatcgtaggaaccgacgaccggtccgttagtacgttaacgtggtacgacggaaggtaaggacggttaacgggggaaaatttacggttttacggaacgttaccgggttaccccttacgttttacgaaccgtttacggtacgggggacccgtaacggggtaaccccgttcggg

SEQ ID NO: 196836 - DNA, 619 bp, Homo sapiens
  misc_feature: GYAE6OF01C1725.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacaggcccctggacaagggcttggagtggatgggatgggatcagcgcttacaatggtacacgaacaaactatgacaacaacgaaacctcgagggcagagtcaccatcgacacagacacactccaagacgaccaccggccttaacaagttcgggaacccttggaacggacgccgtaggaacgtactcgtggtaaccgaaccgaccgggtcccgttagtactttacgtgtcggacgaaggacgaagttaacgggggaaatttacggttttagaccttacgggtttaccccttgttttacgaccgttaaccggtgggggacccctaaggggtaccccgttacgggg

SEQ ID NO: 196837 - DNA, 539 bp, Homo sapiens
  misc_feature: GYAE6OF01EQMYI.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatggggatggatcgagcgcttacaatggtcacacaactatgcacagaacctcagggcagagtcaccatcgaccacagacacatccacgagcacgcctacatgacctgaggagcctgagatctgacgacgacggcgtagtattactgtgcgagagagtacggggtaatagtttagacgttcgggttacccttacgtttacgacgttacgtggggaccgtacgggtacccgtcggg

SEQ ID NO: 196838 - DNA, 528 bp, Homo sapiens
  misc_feature: GYAE6OF01EAINO.39.81.H04.1.454.CMB.1.raw
  modified_base (495)..(495): a, c, t, g, unknown or other
  misc_feature (495)..(495): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatgggatcagcgcttacaatggtcacacaaactatgcacagaacctcagggcagagtcaccatgaccacagacacatccacgagcacggcctacatggacctgaggagcctgagatcgtgacgacaccggccgtgtattactgtgcgagagagtcggggaaattagttttagacttggtaccctntttagactacgtggggaccagggacccgtcggg

SEQ ID NO: 196839 - DNA, 551 bp, Homo sapiens
  misc_feature: GYAE6OF01DFYAF.39.81.H04.1.454.CMB.1.raw
  modified_base (391)..(391): a, c, t, g, unknown or other
  misc_feature (391)..(391): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagacgacgaagcctggggccgtcagtgaaggtctcctgcaaggcttctggttacacctttaccaactatggtatcagttgggtgtcgacacggccccgtggacaaggggacttgagtggatggggatggatcagcgcgttacaatggtcacacaaactatgcacagaacctccaggcagagtcaccatgaccacagacncactccacgaagcaccggactaccaatcggacctgaggagcctgagatctgacgacacggccgtgtatactgtgcgagagtgacggggtaaatagttttagacttcggttaccctccttttgacgttacgtcggggccgaacgggacccgttggtacccg

SEQ ID NO: 196840 - DNA, 582 bp, Homo sapiens
  misc_feature: GYAE6OF01DSGJP.39.81.H04.1.454.CMB.1.raw
  modified_base (504)..(504): a, c, t, g, unknown or other
  misc_feature (504)..(504): n is a, c, g, or t
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacacctttacaactatggtatcgagttgggtgcgacacggccctggacagggcttggagtggagtgggatggatcgagcgacttacgaagtggtacaacgaacaaactatacgacacgaacgaacctcgagggacagacgtaccacagtcgaaccacgaacgacacactccaacgacgaccaccgcctacagtcggacctaggacgacgcctaggagactcgcgaaccgaccgaccgggtcgttagttacttacgtggngacgagagtacgtagggtaaattagtttagcgttacggtacccttgttacgacgtacgtcgggacgtacgggtacccg

SEQ ID NO: 196841 - DNA, 550 bp, Homo sapiens
  misc_feature: GYAE6OF01DIT9R.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgctacaatggtacacaacaactatgcacagaaccctcgagggcagagtcacatcgaccacagacacatcccaacgagcacggcctaacatcggacctgaggagcctgagatctgaacgacgacggccgtgtattactggtgcgaggagagtacggggaaattagtttagacgttcggtacccttcgtttacgacgttacgtacggggaccctacggggtacccgtacggg

SEQ ID NO: 196842 - DNA, 612 bp, Homo sapiens
  misc_feature: GYAE6OF01AJMGV.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttggtgcgacaggccctggacaagggcttgagtggagtgggatggatcgagcgcttacaagtggtcacacaaactatgcacagaacctcgaggcagagtacacatcgaccacacgacacactccacgacgcacggcctacatcggacctaggacggacgccgtagacgtactcgacggaccgaaccgaccggtaccgttagttaacgttacgttggtacggacggtaaggaggtaacggtaacgggggtaaatttacgttttaggacgtttcgggtaacccctttcgtttacggtaaccgttacggtaccgggggtacccgtaacggggtaaccccgttacggg

SEQ ID NO: 196843 - DNA, 592 bp, Homo sapiens
  misc_feature: GYAE6OF01C6EAZ.39.81.H04.1.454.CMB.1.raw
tcagtcgcactagtcacgaccggtgctcgatttagtagtgtagattcgcggggacccaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactatgcacagaacctccgagggcagagtcacatcgaccacagacacatccacgagccacggcctacagtcggacctaggacggacgccgtaggacgagtctggaaccgacgaccggtccgttagtacttacgtggtcgacggaggtagacggtacggggtaaattcgttttacgtacggttccggttaaccccgttcgttttacggtaaccttacgggttacggggacccgtaacggggtaaccccgttcggg

SEQ ID NO: 196844 - DNA, 539 bp, Homo sapiens
  misc_feature: GYAE6OF01DKPHP.39.81.H04.1.454.CMB.1.raw
  modified_base (320)..(320): a, c, t, g, unknown or other
  misc_feature (320)..(320): n is a, c, g, or t
  modified_base (378)..(378): a, c, t, g, unknown or other
  misc_feature (378)..(378): n is a, c, g, or t
  modified_base (507)..(507): a, c, t, g, unknown or other
  misc_feature (507)..(507): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacaggccctggacaagggcttgagtggatgggatggatcagcgnttacaatggtacacaacaaactatgcacagaacctccagggcagagtcacatgaccanagacacatccaacgagacacggcctaacatcggacctggacggagccgtgagactctgaacgacgacggccgtagtacttactgtgcgagagagtacggggaaattagtttagacgttcggtacccttnttacgacttacgtggggccagggaccctcggg

SEQ ID NO: 196845 - DNA, 674 bp, Homo sapiens
  misc_feature: GYAE6OF01BFG60.39.81.H04.1.454.CMB.1.raw
tcagtcgcactagtcacgaccggtgctcgatttagtagtgtagattcgcgggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttggtgcgacaggccctggacaagggcttgagtggatgggatggatcagcgacttacaagtggtacacaacaaactatgacaacgaacgaaaccctccgaagggcaagacgtcaaccatacgaaccaacgagaaccacactaccaacgacgacgacggacctaacaacgtacggaacctaggaacggacgaccgtaggaacgtacgtaccgtagaaccgaaccgaccgggtacccggttagttaacgttaccgttaggtacggacggtaaggaagggtaacggttaacgggggtaaaatttacggttttacgggaccggtttaccgggttaccccgtttacgtttacggtaaccgtttaccgggtaccgggggtacccggtaaccggggtaaccccgtttacccgggg

SEQ ID NO: 196846 - DNA, 547 bp, Homo sapiens
  misc_feature: GYAE6OF01E20HN.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactatgcacagaacctcagggcagagtcacatgaccacagacacactccacgagcacggcctacatcggacctgaggagcctgagatctgacgacacggccgtgtattacgtgtgcgaggagtagtacggggtaaattgttttagacttcggttacccgttctttacgtaccgttacgtgggggtaccctaggggtaacccgttcggg

SEQ ID NO: 196847 - DNA, 543 bp, Homo sapiens
  misc_feature: GYAE6OF01BC44L.39.81.H04.1.454.CMB.1.raw
tcagtcgcactagtcacgaccggtgctcgatttagtagtgtagattcgcggggcccctagatcacagctcctcaccatggactggacctggagcatccttttcttggtggcagcaacaacaggtgcccactcccaggttcagctggtacagtctggagctgagatgacgaagcctggggcctcagtgaagatctcctgcaaggcttctggttacacctttaccaactatggtatcagttgggtgcgacaggcccctggacaagggcttgagtggatgggatggatcagcgcttacaatggtcacacaaactatgcacagaacctcagggcagagtcacatgaccacagacacactccacgagcacggcctacatggacctgaggagcctgagatctgacgacgacggccgtgtattacgtgtagcgagagagtacggggaattagtttgactcggttacccttcgtttacgaccgttacgtacggggtcccgaacggggtacccgtcgggtacctacccggttcctcccgtcgtcgtaccccg

SEQ ID NO: 196848 - DNA, 663 bp, Homo sapiens
  misc_feature: GYAE6OF01BO7UT.39.81.H04.1.454.CMB.1.raw
  modified_base (354)..(354): a, c, t, g, unknown or other
  misc_feature (354)..(354): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggtcttctggttacacctttaccaactatggtatcagttggtgcgacaggcccctggacgaagggcttggagtggatgggatggatcgagcgcttaacaagtggtacaacgaactaaaactntcgacaacacgaaccctccgagggcaagacgtacaccatcgaaccacgagacacactaccgaacgagacaccggacctaacgagtacggaccctggaacggacgtcccgtaggacgtagtaccgtaggaaccgaccggaccggtaccgttagttaacgtttacgtaggttacggaccggtaaggaacgtagggttaaaccggggtaaaattttacggtttaggaccgtttacgggttacccctttaggttttaaccggaccgttaaccgggttcgggggaacccgtaacggggtaaccccgttaccggg

SEQ ID NO: 196849 - DNA, 568 bp, Homo sapiens
  misc_feature: GYAE6OF01EQ2R5.39.81.H04.1.454.CMB.1.raw
  modified_base (444)..(444): a, c, t, g, unknown or other
  misc_feature (444)..(444): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggccctggacaagggcttgagtggagtgggatggatcgagcgcttacaatggtcacacaaatatgcacagaacctcagggcagagtcaccatcgaccacagacacactacccacgacgcgacggacctaacagtcggacctggacggacgccgtagacgatcgngaaccgacgaccggccgttagtacttacgtgtagcgaggagtacgtaggggaaattgtttaggacgttcggtacccttgtttacggtacttacggtaggggacccgtaggggtaacccttcggg

SEQ ID NO: 196850 - DNA, 541 bp, Homo sapiens
  misc_feature: GYAE6OF01CNEF2.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacaacaaactatgcacagaaccctcagggcagacgtcaccatcgaccacagacacactccaacgagcacgcctacatcggacctgacggagccgtgagatctgacgacgacggccgtgtattacgtgtgcgagagagtacgggaaattacgtttagacgttcggtacccttgtttacgacttacgtgggaccgagggtacccgtacgg

SEQ ID NO: 196851 - DNA, 591 bp, Homo sapiens
  misc_feature: GYAE6OF01CUPCW.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtacacacaactatgcacagacctcgaggcagacgtcacatacgacacagacaacactaccacgacgacgacggacctacgaacgtcggacctagggaacggacgccgtagaacgtactcgtacgaaccgacgaccggtaccgttagtacttaacgtgtcgacggagaggtaggtaacgggtaaattacgtttaggaacgttcggttacccttagtttacgaaccgttacggtggggaacccgaggggtaccccgttcggg

SEQ ID NO: 196852 - DNA, 583 bp, Homo sapiens
  misc_feature: GYAE6OF01D66C4.39.81.H04.1.454.CMB.1.raw
  modified_base (350)..(350): a, c, t, g, unknown or other
  misc_feature (350)..(350): n is a, c, g, or t
tcagtcgcactagtcacgaccggtgctcgatttagtagtgtagattcgcggggcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactatgcacaagaaccctcgaggcagacgtcacatcgaccanagacacactcccacgacgccacggcctacagtcggacctgacggacgcctagagactcgtagaccgacgacggtccgtagttacttacgtgtcgacgaaggagtagtacggggtaaattagttttacgacgttcggtacccttgtttacgacgttacggtggggacccgtacggggtaaccccgttgggtacccgtaacccggttcctacccgtacgtacgccccgtaacccg

SEQ ID NO: 196853 - DNA, 553 bp, Homo sapiens
  misc_feature: GYAE6OF01D21CQ.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactatgcacagaacctccagggcagagtcaccatgaccacaagacacatccacgagcacggcctaacatggacctgaggagcctgagatcgtgacgacgacggccgtgtattactgtgcgagagagtacggggtaaattagttttaggacgttcggttaaccccttcttttacgaccgttacgtcgggggaccctacggggtaaccccttcggg

SEQ ID NO: 196854 - DNA, 558 bp, Homo sapiens
  misc_feature: GYAE6OF01AUR3W.39.81.H04.1.454.CMB.1.raw
  modified_base (378)..(378): a, c, t, g, unknown or other
  misc_feature (378)..(378): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggaactgagatgacgaagcctggggcctcagtgaaggtctcctgcaaggcttctggttacacctttacaactatggtatcagttgggtgcgacaggccctggacaagggcttgagtggatgggatggatcgagcgcttacaatggtcacacaaactatgcacagaacctcgaggcagagtcaccatcgaccanagacacatccacgacgcacggcctacatcggacctgaggacgccgtgagtatctagaccgacgaccggtccgtgtacttacgtgtgacgagagagtacggggtaaattagtttcgacgttcggtacccttgtttacgtacttacggtacggggacccgtaacgggtacccgtggtacccg

SEQ ID NO: 196855 - DNA, 578 bp, Homo sapiens
  misc_feature: GYAE6OF01C4RJ2.39.81.H04.1.454.CMB.1.raw
  modified_base (323)..(323): a, c, t, g, unknown or other
  misc_feature (323)..(323): n is a, c, g, or t
  modified_base (383)..(383): a, c, t, g, unknown or other
  misc_feature (383)..(383): n is a, c, g, or t
  modified_base (400)..(400): a, c, t, g, unknown or other
  misc_feature (400)..(400): n is a, c, g, or t
  modified_base (415)..(415): a, c, t, g, unknown or other
  misc_feature (415)..(415): n is a, c, g, or t
  modified_base (537)..(537): a, c, t, g, unknown or other
  misc_feature (537)..(537): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagcctggggcctcagtgaaggtctcctgcaaggcttctggttacacctttacaactatggtatcaggttggtgcgacaggcccctggacaagggtcttgagtggatggatggatcgagcgnttacaagtggtacacaacaaactatgcaacagaacctccgaggcagactcacatgaccanagacacactccaacganaccgacggacctaanacgtacgggaccctggaacggacgccctaggacgtataccgtagaaccgacgaccgggtaccgtagtacttacgtgtacgacgagacgagtagggaaatttgttacgacttcggtacccttnttagaaccgtttacggacgggccgtaagggtcccgttacgg

SEQ ID NO: 196856 - DNA, 542 bp, Homo sapiens
  misc_feature: GYAE6OF01DSHZ3.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatgggatcagcgcttacaatggtcacaacaaactatgcacagaacctcagggcagagtcacatgaccacagacacatccacgagcacggcctacatggacctgaggagcctgagatcgtgacgacacggccgtagtattactgtgcgaggagagtacggggaaatttagtttaggacttgggtaccccttgtttacgtacttacgtggggaccctaggggtaccccgtcggg

SEQ ID NO: 196857 - DNA, 532 bp, Homo sapiens
  misc_feature: GYAE6OF01A04Y3.39.81.H04.1.454.CMB.1.raw
  modified_base (439)..(439): a, c, t, g, unknown or other
  misc_feature (439)..(439): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactatgcacagaacctccagggcagagtcaccatgaccacagacacatccacgagcacggcctacatcggacctgacggacgcctgagatctcgacgacncggccgtgtattactgtgcgagagagtacggggtaatagtttgacgttcggtaccctcgtttcgacttacgtggggcccagggtacccgtcgg

SEQ ID NO: 196858 - DNA, 622 bp, Homo sapiens
  misc_feature: GYAE6OF01DKPYQ.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcatgcaaggcttctggttacacctttaccaatatggtatcagttgggtgcgacacggccctggacaagggcttggagtggatgggatggatcagcgcttacaatggtacaacaacaaactattacacaagaacctcgagggcaagagtcaccatacgaccacacgacacactccacgacgaccacggacctaacacgtacggacccgtaggaacggacgcccgtagaacggtataccgtacggaaccgaccgaccgggtccgttacgttaacgttacgtcggtacgacggtacggaaggtacggtaacggggtaaatttagttttacggacgttcggttacccttcgtttacggaccgttacggtacggggacccgtacgggtaaccccgttacggg

SEQ ID NO: 196859 - DNA, 543 bp, Homo sapiens
  misc_feature: GYAE6OF01B78YJ.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcgagcgcttacaatggtcacacaaactatgcacagaacctccgagggcagagtcaccatcgaccacagacacactccacgagcacggcctacagtggacctgaggacgcctgagatctgacgacacggccgtgtattacgtgtgcggagagagtacggggaaattagttttgactcggttacccttcgtttacgacttacggtggggccgtaagggtacccgtcggg

SEQ ID NO: 196860 - DNA, 622 bp, Homo sapiens
  misc_feature: GYAE6OF01CT8HV.39.81.H04.1.454.CMB.1.raw
  modified_base (342)..(342): a, c, t, g, unknown or other
  misc_feature (342)..(342): n is a, c, g, or t
tcagtcgcactagtcacgaccggtgctcgatttagtagtgtagattcgcggggcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacaggccctggacaagggcttgagtggatgggatggatcgagcgcttacaagtggtcaacacaaactatgacacagaacctcagggcagagtcacancgaccacagacacactccaacgagcacggcctaacatacggacctaggacggacgccgtagaacgactctaggaaccgacgaccgggtccgttagttaacttacgtggtacggacgaaggacgtaggtacggggtaaaatttagttttacggacgttacgggttaccccttcgtttacgaaccgttacggtacgggggtacccgtaaacggggttacccccgttacgggttacccgtaccccggttcctaccccgttacgacccggtccctaacccccgg

SEQ ID NO: 196861 - DNA, 635 bp, Homo sapiens
  misc_feature: GYAE6OF01CQYHV.39.81.H04.1.454.CMB.1.raw
  modified_base (339)..(339): a, c, t, g, unknown or other
  misc_feature (339)..(339): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagcctggggcctcagtgaaggtctcctgcaaggcttcgtggtactacctttacaactatggtatcaggttggtgcgacaggccctggacaagggcttagagtggatgggatggatcagcgtcttacaatggacacanaaaactatgacaacgaacgtaaccaccgaaggggccaagtagtacaaccgaagtacgaaccaacaagaaccaacgaactacccgaacggacgccgtaacggccctaacgaacgtggaaccctagggaacggacgtcctggaaccgtatacgtacgacgtaccgaacggtccgtagtaacttacgttagcgacgtaagagaggtacgggtaaattgtttagaacgttcggttaccccgtttagttaacggtaaccttacgggtaccggggacctaaacggggtaacccgttcccggg

SEQ ID NO: 196862 - DNA, 559 bp, Homo sapiens
  misc_feature: GYAE6OF01B9TH0.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggccctggacaagggcttgagtggatgggatggatcgagcgcttaacaatggtcacacaaactatgcaacagaacctccgagggcagagtcaccatcgaccacacgacacactccacgagccacggcctacatcggacctgagacgaccgtgagatctgacgacacggcgtagtattactgtgcggagagagtacggggtaaattagttttagacgttcggttacccttacgttttacgaccgttacggtcggggacccgtacgggtaccccgttcggg

SEQ ID NO: 196863 - DNA, 589 bp, Homo sapiens
  misc_feature: GYAE6OF01AIFOF.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactatgcacagaacctcgagggcagagtcaccatcgaccacagacacactccaacgacgccgaccggcctaacagtcggaccctggacggacgtcctaggagtactcgtacggaaccgaccgacgggtcccgttaggtactttacgtggtgacggaggacgtaggtacggggaaatttacgttttaggacgttcggtaccccttgtttacgaacgttacggtcggggaccctacggggtaacccttcggg

SEQ ID NO: 196864 - DNA, 564 bp, Homo sapiens
  misc_feature: GYAE6OF01CEHGL.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttggtgcgacaggccctggacaagggcttgagtggagtgggatggatcgagcgcttacaatggtcacacaactatgcacagaactcccccaggcagagtcaccatagaccacacgacacactccacgacgcacggacctacatcggacctgaggacgcctgacgatctagacgacgacggccgtagtattactgtgcggagaggagtacgggtaaagttagttttagacgttcggttacccgttacgtttacggtacgttacgttaggggcccgtacggggtaaccccgtaccggg

SEQ ID NO: 196865 - DNA, 661 bp, Homo sapiens
  misc_feature: GYAE6OF01CYFVQ.39.81.H04.1.454.CMB.1.raw
  modified_base (352)..(352): a, c, t, g, unknown or other
  misc_feature (352)..(352): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagcctggggcctcagtgaaggtctcctgcaaggcttctggttactacctttacaactatggtatctaggttggtgcgacaggccctggacaggcttgagtggagtggatggatcgagcgtcttaacgaagtggtacaacaactaaaactntacgacaacgaacgtaaaccctcgaagggcaaggacgtccaaaccgagtacgaaccaacaacgtaaccacactaccgaacgacgaccgaaccggacctaacgagtacggaccgtaggaggacgccgtggaatacgtcgtacgaacgaccgacgggtcgttagtattacgtgtacggacggtaaaggtacggtaggttaaccggggtaaatttacggttttacggacgtttccgggtttaacccctttcggtttacggtaaccgttacgggtccggggtaacccgtaacggggtaccccgtttaccgggg

SEQ ID NO: 196866 - DNA, 699 bp, Homo sapiens
  misc_feature: GYAE6OF01APFBI.39.81.H04.1.454.CMB.1.raw
  modified_base (345)..(345): a, c, t, g, unknown or other
  misc_feature (345)..(345): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggccctggacaagggcttgagtggatgggatggatcgagcgacttacaatggtacacacaaactntgacacagaacctcgagggcagagtacacatcgaccacagacacactaccgacgacgaccgacggacctaacgacgtacgggaacccttagggaacgggtacgttacgtaggtaacgtacttaccgtacggaacccggtaaccgaccggggtacccgttaggttaaccgtttacgttacgggtacggacggtaaggtacggtaacgggttaaccggggggttaaaattttacggtttttaacgggaacccggttttaccgggtttaacccccgtttacgtttttaccgggaaccgtttaaccggggttacccgggggaccccggttaaacgggggtaacccccgtttaccgggg

SEQ ID NO: 196867 - DNA, 636 bp, Homo sapiens
  misc_feature: GYAE6OF01DVYOQ.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatcctttttcttggtggcagcaacaacaggtgcccactcccaggttcagctggtacagtctggagctgagatggcgaagcctggggcctcagtgaaggtctcctgcaaggcttctggttacacctttacaactatgtatcagttggtgcgacacggccctggacaagggcttgagtggagtgggatggatcagcgtctacaatcggtacaacaacaaactatgacacacgaacctcgagggcagagtcacatcgaaccacagacacactccaacgacgcacggtacctacacgtcggacctggaacggacgccgtaggacgtatcgtacggaaccggaacgaccgggtccgttagttaacgtttaccgtagggtacgacggaaggtaaggtacggttaaccgggggtaaaatttacggtttttaggaaccggtttacgggttaccctttcgttttacggtaaccgttaccggttacgggggacccggttaacggggtaaccccgttacggg

SEQ ID NO: 196868 - DNA, 593 bp, Homo sapiens
  misc_feature: GYAE6OF01B37AM.39.81.H04.1.454.CMB.1.raw
  modified_base (343)..(343): a, c, t, g, unknown or other
  misc_feature (343)..(343): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactntgcacagaacctccagggcagatcaccatcgaccacagacacatccgacgacgcacggcctacgactcggacctggaacggacgcctaggaagataccgtacggaaccgaaccgaccgggtaccgttagttaactttacgtggtacgcggaaggaggtacgtacggggtaaatttgttttacgacgttcgggtaccccttcgtttacgtaccgttacggtacggggccctaacggggtaccccgttcggg

SEQ ID NO: 196869 - DNA, 592 bp, Homo sapiens
  misc_feature: GYAE6OF01BEWEY.39.81.H04.1.454.CMB.1.raw
tcagtcgcactagtcacgaccggtgctcgatttagtagtgtagattcgcgggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactatgacacagaacctccgagggcagagtcacatgaccacagacacatccacgagcacggcctacatggacctggacggacgcctgacgatccgtagaccgaacgaccgggtccgtagttaactttacgtggtcggacggagaaggtacgtaacgggggtaaattacgtttttacggacgttcgggttaaccccttcgttttacggtacgttaccgtacgggggacccgtaacggggtaaccccgttacgggg

SEQ ID NO: 196870 - DNA, 587 bp, Homo sapiens
  misc_feature: GYAE6OF01DEZVU.39.81.H04.1.454.CMB.1.raw
  modified_base (321)..(321): a, c, t, g, unknown or other
  misc_feature (321)..(321): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggccctggacaagggcttgagtggatgggatggatcagcgnttacaatggtcacaacaaactatgcaacagaacctcgagggcagagtcaccatcgaccacagacacactccacgagcacggcctaacagtcggacctggaacggcgcctagacgatcgtgaaccgacgaccgggtccgttagttacttacgtggtacgacgaacggtaggacggttacggggtaaaatttgttttacggacgttcgggttaaccccttgtttacgaccgttacggtcggggacccgtacggggtaccccttacggg

SEQ ID NO: 196871 - DNA, 689 bp, Homo sapiens
  misc_feature: GYAE6OF01DQ8BB.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacacggcccctggaacaagggtcttggaggtggagtgggatggatcgagcgcttaacaagtggtacaacgaacaaactatgacaacaacgaaccctcgaagggcaagtacgtacaaccatacgaaccaacgacgaaccacactaccgacgagccgaaccggcctaacgagtacggaccctagggaacggacgtaccgtaggaacgtacgtaccgtacggaaccgaaccgtacccgggtaccgttagttaacgtttaccggtggtacggacggtaaggtaacggtaaacgggttaacgggggtaaaattttcgttttaagggaacccgtttcgggttacccctttaggttttacggaacccgtttaacgggtccgggggtaacccgtaaaccgggggtaaccccgttccgggg

SEQ ID NO: 196872 - DNA, 551 bp, Homo sapiens
  misc_feature: GYAE6OF01BKILG.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactatgcacagaacctcgagggcagagtcaccatgaccacagacacactccaacgacgcacggcctaacatggacctggaaggagacctgagatctgacgacacggccgtgttacttacgtgtgcgtagagagtacggggaaattgttttagacgttcggtacccttctttacgtacttacgtaggggacccgaggggtaaccccttacggg

SEQ ID NO: 196873 - DNA, 591 bp, Homo sapiens
  misc_feature: GYAE6OF01AY8M7.39.81.H04.1.454.CMB.1.raw
tcagtcgcactagtcacgaccggtgctcgatttagtagtgtagattcgcggggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacacctacttgaattggtttcagcagacggccaggccaatctccaaggccgaccttaatttataacggtttactaaccgggactcgtacggggtacccagacagacttcgagcggcaggtgggtacaggcactgaattcacactagaaatcgagcgagggtaggaggcgtaggaggtagttgggtttagggtttattacgtgtacgtagtagacgaaaggtaacaacgacgtacggtcccttaccgtacttacgtttcggaccggtacgggaaccacggtacgtaggtaacgtaagtacgaaacgaacgtggtacggtactacgacctacctagttccgttacg

SEQ ID NO: 196874 - DNA, 529 bp, Homo sapiens
  misc_feature: GYAE6OF01DSUYC.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcgagcgcttacaatggtacacacaaactatgcaacagaacctcagggcaagactcaccatgaccacaagacacatccacgagcacgcaacatggacctgaggagctgagatctgaacacgacggccgtgtattactgtgcgagagagtacgggaatagtttgacttcggtacccttgttacgtacttacgtcggggaccagggtacccgtcgg

SEQ ID NO: 196875 - DNA, 566 bp, Homo sapiens
  misc_feature: GYAE6OF01DKUP8.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcgagcgcttacaatggtcacacaaactatgcacagaaccctccgagggcagacgtcaccatgaccacagacacactccaacgagcaccggcctaacatcggacctgaggacgcctgagatcgtgaccgacgaccggtcgtagtattacgtgtgcgaagagagtacggggaaatttacgtttagacttcggttaccccttcgtttacggtaccgttacggtcggggaccgacggggtaaccccgttacggg

SEQ ID NO: 196876 - DNA, 724 bp, Homo sapiens
  misc_feature: GYAE6OF01DNJ68.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtggggcctcgagtgaaggtctcctgcaagtcttcgtggttacctacctttacaactagtggtatcgtaggttgggtgcgacgacggcccctaggacgaagggtcttggagtggagtgggatggatcgagcgtacttacagtcggtacaacaactaaactagtacgacaacgaacgaacctcgagggacaaggactaccacagtacgaaccacgacgaacacactaccgaacgacgaccgaacccggacctaacgacgtaccggaccgtagggaacgggaccgtaccgtggaaacgtacgtaccgtaacgaaccggaccggtaaccgggtcccgtttaagttaaccgttttaacggtggtacggaacggtaaggtaacgggtaacgggtttaaacgggggttaaaacttttcgggttttaacggtaccggtttacccggttttaccctttaggtttaaccgtacgggttaacccgggtccgggggtaacccggttaaccggggtaaccccgttccggg

SEQ ID NO: 196877 - DNA, 656 bp, Homo sapiens
  misc_feature: GYAE6OF01A1V5M.39.81.H04.1.454.CMB.1.raw
  modified_base (378)..(378): a, c, t, g, unknown or other
  misc_feature (378)..(378): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggccctggacaagggcttgagtggatgggatggatcagcgcttacaatggtcacacaaactatgacacagaacctcgaggcagagtcacatcgaccanagacacactccagagacacggacctacacgtcggacctggaacggacgcccgtagacgtagtaccgtaggaaccggtaaccgaacccggggcccgttacggttaacgtttacccgtaggtacggaccgggaaacgggtaaggtaaacgggtaaccggggggttaaaatttaacggtttttagggtaacccggttacgggtttaaccccctttagttttaccgggtaacttaccgggtacggggggaccccgtaaccgggggtaaacccccttcggggg

SEQ ID NO: 196878 - DNA, 631 bp, Homo sapiens
  misc_feature: GYAE6OF01AVBTE.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaggcttctggttacctacctttaccaactagtggtatcgtaggttgggtgcgacgacggcccctggacgaagggtcttggaggtggagtgggatggatcgagcgtcttaacaagtggtacacacaaactagtcgacacacgaacctccgagggcaggactacacatacgaccacgacgacacacgtaccgaacgacgaccgacccggacctaacgacgtacggacccgtaggacggacgcgtagacgtactcgacggaccgacgaccggtccgttagtacttacgtacggtgacggaagtaggtacggtacgggttaaagtttcggtttacggacgttccggttacccttcgtttacgaccgttacgggtacgggacccgtaacgggtacccgttaccggg

SEQ ID NO: 196879 - DNA, 660 bp, Homo sapiens
  misc_feature: GYAE6OF01AXUCX.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcgagtgaaggtctcctgcaaggcttctggttacacctttaccaactatggtatcgagttgggtgcgacacggcccctggacgaagggcttggagtggagtgggatggatcgagcgcttacagtggtacaacacaaactatcgacaacgacgaaccctcgagggcagacgtacaccagtacgaccaacagaccacatacccaacgacgaccaacggcctaacgacgtacggaccctagggaacgggacgccgtaggaacgtactccgtacgtaaccgaccgtaccgggtccgttacggtagtttacgtggtacggacggaaggtaagggtacggttaacggggtaaatttacggttttaggaacggtttaccggttacccgttacggttttacggtaaccgttacgggttaccggggacccgtaaccgggggtaaccccgttacgggg

SEQ ID NO: 196880 - DNA, 565 bp, Homo sapiens
  misc_feature: GYAE6OF01DBCVF.39.81.H04.1.454.CMB.1.raw
tcagtcgcactagtcacgaccggtgctcgatttagtagtgtagattcgcggggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatcctcctgcaggtctagtcaaagccttcgtatacattgataggaaacacctactgtaattggtttcagcagagccaggccaatcctcaaggcgcctaatttataaggtttctaaccgggactcgtcgggtcccagacagattcagcggcagtgggtcaggcactgaaattcacactagaaatcagcagggtggagctaggaggtattggtttggggtttattacgtgtacagtgacgaaggtaacacgacgtacggtccctaccgtactacgtttcggacccggtagggtaacccaaggtcgtagggtaacgtataccaaacgtaacgtggtacggacttacgacaccctagtcgttacg

SEQ ID NO: 196881 - DNA, 690 bp, Homo sapiens
  misc_feature: GYAE6OF01CNSB3.39.81.H04.1.454.CMB.1.raw
  modified_base (275)..(275): a, c, t, g, unknown or other
  misc_feature (275)..(275): n is a, c, g, or t
  modified_base (356)..(356): a, c, t, g, unknown or other
  misc_feature (356)..(356): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggngcgacacggcccctggacaagggtcttggagtggagtgggatggatcgagcgtcttacaagttcggtacaacaacaaactntacgcaacaacgaaccctcgagggcaggactaccaccatcgaccacagaccacactccgacgacgccgaccggacctacacgtcggacccgtaggacgggacgccgtaggaacgtacgttccgtacggaaccggaacccggtaccgggtcccggttagttaaccgtttacgttacgggtacgaccgggtaaggacggtaacgggttaacggggttaaaattttcggttttagggtaacccgtttccgggtttaacccctttcggttttaacggtacccggttaacgggttaccgggggtacccccggtaaacgggggtacccccgttaccgggg

SEQ ID NO: 196882 - DNA, 594 bp, Homo sapiens
  misc_feature: GYAE6OF01ATKG7.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcgagcgcttacaagtggtacacaacaaactatcgacaacagaacctccgagggcaagacgtacaccatcgaaccacacgacacatccaacgacgcacgacctacgatcggacctagaggacgcctaggagactcgtagaccgacgaccggtccgtagtactttacgtggtacgcgaagacgtagtacggtaagggtaaactttagtttaggtaccgttacggttaccctttcgtttacgtaccttacgggtcggggtcccgtaacggggtaacccccg

SEQ ID NO: 196883 - DNA, 625 bp, Homo sapiens
  misc_feature: GYAE6OF01C7JSS.39.81.H04.1.454.CMB.1.raw
  modified_base (448)..(448): a, c, t, g, unknown or other
  misc_feature (448)..(448): n is a, c, g, or t
tcagtcgcactagtcacgaccggtgctcgatttagtagtgtagattcgcggggacccaaaaaccacaccctccttgggagaatcccctagatcacagctcctcaccatggactggacctggagcatccttttcttggtggcagcaacaacaggtgcccactccaggttcagctggtacagtctggagctgagatgacgaagcctggggcctcagtgaaggtctcctgcaaggcttctggttacacctttacaactatggtatcagttgggtgcgacacggccctggacaagggcttgagtggatgggatggatcgagcgcttaacaatggtacacaacaaactatgacacaacgaacctccgaagggccagaacgtcaaccatagaccacacgacaacactccaacgaacgcgaaccggacctaacagtacggacctgggaacggacncccgtaggacgatccgtaggaccgaacgaccgggtccgtagttaacgtttactacggtgacggtaaggaggagttaacgggggtaaatttagttttaggactttcgggttaccccttacgttttacggtaaccttaccgggtggggtaacccgtaacggggtaaccccgttacgggg

SEQ ID NO: 196884 - DNA, 537 bp, Homo sapiens
  misc_feature: GYAE6OF01BNRV8.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggtagcagcaacaggtgcccactcccaggttcagctggtgcagtctggagctgaggtgaagacgcctggggcctcagtgaaggtctcctgcaaggcttctggttacccattcaccacctttgctctcagctgggtgcgacaggcccctggacaagggcttgagtggatgggttccgtctacaacacaaaccatgcccagaagttccagggcagagtcacatgaccacagacacatccacggacacagcctacatggaactgagacagcctgagatttgacgtacacggccatcgtattactgtgcgtaggtctcttcgaccaactgagtggtagacgtaaaagggttgacgttcgtcgggaccgacgggtaaccctcggtacaccgtcgtccgtaccg

SEQ ID NO: 196885 - DNA, 749 bp, Homo sapiens
  misc_feature: GYAE6OF01CUYIX.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatcctttcttggtggcagcaacaacaggtgcccactcccaggttcagctggtacagtctggagctgagatgacgaagcctggggcctcagtgaaggtctcctgcaaggcttctggttacaccttaccaactatggtatcaggttgggtgcgacgacggcccctggacaagggcttggagtggagtgggatggatcaaggccgtacttaacaagttcggtacaaccaactaaaacctagtcgacctaacaacgtaacccctccgaaggggaccgaaggacgttacccaccgtaagtacggaacccaacgaacgacaacctaactcccgaaccgacgacccgaaccggccctaacgaacgtacggacccgttagggaacgggacgacccgttaggaacgtacttaccgacggtaacccgaaccgtaacccgggtaccgtttaggtaaccgtttacgtaggtacggtacggtaacggtaaaggtacgggttaacgggggtaaaacttttacggtttttacggaccgtttaacccgggttaccccctttacggttttaccggtaacccggtttaaccgggtaccgggggtaaccccgaaccgggggttaaccccctttaacccggggg

SEQ ID NO: 196886 - DNA, 633 bp, Homo sapiens
  misc_feature: GYAE6OF01D1G6C.39.81.H04.1.454.CMB.1.raw
  modified_base (331)..(331): a, c, t, g, unknown or other
  misc_feature (331)..(331): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttggtgcgtacacggcccctggacaagggtcttggagtggatgggatggatcgagcgcttaanaatggtacacgactaaactatgacacacgaacctcgagggcagacgtacaccatcgaaccacaagaccaacactacccaacgacgacaccggaccctaacgaagttccgggacccttggaagggaccgacccgttggaacgtacgttccgtacggaaccgtaccgaccggtcccgttagttaactttacgtggtcgacggaagaacggtgtaacggggtaaatttagttttaggacgttcgttacccgttctttaggaaccctttacggacggggtacccgtacggggtaacccgttacggg

SEQ ID NO: 196887 - DNA, 702 bp, Homo sapiens
  misc_feature: GYAE6OF01DN0TO.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggtcttctggttacacctttaccaactatggtatcgaggttgggtgcgacacggccctggacaagggcttggagtggagtgggatgggatcgagcgtacttaacaagttcggtacaacaactaaactatcgacaacaacgaaccctacgagggacagtacgtacactatacgaaccaacacgaacaacactacccgaacggacacccggaaccggtcctaaacgtacggtaccggaaccgtagggaacggaccgtaccgtaggacgtacgtacgtacggaaccgaccggaccgggtccgttagttaacttacgtggtcgacggaaacggtacggtacgggttaacggggttaaattttacggtttaaggtacccggtttaccgggttaaacccccttttggtttaacccgggtaacccgtttaacggggcccggggtaacccgggtaaccgggttaacccccgttcgggg

SEQ ID NO: 196888 - DNA, 670 bp, Homo sapiens
  misc_feature: GYAE6OF01D9A43.39.81.H04.1.454.CMB.1.raw
  modified_base (406)..(406): a, c, t, g, unknown or other
  misc_feature (406)..(406): n is a, c, g, or t
tcagtcgcactagtcacgaccggtgctcgatttagtagtgtagattcgcgggacccaaaaaccacacccctccttgggagaatcccctatatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttcgtggttaccacctttaccaactatggtatcgagttggtgcgacacggccctggacgaagggcttggagtggagtgggatggatcgagcgtacttaacaagtggtacaacgaactaaactagtcgacaacgaacgtaaccctcgaaggcaagacgtcacatcgaaccanacgacacactccaacgacgcacggcctaacgagtaccggaccgtaggaacggaccgtcccgtaggaacgtacgtaccgtacggaaccgaccgtacccgggtccgttaagttaacttaaccgttggtaggttacggaaggtaacggtacggttaaacggggttaaatttcgttttacggaaccggtttcccggttaacccctttcgtttaacgggtacccgttaacgggttcgggggaccctaaccggggtaaccccttacgggg

SEQ ID NO: 196889 - DNA, 756 bp, Homo sapiens
  misc_feature: GYAE6OF01EJ3VH.39.81.H04.1.454.CMB.1.raw
  modified_base (748)..(748): a, c, t, g, unknown or other
  misc_feature (748)..(748): n is a, c, g, or t
tcagtcgcactagtcacgaccggtgctcgatttagtagtgtagattcgcggggtgatcaggactcctcagttcaccttctcacaatgaggctccctgctcagctccgtggggctgctaatgctcgtgggtcccaggatccagtggggattgttgtgatgactcagtctccagtcctccctgccctcaccttggacacgccgcctccatcctcctgctaggtctagtacaaacgcctagtatactattgaataggaaacctacttactttagaagtttggttacagtccgaaggacggaccaaggacctaataccgtacccgtaaacgggtcctaaccctttaaaagtttttaacggttaaaccgggttttacccgtaaaacccggggtacctttacccgggttacgggggtaaccccctaaagggaacctaacggttacgtttaccgaacgggcccgggtacgttaaggggttcgggtaccgaacgggtacccaacgttaacggtaaactttaccgaaaccgttaagtaaacggtaaaacttccgaagggacggtaacgggggttaggacgggtacgtagggtaacggttaggtttgggttttacggggtttattacggtgtacgtagtacggacgtaaaggaaccacgacgtcggtacccttcgttaacttcggttacggaccgtacgggtaaccaggtccgtaggactacaacggtaaacgtacgtgacggtcacgataacccgtntcgttacg

SEQ ID NO: 196890 - DNA, 578 bp, Homo sapiens
  misc_feature: GYAE6OF01A1P7M.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacaggcccctggacaagggcttgagtggatgggatggatcgagcgcttacaatggtcacacaaactatgacacagaaccctcgaggcagacgtcacatcgaccacagacacataccacgacgcaccggacctaacacgtggaccctggaacggacgaccgtaggagtatcgtagaaccgacgaccgggccgttagtacttacgtgtcggcgagagagtacggggtaaattgtttagacgttcggtacccttcgtttacggtacgttacggtaggggacccgtaacggggtaaccccgtcggg

SEQ ID NO: 196891 - DNA, 537 bp, Homo sapiens
  misc_feature: GYAE6OF01B5PG8.39.81.H04.1.454.CMB.1.raw
  modified_base (363)..(363): a, c, t, g, unknown or other
  misc_feature (363)..(363): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggccctggacaagggcttgagtggatgggatggatcgagcgcttacaatggtcacacaaactatgcacagacctcgaggcagngtcacatgaccacagacacatccacgagcacggcctacatcgacctgaggacgcctgagatcgtagacgacgaccggtccgtagtacttacgtgtgacgaggagaggtacgggtaaattagtttagacgttcggtaccctgtttacgacttacgtgggccacgggtaccctcgg

SEQ ID NO: 196892 - DNA, 519 bp, Homo sapiens
  misc_feature: GYAE6OF01EFSCZ.39.81.H04.1.454.CMB.1.raw
  modified_base (238)..(238): a, c, t, g, unknown or other
  misc_feature (238)..(238): n is a, c, g, or t
  modified_base (306)..(306): a, c, t, g, unknown or other
  misc_feature (306)..(306): n is a, c, g, or t
  modified_base (404)..(404): a, c, t, g, unknown or other
  misc_feature (404)..(404): n is a, c, g, or t
  modified_base (447)..(447): a, c, t, g, unknown or other
  misc_feature (447)..(447): n is a, c, g, or t
  modified_base (504)..(504): a, c, t, g, unknown or other
  misc_feature (504)..(504): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaggtctcctgcaaggcttcnggatacatcttcagcgcctattatatacactgggtgcgccaggcccctggacaagggcctgagtggangggatgtatcaccccgagagtggcgaacacaaaatatgcacaagagatttcagggcagggtcacatgacgtcggacacgtcatacaaacagacctacntagatcagtagactgagtacaacgacacggtacgtcgtacttntgtgcgagagcagagtccgacggtgggaataggtgacgtaagttcgagttggtttangttgtcggtacgggg

SEQ ID NO: 196893 - DNA, 621 bp, Homo sapiens
  misc_feature: GYAE6OF01ACSYO.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggagtgggatggatcgaggcgcttacaagttcggtacaacaacaaactatcgacaacgaacgaaccctccgagggacagacgtacacctatcgaaccacacgacacactccacgacgccacggcctaacagtacggacccgtaggacggacgccgtagacgactccgtacggaaccgacgaccgggtcgttacgttaacttacgtaggtcgacggagaggtacggtaggggtaaactttagtttaggtaccgttcgggttaccctttgtttacggtaccgttacggtcgggggaccctacggggtaacccttccgggg

SEQ ID NO: 196894 - DNA, 619 bp, Homo sapiens
  misc_feature: GYAE6OF01B932X.39.81.H04.1.454.CMB.1.raw
  modified_base (483)..(483): a, c, t, g, unknown or other
  misc_feature (483)..(483): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctgggctcagtgaaggtctcctgcaaggcttctggttacaccttacaactatggtatcagttgggtgcgacgaggccctggacgagggctgagtggagtgggatggatcgagcgtactacgaattgggacacaacgaaactagtgactaacacgtaaccctacgagggccaagacgtcaaccactacgaaccaacgacgaacaacgactaccaacgacgccgacggacctaacgagtcggacctggacggtacgctaggagtagtcgtacgaccgaacnccgggtaccgttgttaacttcgtaggtacgcggaagacggaaggtacgggtaaagtttcgtttaggacgttaccggttacccttcgttacgtaccgtacggttacggggtaacccacggggtaacccgttaccggg

SEQ ID NO: 196895 - DNA, 566 bp, Homo sapiens
  misc_feature: GYAE6OF01D44QK.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttaccacctttaccaactatggtatcagttgggtgcgacaggcccctggacaagggtcttgagtggagtgggatggatcgagcgtcttaacagtggtacacaacaaactatgacacagaacctcgaggcagacgtcacatcgaccacacgacacactaccacgacgccgacgacctacagtcggaccgtaggaggcgctgtgatcgtacgacgaccgcggtccgtgttacttcgtggtcgagaggagtagtacgggtaattagtttagacgttcggttacccttgttacgtacgttacggtcggggaccgtacgggtaccgtcgg

SEQ ID NO: 196896 - DNA, 727 bp, Homo sapiens
  misc_feature: GYAE6OF01BL5D5.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacacggccctggacaagggcttggagtggatgggatggatcgagcgcttaacaagtcggtacaacgaactaaaactatcgactaacaacgaaccctccgaagggccaaggacgtaccaaccgagtacggaacctaacgaacggaaccaacactacccaacgacgaccgaccggacctaacgacgtacggaacccgtagggaacggacgtaccgtaggaacgtacgttaccgtacggaaccggaaccggaacccgggtcccggttaggttaacgttacggttacgggttacggaccggtaacggtaacgggtaacgggtttaaccgggggtaaaattttacggtttttacggaccggtttacccggggtttaacccctttcggttttaacggtaccggtttaaccgggttacgggggaacccgtaaccgggggtaaccccgttaaccgggg

SEQ ID NO: 196897 - DNA, 587 bp, Homo sapiens
  misc_feature: GYAE6OF01C5I7M.39.81.H04.1.454.CMB.1.raw
tcagtcgcactagtcacgaccggtgctcgatttagtagtgtagattcgcggggacccaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggccctggacaagggcttggagtggatgggatggatcgagcgtacttaacgaagttggtcaacaacaaaactatgacacagaaccctcgaggcagacgtcaccatcgaaccacacgaacacataccacgagccaacggctaacatacggacctggaaggacgctgatatcgtagaccgacgacggtccgtagtacgttacgtgtcgacgtagagtacgtacggggaaatttacgtttagacgttcgggtacccctttagtttacgaaccgtttacggacggggtacccgtaggggtaaccccttcggg

SEQ ID NO: 196898 - DNA, 548 bp, Homo sapiens
  misc_feature: GYAE6OF01AYAU3.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactatgcacagaacctccagggcagagtcaccatcgaccacagacacactaccacgacgacacggacctaacatcggacctgaggacgccgtgagatctgacgacgacggcgtgtattacgtgtgcgagagagtacggggaaattagtttagacgttcggtacccttctttacgacgttacgtacggggccgacgggtaacccgtcggg

SEQ ID NO: 196899 - DNA, 555 bp, Homo sapiens
  misc_feature: GYAE6OF01C56UL.39.81.H04.1.454.CMB.1.raw
  modified_base (530)..(530): a, c, t, g, unknown or other
  misc_feature (530)..(530): n is a, c, g, or t
tcagtcgcactagtcacgaccggtgctcgatttagtagtgtagattcgcgggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacaggcccctggacaagggcttgagtggatggatggatcagcgcttacaatggtcacaacaaactatgcacagaaccctccagggcagagtcacatcgaacacagacacatccacgagcacggcctaacagtcggacctgaacggacgcctagagactcgtggaacgacgaccggtccgtgtacttacgtgtgcgagaggagtacggggaaatttgtttagacgttggtaccccttgtttacgaccttacggnggggtacccaggggtacccttcggg

SEQ ID NO: 196900 - DNA, 557 bp, Homo sapiens
  misc_feature: GYAE6OF01DF1BY.39.81.H04.1.454.CMB.1.raw
  modified_base (429)..(429): a, c, t, g, unknown or other
  misc_feature (429)..(429): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatcctttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcgagcgcttacaatggtcacacaaactatgcacagaacctccagggcagagtcaccatcgaccacagacacatccacgagcacggcctacatggacctgaggacgcctgagatntcgacgacgacggccgtgtacttactgtgcgagagagtacggggtaaattagtttagacgttcggttaccccttcgtttacgtaaccttacggttcggggacccgtaacggggtaaccccgttccggg

SEQ ID NO: 196901 - DNA, 642 bp, Homo sapiens
  misc_feature: GYAE6OF01ACRFW.39.81.H04.1.454.CMB.1.raw
tcagtcgcactagtcacgaccggtgctcgatttagtagtgtagattcgcgggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttggtgcgacaggcccctggacaagggcttggagtggagtggggatggatcgaggcgcttaacaagtggtcacacaaactatcgcacaacgaccctcgagggcagacgtacacatacgaccacacgacacactccacgacgccacggcctacgagtcggacccgtggacggacgtccgtaggaacgactccgtacggaaccggaaccgaccgggtaccgttagttacgttaacgtggtacggacggtaagacggtacggtaacggggttaaatttacgttttacggtaaccggttccggttaaccccgtttacgtttacggtaaccgttacgggtaccgggggacccgtaaccggggtaaccccgttacgggg

SEQ ID NO: 196902 - DNA, 652 bp, Homo sapiens
  misc_feature: GYAE6OF01DV7CY.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgaccgaagcctggggcctcagtgaaggtctcctgcaaggcttctggttacacctttaccaactatggtatcagttgggtgcgacacggcccctggacaagggcttgagtggatgggatggatcgagcgcttacaatggtacacaacaactatgcaacacgaaccctcgagggacaagacgtaccaccgatcgaacccaacgaacgacaacaactacccaacggacgaccgaaccggacctaacgacgtacggaccgtagggaacggacgcccgtaggaacgacttaccgtacgaaaccggaccgaaccgggtcccgttagttacttacgtcggtacgaccggaaggtaacggaggttacggggtaaatttacggttttacggaacgtttcgggttaacccctttgtttacgaccgttaacggtcggggacccgtaacggggtaaccccgttacggg

SEQ ID NO: 196903 - DNA, 695 bp, Homo sapiens
  misc_feature: GYAE6OF01EON45.39.81.H04.1.454.CMB.1.raw
  modified_base (398)..(398): a, c, t, g, unknown or other
  misc_feature (398)..(398): n is a, c, g, or t
  modified_base (425)..(425): a, c, t, g, unknown or other
  misc_feature (425)..(425): n is a, c, g, or t
tcagtcgcactagtcacgaccggtgctcgatttagtagtgtagattcgcggggtacccgaaaaaccacacccctccttgggagaactcccctagatcacagctcctcaccatggactggacctggagcatccttttcttggtggcagcaacacgaggtgccctacttccctaggttcagtcgttaggtaacagtcgtggagctgagatgacgagtccgtggggcctcgtagtgaaggttccgtccgtgcgaaggtcttccgtaggttacctaccgtttacaaacgttagtaggttataccgtaggttgggtataccggacgtacggtcccctagggaaccgtaacggtccgttaggacggttaggaggtcgggagttggacttcgtagccgtacttanaagttcgtaacaacaacgtaaacgttncgaactaacgaaccgtaaccgtacgagggactaacggtacctacgaacgtacgtaccgaacaacgacaactacaactaccgaacgacgtaccgaacggaccctaatacggtacgtaccgtgaacgacgtcgtaagacgtacgtcacggaaccacggaccgtcgtaagttctaaccgttgacgacgtaagtacgtagtaacgttagtttcgtaggtccttaccgtacgttgtaacgttacgacgggtcggaacgtccggtacccgttacgg

SEQ ID NO: 196904 - DNA, 711 bp, Homo sapiens
  misc_feature: GYAE6OF01ECHBW.39.81.H04.1.454.CMB.1.raw
tcagtcgcactagtcacgaccggtgctcgatttagtagtgtagattcgcggggacccaaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtggggcctcagtgaaggtctcctgcaggtcttcgtcggttactacctttaccaactatggtatcgtaggttggtgcgacgacggccctggacgagggtcttggaggtggagtggggatgggactcgacggtcgtacttaacgaagttcgggtaccaacgaaactaaacttagtcgacaacgaacgaacccgtaccggagggacaacggtacgtaccaaccgtagtacgaacccaacgaacgaccaactacctacccgaacggtacgaccgaaccggtaccctaacgacgtaccggaccgtaggaacgggtactccgtagacgtactccgacggaaccgaccggtaccgggtccgttagttacttacgtggtacggacggtaggaaggtacggtaacgggttaaatttcgtttacggaaccggtttccggttaaccctttcggtttaccggtaaccggttacgggtacccggggtaccggtaaccggggtacccgttacccggg

SEQ ID NO: 196905 - DNA, 551 bp, Homo sapiens
  misc_feature: GYAE6OF01CH9F8.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctccttcaaggcttctggttacacctttaccaactatggtatcagttggtgcgacaggcccctggacaagggcttgagtggatgggatggatcgagcgcttacaatggtcacacaactatgcacagaacctccagggcagagtcaccatcgaccacagacacatccacgagcacggccctacgatcggacctggacggacgcctagagactcgtagacgacgaaccggccgttagtacttacgtgtgcgagagagtacgggtaaattgtttgacttcggttaccctgtttagacgtacgtcggggaccacgggtacccgtggtacccg

SEQ ID NO: 196906 - DNA, 641 bp, Homo sapiens
  misc_feature: GYAE6OF01BYORM.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacacctttacaactatggtatcgaggttggtgcgacaggcccctggacgaggcttgagtggagtgggatggatcagcgtacttaacaagtggtacaacaactaaaactagtacggacaacgaacgaaccgtccgaacggggacaagaacgtccaaaccgtagtacgaaccaacgacgaacctacaactaccgaacgacgaccaaccggtcctaacgacgtcggtaacccgtaggaacgggacgcctaggtacgagtcgtacgaacgtaccgacggtccgtagttaacttacgtggtagacgtaagaggtagtaacggggtaaattcgtttagtacgttcggtacccttcgtttacggtacctacggtaggggcccgtaaacgggtacccgttacggg

SEQ ID NO: 196907 - DNA, 697 bp, Homo sapiens
  misc_feature: GYAE6OF01CP36P.39.81.H04.1.454.CMB.1.raw
  modified_base (357)..(357): a, c, t, g, unknown or other
  misc_feature (357)..(357): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtgggcctcagtgaaggtctcctgcaaggcttcgtggttactacctttaccaactatggtatctaggttggtgcgacgacggcccctaggacgaagggcttggagtggagtggagtggatcgagcgcttacaagtggtacacaacgaaactntgactacaacgaaccctcgaggacaagactaccgaaccagtacgaccaacgacgacaaccactacccgaacgacgaccgaaccggaccctaacgagtaccggacccgtaggaacggacgtccgtagaacgtacgtccgtaggaaccgaaccggaaccgggttacccgttaggtttaacttaccgttaggtacggtaaccggaaggtaacggtacggttaaacgggggtaaaattttacgggtttacgtaacggtttacccgggttaccccttttacggtttaacgtaccggttaaccgggtacggggtaacccggtaaccggggtaaccccgttaccggg

SEQ ID NO: 196908 - DNA, 697 bp, Homo sapiens
  misc_feature: GYAE6OF01C34H2.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggtcttctggttacacctttaccaactagtggtatcagttggtgcgacgacggccctaggacgaagggtcttggagtggagtgggatggatcgagcgtacttaacgaagtcggtacaacaacaaaactatgacaacgaacgaaccctcgaagggcaaggacgtacaaccgagtacgaacccaagacgaaccaacaactacccgaacgacgacccgaaccggtacctaacgacgtacggaaccgtggaacggacgcctaggaagtacttacgacggaaccgaaccgaccgggtacccgttaaggtttaactttacggtggtacggacggtaaacggaggtaacgggtaacggggttaaaatttacggttttacggaccgttttaccgggtaaccccttttcgtttaacgggtaacccgtttaacggggaggggtaaccccgtaaacggggtaacccgtttacggg

SEQ ID NO: 196909 - DNA, 658 bp, Homo sapiens
  misc_feature: GYAE6OF01D9BDM.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctctgcaaggcttctggttacacctttacaactatggtatcagttggtgcgacacggccctggacaagggcttgagtggagtgggatggatcgagcgtcttaacgaattcgggtacaacgtaaccaaaacgttatacggaccaacgaacgtaaaccccttccgaaggggccaaaggtacgtaccaacccgagttaccggaaacccaaccgaacgaacctaacgacgttaaccccgaacggaacgacccgaacccggtaccctaacgtacgtacggaccgttaggaacggacgacccgttagacgtacgtcgacggaaccgacgaccggtccgttagttacttacgtggtacgcgaagagtacgtaagggtaattacgtttgacgttcgttacccttgttacgtaccttaggtacgggcgtacgggacccgttcgg

SEQ ID NO: 196910 - DNA, 689 bp, Homo sapiens
  misc_feature: GYAE6OF01EFMJ8.39.81.H04.1.454.CMB.1.raw
  modified_base (395)..(395): a, c, t, g, unknown or other
  misc_feature (395)..(395): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcgagtgaaggtctcctgcaaggcttctggttacctacctttacaacttatggtatctagttgggtgcgacacggccctggacgaagggtcttggaggtggagtggggatggatcgaggcgtacttaacagtggtaacaaaacaacgtatgacacgaagaacctcgaggcagacgtcaactanacgaaccacagaaccacacgtacccgaacgacgaccgaccggtacctaaccgacgtacggaacctacgggaacggtacgaccgttaggacggtaacttaccggaggaacccgtacgtaacccggggtccgttaggtttaacttaccggtgtacggaccgggtaaggtaaggtaacgggttaacggggtaaattttacggtttcggtaaaccggtttcgggttaaccccttcgtttacggtaacgttacccgggtcggggaacccgttaccggggtaacccttcgggtaaccccg

SEQ ID NO: 196911 - DNA, 584 bp, Homo sapiens
  misc_feature: GYAE6OF01D505G.39.81.H04.1.454.CMB.1.raw
  modified_base (402)..(402): a, c, t, g, unknown or other
  misc_feature (402)..(402): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttaccacctttaccaacttatggtatcagttgggtgcgacaggcccctggacaagggcttgagtggatgggatggatcgagcgcttacaatggtcacacaactatgcacagaacctcgaggcagacgtcaccagtcgaccacacgacacactccgaacganaccgacggacctacagtcggacctggacggacgcctaggagactcgtagaaccgacctaccgggtccgttagttacgttacgtcgtaggacgaaggagtagtacggggtaaattagttttagacgtttcgggtacccttgtttacgtacgttacggtcggggacctacgggtacccgtcggg

SEQ ID NO: 196912 - DNA, 743 bp, Homo sapiens
  misc_feature: GYAE6OF01AVAS3.39.81.H04.1.454.CMB.1.raw
  modified_base (735)..(735): a, c, t, g, unknown or other
  misc_feature (735)..(735): n is a, c, g, or t
tcagtcgcactagtcacgaccggtgctcgatttagtagtgtagattcgcggggtgatcaggactcctcagttcaccttctcacaatgaggctccctgctcagctcctggggctgctaatgctctgggtcccaggatccagtggggatgttgtgatgactcagtctcagtctccctgcccgtcacccttggacacgccgcctccatctcctgcaggtctagtcaaacgcctgtatacattgaatacggaaaccaccttacgttagtaattggtttacagcgaggaggccaggaccaatcctaccgaagggcctaccttaaagttttacgtaacgggttttaccgtaaacccgggtactcggtacggggtaccccaaggtaaccgtaacgtacgtttaccgaaggccgggtacgtaagggttacggggtaccaacgggcctaaacgttacggtaaacttcgaaaccgtaacgttaacgaaaacgttcgaacggtaccggtaagggggtacggggaacgggtcgtaagggaacggttagggtttacggggttttagggggttttaacttacggttggacgtaagtacgaacgtaaacggtaactacgtaccgtaccggtacccgttaccgttaacgttaccgtttacgggaacccggtacggggtaaccgtaaggtaccggtaggtaacgtaacgtaaccggaaacgtaacgtggtacggtcgtacgacctaaccgtnttcgtacg

SEQ ID NO: 196913 - DNA, 681 bp, Homo sapiens
  misc_feature: GYAE6OF01A5UYJ.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttggagtggatgggatggatcgagcgcttacaatggtacacaacaaactatcgacacacgaaccctccgaagggccaaggacgtaccaaccgagtacgaccaacaacgaaccaaccactacccgaacggacgaccgaacccggaccctaacgagttaccgggaaccctagggaacgggacgtcccgtaggaacgtactccgtacgggaacccgtaaccgaccgggtcccggttagttaaccgtttacgtcggtcgacggaggtacggtaacggttaaccggggtaaatttacgttttaggaccgttccggttaaccccttcggttttaacgtacccggttaacggtaccgggggacccgtaagggggtaaccccgttaccgggg

SEQ ID NO: 196914 - DNA, 569 bp, Homo sapiens
  misc_feature: GYAE6OF01BQQ8A.39.81.H04.1.454.CMB.1.raw
  modified_base (382)..(382): a, c, t, g, unknown or other
  misc_feature (382)..(382): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcgagcgcttacaatggtcacacaaactatgacacagaacctcgagggcagagtcaccatcgaccanagacacactccacgacgcacggcctaacgatcggacctggacggacgccgtgagtactcgtacggaccgaccgacggtccgtagttacttacgtgtagacggagaggagtaacggggtaaattacgtttagacgttcggtacccttcgtttagacttacggtacgggccgaacgggtacccgtcggg

SEQ ID NO: 196915 - DNA, 606 bp, Homo sapiens
  misc_feature: GYAE6OF01CNFHT.39.81.H04.1.454.CMB.1.raw
  modified_base (274)..(274): a, c, t, g, unknown or other
  misc_feature (274)..(274): n is a, c, g, or t
  modified_base (324)..(324): a, c, t, g, unknown or other
  misc_feature (324)..(324): n is a, c, g, or t
  modified_base (341)..(341): a, c, t, g, unknown or other
  misc_feature (341)..(341): n is a, c, g, or t
  modified_base (378)..(378): a, c, t, g, unknown or other
  misc_feature (378)..(378): n is a, c, g, or t
  modified_base (410)..(410): a, c, t, g, unknown or other
  misc_feature (410)..(410): n is a, c, g, or t
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacactatggtatcagttgggtncgacaggccctggacaagggcttgagtggatgggatggatcagcgcttanaatgtacacacaaactntcgcaacagaacctcagggcagacgtcacatgaccanacgacacactccacgacgaccacggtcctaanagtcggaaccgtgacggacgtcctaggagtactcggacgaacggtaccgaccgggtcgttaggtacttacgtaggtcggacgaaggtacgtaggtacggggtaaattcggttttaacgggaccgttacgggttaacccctttcggtttacggacccggtttaagtccggggggtaccctaacgggggtaacccccg

SEQ ID NO: 196916 - DNA, 561 bp, Homo sapiens
  misc_feature: GYAE6OF01C80HM.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactatgcacagaacctcagggcaagagtcaccatcgaccacacgacacatccacgagccacggcctacatcggacctggaacggagccgtagagactcgtacggaacgaccgacggccgttagtacttacgtgtgacgagagaggtacgggaaattgttttacgacttcgggtacccttgtttacgaccgttacggtcggggaccacggggtaaccctcggg

SEQ ID NO: 196917 - DNA, 707 bp, Homo sapiens
  misc_feature: GYAE6OF01DSNCI.39.81.H04.1.454.CMB.1.raw
  modified_base (259)..(259): a, c, t, g, unknown or other
  misc_feature (259)..(259): n is a, c, g, or t
  modified_base (360)..(360): a, c, t, g, unknown or other
  misc_feature (360)..(360): n is a, c, g, or t
  modified_base (569)..(569): a, c, t, g, unknown or other
  misc_feature (569)..(569): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactntggtatcgaggttgggtgcgacacggcccctggaccaagggcttggaggtggagtggggatgggatcgagcgtacttaacaagtggactaacaacaaactntcgacaacaacgaacccgtcgaaggggacaaggacgtaccaaccagtacggaacccaacgaacgaaccaactacgtacccgaacggacgaccgaacccggaccctaacgaacggtacgggtaacctagggaacgggacgtcccgtaggaacgtaacgtccgtacggaacccggaaccgtaccggggtccgttaaggttactttaaccgnggttacggacggtaaggaaggtaacggttaaacggggttaaatttacggtttacggacgtttaccgggttaaccctttcgtttacggtaacggttacggtaccggggacccgtaaaccggggtaccccgttaccgggg

SEQ ID NO: 196918 - DNA, 611 bp, Homo sapiens
  misc_feature: GYAE6OF01DQ3KM.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttggtgcgacaggcccctggacaagggcttgagtggatgggatggatcagcgcttacaatggtcacacaaactatgcacagaacctccgagggcagagtacacatgaccacagacacactccaacgacgacacggcctaacgactcgggaacctggaacggtacgcccgttagacgaactcgtaggaacccgaccgaacgggcccgttggttaactttacgttggtgccggaaggagaggttacggggaaaatttacgttttaggacgttcgggttaacccccttgtttacggtaaccgtttaaccggtgggggtacccgtaacggggtaaaccccgtcgggg

SEQ ID NO: 196919 - DNA, 646 bp, Homo sapiens
  misc_feature: GYAE6OF01CBYEM.39.81.H04.1.454.CMB.1.raw
  modified_base (225)..(225): a, c, t, g, unknown or other
  misc_feature (225)..(225): n is a, c, g, or t
  modified_base (238)..(238): a, c, t, g, unknown or other
  misc_feature (238)..(238): n is a, c, g, or t
  modified_base (273)..(273): a, c, t, g, unknown or other
  misc_feature (273)..(273): n is a, c, g, or t
  modified_base (277)..(277): a, c, t, g, unknown or other
  misc_feature (277)..(277): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtcnctgcaaggcttcnggttacacctttacaactatggtatcagttgggtncganaggccctggacaagggctgagtggatgggatggatcgagcgacttacgaagttcggacaacaacaaactagtacgcaacaaggtaaccctaccgagggacccaaggtacgtaccaaccagacggaaccaacgaacgaacaactaacaccaacgacgaccgaccggacctaacgaacgtacggaacccaggaggacgaccgtaggaagaacgttcgacgaaccggaccgaacgggcccgttagtaacttacgtaggttcgacgaggtaaggtacgttaccggggaaaatttacggtttagacgttcccggttaacccttcgtttacggaccgttacggttacgggaccgtaacgggtacccgttaccggg

SEQ ID NO: 196920 - DNA, 695 bp, Homo sapiens
  misc_feature: GYAE6OF01EJCCD.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcgagtgaaggtctcctgcaaggtcttctggttacacctttaccaactatggtatcgagttgggtgcgacacggccctggacgaagggcttggaggtggagtggggatggatcgagcgcttacaagtggtacacgaacaactatgacacaacgaaccctccgagggacaaggacgtacaccatacgaaccacgacgaaccacaactacccaacgacgaccgacccggacctaacgacgtacggacccgtaggaacgggaccgtaccgtaggacgtaacttccggtaacggaacccggaaccggtaccgggtaccggttaacggttaacctttacgtggttacggacgggtaaaggaggtaacgggtaacggggttaaaagtttacggtttttacggaaccggtttcgggttaacccctttggttttaacgaccggtttaccggtacgggggtaacccgtaacgggggtaaccccgttccgggg

SEQ ID NO: 196921 - DNA, 742 bp, Homo sapiens
  misc_feature: GYAE6OF01DRX7R.39.81.H04.1.454.CMB.1.raw
tcagtcgcactagtcacgaccggtgctcgatttagtagtgtagattcgcgggacccaaaaaccacacccctccttgggagaatcccctagatcacagctcctcaccatggactggacctggagcattccttttcttggtggcagcaacaacaggtgcccactcccaggttcagctggtacattctggagctgagatgacgaagcctggggcctcagtgaaggtctcctgcaaggtcttcgtaggttactaccctttaccaactatggtatcaggttgggtgcgacacggcccctggacgaaggcttggagtggagtgggatggatcgacggcgtactttaacgaaagttcgggtacaaccaactaaaaaccgttatacggaccaaccgaaaccgaaaccccgttacccggaaggggaccaaaggtaccgttacccgaacccaagttaccggaaacccctaaaccggaacgaacccaaccgtaacctacccgaacgacgacccgtaaccgggtaccctaacgacgttaccggaccgtagggacgggacgtacccgtaggaacgtactaccgtacggaaccggaaccgacccggggtaccgttagttaacgtttaaccgtgggttacgacggaagtaggtacggttaacggggttaaatttaggttttacgacgtttcggttaacccctttgtttacgtaaccgttacgggtacggggacccgtacggggtaccccgttacggg

SEQ ID NO: 196922 - DNA, 717 bp, Homo sapiens
  misc_feature: GYAE6OF01CGU4X.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgaggtgaaggtctccgtgcgaagggtcttcgtggttaacctaccttttaaccaacttatgggttatcgtaggtttgggtgcgacgacggtccccgtaggaccaagggtcttggaggtggagtgggatggatcgagcgtacttaacagttggtaccaacaactaaaactatacgactaacgaacgaaccctcgaaggcaaggacgtacaaccgtagtacgaaccaacacgactaacactacccgaacgacgaccgaccggacctaacgacgtacggaccgtaggaacggaccgtaccgtaggaacgtacgttaccgtaacggaaccgtaaccggaccgggttacccggttagttaacgtttaccgcggttacgggaccggaaggtaacgtaacgggttaacggggttaaatttcggtttagtaccggtttacccggtttaccccgttagtttacggtaccgttaccgggaccggggtaccgtaaccggggtacccgttccggg

SEQ ID NO: 196923 - DNA, 596 bp, Homo sapiens
  misc_feature: GYAE6OF01DDB7D.39.81.H04.1.454.CMB.1.raw
  modified_base (332)..(332): a, c, t, g, unknown or other
  misc_feature (332)..(332): n is a, c, g, or t
tcagtcgcactagtcacgaccggtgctcgatttagtagtgtagattcgcggggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttggtgcgacaggcccctggacaagggcttgagtggatgggatggatcagcgcttacaatggtcacacaaactatgacacagaacctcagggcagatcaccatgaccacagacacatccagancaacgctacatacggacctgacggacgcctgagactctgacgacacggccgtagtattacgtgtagcgtaacgagacgtacggggaaattagttttacgacttgttacccttcgtttacgtaacttacgtcggggtaccaacggggtaaccctggtaccgtacccggttcctcccgtcgtaacgcccttaacccgaacccgaaccgggacccaacgttccggttacccgttcccccgtaccggccctaccccgtccctaacccg

SEQ ID NO: 196924 - DNA, 672 bp, Homo sapiens
  misc_feature: GYAE6OF01CBO4C.39.81.H04.1.454.CMB.1.raw
tcagtcgcactagtcacgaccggtgctcgatttagtagtgtagattcgcgggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtgggcctcagtgagtctctgcaggcttctgttacaccttacaactatgtatctaggttggtgcgacgacggcccgtaggacgaaggtcttggaggtggagtgggatggatcgaggcgtacttaacgaagttcggtaccaaccgtaaacgtaaaacttagtacgaccaaaccgaaccggtaaaccccttaccggaaggggtaccaaggtacgtacccaaaccgtaagtaccggaaacccgaacgaacgaaccgtaccaacgtacccgaacggacgaccgaaccggtaccctaacgtacggtacggacccgtaggaacgggacctccgtaggaactcgtacgtacgaaccggaccgtacggtccgttagttacgtcgtacgtgaacgagaggtacggtacgggtaatttgttacgacgttcggttacctgtttacgaccgtcggtagggacccgtcgggtacctcggg

SEQ ID NO: 196925 - DNA, 667 bp, Homo sapiens
  misc_feature: GYAE6OF01CYJOA.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtggggcctcagtgaaggtctcctgcaaggcttctggttaccacctttaccaactatggtatcaggttgggtgcgacacggcccctggacaagggcttgaggtggagtgggatggatcgagcgtcttaacgaagtggtacaacaacaaaacgtatcgacaacaacgaaacccgtccgaggggacaaggtacgtaccaccatacgaacccacaacgacaacaactccaacgacgaccaccgcctaacagtcggacctaggacggagacccgtgacgactcgacgtaaccgaaccgaccgggtaccgttaggttaacttacgttaggtcggacggtaaggaagtaacggtacggggtaaaatttcggttttaggtaccgtttcgggtttaacccctttcggttttacggtaccgtttaaccggtccgggggtaacctaacccgggggtaaccccgttaccggg

SEQ ID NO: 196926 - DNA, 621 bp, Homo sapiens
  misc_feature: GYAE6OF01C69FF.39.81.H04.1.454.CMB.1.raw
  modified_base (348)..(348): a, c, t, g, unknown or other
  misc_feature (348)..(348): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcgagcgtcttacaattggtacacaacaaactntgcacacgaacctcagggcagacgtacacatacgaccacagacaacactaccaacgacgacaccggcctaacagtcggacctggaggacgccgtagagactcgtacggaaccgaccgaccgggtccgttagttacgttacgtggtcgacggaaggaggaggttaccgggggtaaatttacggttttaggtaaccgttcgggttaacccctttgttttacggaaccgtttaccgggtacgggggtacccgaacggggtaaccccgttaccgggg

SEQ ID NO: 196927 - DNA, 748 bp, Homo sapiens
  misc_feature: GYAE6OF01DH9WR.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtcgcccactcccaggttcagctggtacagtctggagctgagatgacgaagccgtggggcctcgagtgaaggtctcctgcaggcttcgtgttacctaccttacaactagtggtatcgtaggttggtgcgacgacggacccgtggaacgaagggtcttaggaggtaggaggtgggatggactcgaggtcgtacttaacgagttcggaccaacgaacgtaaactagtacgacaacgaaccgaaccctaccggaaggggaccaacggtaacgtaccaaaccgtaacgtacgaaacccaacgaacgtaaccaaccgaactaccggaacgacgaccgaacccgtaccgtaacaacggttaccgggaaccctgggaacggaccggtacccgtaggaacgttacacggtacgaaccggaaccggtccggtaccgttagttaacgttcgtggtacggacgtaacgggtagaacgggttaaccgggttaaagttttcggttttaacggacccgtttcccggtttaacccgtttggttttaaccggacccggtttaacgggaccgggggtaaccccgttaacgggggtacccctttaccggggg

SEQ ID NO: 196928 - DNA, 756 bp, Homo sapiens
  misc_feature: GYAE6OF01B6IGD.39.81.H04.1.454.CMB.1.raw
  modified_base (380)..(380): a, c, t, g, unknown or other
  misc_feature (380)..(380): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtggggcctcgagtgaaggtctccgtgcaaggtcttctggttacacctttacaactatggtatcgtaggttgggtgcgacgacggtccccgtaggaaccgaagggtctttggacggttgggagtgggatggatcgaggcgtacttacgaagttggtacaacaaacgtaaaactntacgacaacgaacgtaaccctccgaacgggcaaggtacgtaccaaccctagtaccgaacccaacgaacgtaaccacgtaactacccgaaccgggaacgacccggtaacccggacccttaaccgaacgtaccgggaaccccgtagggaaccggtacgtacccgtagggtaaacgtacggtaccttaacgggaacccggaaccggacccgggtacgttcgttaacgtttacgttcgacggaacgaacggtaaggtaacgggtaaccggggttaaattttcggtttaacggtaccggttaccgtttacccgtttacgttttacggtaacccgttacgggtaccggggtaacccgtaaccggggtaccccgttacccggg

SEQ ID NO: 196929 - DNA, 535 bp, Homo sapiens
  misc_feature: GYAE6OF01BT9DT.39.81.H04.1.454.CMB.1.raw
  modified_base (502)..(502): a, c, t, g, unknown or other
  misc_feature (502)..(502): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggccctggacaagggcttgagtggatggggatggatcagcgcttacaatggtcacacaaactatgcacagaacctcagggcagacgtcaccatcgaccacagacacatcccacgacgcacggcctacatcggacctggaggagcctgagatcgtgaacgacgacggccgtgtattactgtgacgagagagtacggggaaattgtttgacgttggtacccttntttcgacttacgtggggccagggtaccctcggg

SEQ ID NO: 196930 - DNA, 666 bp, Homo sapiens
  misc_feature: GYAE6OF01BL8R4.39.81.H04.1.454.CMB.1.raw
  modified_base (357)..(357): a, c, t, g, unknown or other
  misc_feature (357)..(357): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcaggttgggtgcgacacggcccctggacgaagggcttgaggtggagtggggatggatcgagcgtacttacaagtcggtacacaacaaaactntcgacaacaacgaacctcgaggcaagacgtcacatcgaaccacagacacactaccaacgacgcacggacctacagtacggacctaggacggacgaccgtagaacgtacgtacgacggaaccgaaccgtacccgggtccgttaacggttactttaacggtcggttacggaccggtaaggaagggtacggttaaccgggggtaaaattttacggttttaacggacggttacggttaacccccgttgttttaaccggacgtttaaccgggtccggggggtaacccgtaaccggggttaacccgttaccgggg

SEQ ID NO: 196931 - DNA, 722 bp, Homo sapiens
  misc_feature: GYAE6OF01DIV7P.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcattcctttttcttggtggcagcaaacaacaggtgcccactcccaggttcagctggtacagtctggagctgagatgacgagccgtgggctcagtgaggtctcctgcaggcttcgtgttacctacctttaccaatgtggtatcgtaggttgggtgcgacgacggtccccgtaggaacgtaagggtcttaggaggtaggagtaggggatggtactcgacggcgtacttaacgaagtggtaccaaccgaacaaacttgtacgactaacgaaacgtaccctacgagggacaagtacgtaccaacagtacgaaccaacgacgaccaactactaccgaacggacgaccgaaccggacctaagacgttacggaacccgtgggtaacggacgtccaagggcgtacttccgggaacgtaacgacccggtaccgggtaccgttagtaactttacggcggttacggacggtaggtaacgaacgggtttaacgggtaaattttacggtttaccgtaacgggtttacccgttaacccgttttagtttacccggtaaccgtttaccggggtaccggggtacccggtaacccgggggtaccctttaaccgggg

SEQ ID NO: 196932 - DNA, 551 bp, Homo sapiens
  misc_feature: GYAE6OF01BL61H.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcgagcgcttacaatggtcacacaaactatgcacagaacctcagggcagagtcacatgaccacagacacatccacgagcacggcctacatcggacctgaggacgcctgagatctgacgacacggccgtagtacttacgtgtgacgagagagtacggggtaaattagtttagacgttcggtaccccttcgtttacgtaccttacggtacggggcccgtacggggtacccgttacggg

SEQ ID NO: 196933 - DNA, 542 bp, Homo sapiens
  misc_feature: GYAE6OF01CTQ4W.39.81.H04.1.454.CMB.1.raw
  modified_base (424)..(424): a, c, t, g, unknown or other
  misc_feature (424)..(424): n is a, c, g, or t
tcagtcgcactagtcacgaccggtgctcgatttagtagtgtagattcgcggggacccaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttggtgcgacaggccctggacaagggcttgagtggagtgggatggatcagcgcttacaatggtacacacaaactatgcaacagaacctcgagggcagatcacatcgaccacagacacactccacgacgcacggcctaacactacggacctgaggacncgtgagatcgtagacgacgacggccgtagtacttacgtgtgacgagagagtacggggaaattgtttgacgtcggtacccttatttcgaccttacggaggggcctagggtaccctcggg

SEQ ID NO: 196934 - DNA, 618 bp, Homo sapiens
  misc_feature: GYAE6OF01BTCNX.39.81.H04.1.454.CMB.1.raw
  modified_base (353)..(353): a, c, t, g, unknown or other
  misc_feature (353)..(353): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcaggttgggtgcgacacggcccctggacaagggcttggagtggagtgggatggatcgagcgtcttacaagtggtacacaacaaactntcgacaacaacgaacctcgagggacaagacgtacaaccagtacgaaccaacacgaacaccactaccgaacgacgacgacgacctacacgtcggacctggacgacgaccgtaggacgtactcgtacgaaccgacgaccggcgttagtacgttacgcggtcgacggaggacgtaggtaacggggtaatttgtttacggacgttcggttaacccttcggtttacgtacgttaccggttacggggacccgtaaggggtaccccgtacgg

SEQ ID NO: 196935 - DNA, 664 bp, Homo sapiens
  misc_feature: GYAE6OF01DPQN7.39.81.H04.1.454.CMB.1.raw
  modified_base (262)..(262): a, c, t, g, unknown or other
  misc_feature (262)..(262): n is a, c, g, or t
  modified_base (386)..(386): a, c, t, g, unknown or other
  misc_feature (386)..(386): n is a, c, g, or t
  modified_base (440)..(440): a, c, t, g, unknown or other
  misc_feature (440)..(440): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctctgcaggcttctgttacaccttacaactatggtatntagttggtgcgacaggccctggacgaaggcttgagtggagtggatggatcgagcgtcttaacagtcggtacaacaacaaactatcgacaacgaacgaacctcgacgggcaagacgtacaaccanacgaaccaacaagacacacctacacgacgccacggacctacacgtacggtaccnggacggacgccgtaggagtaactcgtacggaaccgaccggaccgggtacccgttagtttacttaacggttcgacggtaaggacggttaacgggttaacggggtaaaagttttacggttttacggtaaccggtttccggttaacccctttacgttttacggtaacccggttacgggttaccggggacccgttaaaccggggtaaccccgttcggttaaaccccgg

SEQ ID NO: 196936 - DNA, 550 bp, Homo sapiens
  misc_feature: GYAE6OF01BPOWR.39.81.H04.1.454.CMB.1.raw
  modified_base (468)..(468): a, c, t, g, unknown or other
  misc_feature (468)..(468): n is a, c, g, or t
  modified_base (528)..(528): a, c, t, g, unknown or other
  misc_feature (528)..(528): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcaggttgggtgcgacgaggcccctggacaagggcttgaggtggatgggatggatcagcgcttacaatggtcacacaaactatgcaacacgaacctcgaggcagagtacacatcgaccacgagacacactccaacgacgacacggacctacagtcggacctggaggacgctagagatcgacgacgacgacggcgtgtacttagngtcgcgagagagtacgggtaattgtttgacgttcggttacccttgttacgacgttacggngggacgtacgggtacccgtcgg

SEQ ID NO: 196937 - DNA, 648 bp, Homo sapiens
  misc_feature: GYAE6OF01EYPZ7.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacacggccctggacaagggcttgagtggagtgggatgggatcgagcgcttacaatggtcaacaacaaactatgacacagaacctcgaggcaggatcaccatcgaaccacagacacactaccacgacgcaccggcctaacagtacggaccgtggaacggacgaccgtggaacgtactccgtacggaccgaacggaccgggtccgttagttaacgtttaccgtggtacggtacggaaggtacggtaaacggttaacgggggtaaaattttagttttacgggtacggttaccggtttaccccttacgttttacggtaacccgtttaacgggtaccggggggtaacccgtaaccgggggtaaacccgttccgggg

SEQ ID NO: 196938 - DNA, 643 bp, Homo sapiens
  misc_feature: GYAE6OF01BS5UT.39.81.H04.1.454.CMB.1.raw
  modified_base (371)..(371): a, c, t, g, unknown or other
  misc_feature (371)..(371): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtgggcctcgagtgaaggtctcctgcaaggtcttcgtggttactacctttacaactatggtatcgtaggttgggtgcgacgacggccctaggaccgtaagggcttggaggtggagtgggatggactcgagcgtacttaacgaagtcggtacaacgtaacaaactntcgacaacgaacgaacctcgaggcaagacgtacacagtacgaaccacgtagaccaacacgtaccgaacgacgaccaacggacctaacgagtacggacctggaacggacgtaccgtaggaacgtactaccgtacggaaccgaaccggtacggtaccggttagtaacgtttacgtcggtacggacgtaggaacggtaggtaacgggtaattcgtttacgacgttcgttaccttgttacgtaccgtcggtacgggacctacgggtacccgttcgg

SEQ ID NO: 196939 - DNA, 634 bp, Homo sapiens
  misc_feature: GYAE6OF01EOIVT.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacacggccctggacaagggcttgagtggatgggatggatcgagcgctacatggtacacaacaactatgacacgacgaacctcgagggcagacgtcaccatacgaccaacacgaaccacactacccgacgacgaccaaccggacctaacgacgtacggacccgtagggaacggacgccgtaggaacgtacgtcgtacggaaccggaccgaaccggggtccgttagttaactttacgtcggtaggtcggaaggaaggtaggtaacggggtaaatttacgtttacggtaaccgttcggttaccccttgttttacggaccgttacgggtacggggtacccgtaggggtaaccccgttcggg

SEQ ID NO: 196940 - DNA, 788 bp, Homo sapiens
  misc_feature: GYAE6OF01CLI1L.39.81.H04.1.454.CMB.1.raw
  modified_base (377)..(377): a, c, t, g, unknown or other
  misc_feature (377)..(377): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtggggcctcagtgaaggtctccgtgcaaggtcttcgtggttactacctttaccaactatggtatcgtaggttgggtgcgacgacgggcccctaggacgaaggggtcttggaggtggagtgggatggatcgaggcgtacttaacaagttcggtacaacgaactaaaacgtntacgacaaaccgtaacggtaacccgtaccgaacggggtacaacggtaacgttaaccgaaacccgtaacgttacggaaacccaaccgaacggaaccctaaacctaaccgtaaccccgaaccgggaaccgacccggtaaacccgggtaccctttaaacgaacgttaccgggaaccgtacgggacgggtaaccgcccgttagggaacgtacgttaccgtacgggaaccgaaccggtacccgggtcccgttagttaacgttacgttcgggtacggaaccggtaggtaaggaaccgggtttaaaggggaaacttttacggtttacggtaacggtttccgggtttaacccctttagtttaaccggttacgttaacgggtacggggtaacccttaacgggggtaaaccctttaccggg

SEQ ID NO: 196941 - DNA, 678 bp, Homo sapiens
  misc_feature: GYAE6OF01DG5QF.39.81.H04.1.454.CMB.1.raw
  modified_base (265)..(265): a, c, t, g, unknown or other
  misc_feature (265)..(265): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtctcctgcaaggtcttcgtggttaccacctttaccaacttntggtatcgaggttggtgcgacacggccctggacaagggcttgagtggagtgggatggatcgagcgtacttacaagtggacacaacaaactatgacaacaacgaccctccgagggacagcgtaccaaccagtacgaccaacgacgacaacactaccgaacgacgaccgaacccggtactaacacgtacggaccgtacggacgggacgccgtaggaactacgtcgtacggaaccgaccgtacgggtaccgttagttacgttacgtcggtaggacgggaaaggtacggtaaacgggttaggggtaaaacttttagggttttaccgtaacggtttacgggtttaacccctttcggtttacgtaaccggttaaccgggttcggggtaaacccggtaccggggttaacccgttccgggg

SEQ ID NO: 196942 - DNA, 617 bp, Homo sapiens
  misc_feature: GYAE6OF01DR1L4.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcgagcgcttacaatggtcacacaaactatgcacagaaccctccgagggcagagtacaccatcgaccacaacgacacactaccaacgacgaccaaccggccctaacgacgtacggaccctaggaacggacgcccgttaggaagtacttacgtacgaaccgaccgaccgggtccgttagttaacttacgtggtcgacggagaggtaggtacggggtaaatttacgtttaggaacgttcgggttaaccccttgtttacggaccgttacggtcggggaacccgtaacggggtaccccgttacggg

SEQ ID NO: 196943 - DNA, 536 bp, Homo sapiens
  misc_feature: GYAE6OF01DGGTK.39.81.H04.1.454.CMB.1.raw
  modified_base (424)..(424): a, c, t, g, unknown or other
  misc_feature (424)..(424): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactatgcacagaacctcgagggcagagtccacatcgaccacagacacatcccaagacgcacggcctacagtcggacctgacggancctgagatcgtgaccgacaccggcgtgtattactgtgcgagagagtcgggaaattcgtttgacgttggtacccttgtttagacctacggtggggacccagggtaccctcggg

SEQ ID NO: 196944 - DNA, 714 bp, Homo sapiens
  misc_feature: GYAE6OF01C9N4X.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttctggtggcagcaacaacaggtgcccactcccaggttcagctggtacagtctggagctgagatgacgaagcctggggcctcagtgaaggtctcctgcaagcttctggtactaccttacaactatgtatcagttggtgcgacacggccctggacgaagggtcttgaggttaggagtgggagtggatacgagtcgtacttagaagtggtacaacgaacaaactatcgactacgaacgaaccctcgaaggggcagactacaccatacgaccaacacgaaccacactaccgaacgacgaccgtacggaccctaacgaagttaccggaaccgtaggaacgggacgtccgtaggacgtaacgttccgacggtaaccgaaccggtaccgggtacccggttaggttaaccgttacggttacgacgggtacggaaaggtacgggtaaccggttaacgggggttaaaacgttttcggtttaacggtaaccggtttccggttaacccccgttttgttttaaccggtaacccggtttacgggttacccgggggtaacccggttaaccccggggttaacccggtttaaccccggg

SEQ ID NO: 196945 - DNA, 562 bp, Homo sapiens
  misc_feature: GYAE6OF01BZJRL.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacacggccctggacaagggcttgagtggatgggatggatcgagcgcttacagtggtacacaacaaactatgacacagaacctcgaggcagatcaccatcgaccacagacacactccacgacgcgaccggacctacgagtacggacctggacggacgccgtagagatcgtacgacgacgaccggccgttagtacttacgtgtagacgagagtagtacggggtaaattcgtttagacgttcggtacccttgttcgtactacggtagggccgtacgggtacccgtcgg

SEQ ID NO: 196946 - DNA, 586 bp, Homo sapiens
  misc_feature: GYAE6OF01D8AEK.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttaccacctttaccaactatggtatcagttgggtgcgacacggcccctggacgaagggtcttggagtggatggggatggatcgagcgcttacgaatggtacacaacaaactatgacaacagaaccctaccgagggccaagacgtacgaccatcgaaccacacgaccaacactacccgaagacgcaacggcctaacagtccggacctggaaggacgaccgtggaagactcgtgaaccgacgccggaccgttgtattacgtgtagcgagagagtacgggtaattagtttagacgttcgttacccttgttacgtacgtacggtaggggaccacggggtaccctacggg

SEQ ID NO: 196947 - DNA, 605 bp, Homo sapiens
  misc_feature: GYAE6OF01BCXKV.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttggagtggagtgggatggatcgagcgcttacagtggtacacaacaactatgacacgacgaacctcgagggcagatcacatacgaccacacgacacactaccagacgcaccggcctaacgactacggacctaggacggacgccgtagacgtatcgtacgaccgaccgaccggtaccgttagttacgttacgtggtgacggaaggaagtacggttaacggggtaaattcgtttacgacgtttaccggttacccttacgtttacgtaccgttacggtaccggggtacctaaccggggtacccgtaccggg

SEQ ID NO: 196948 - DNA, 596 bp, Homo sapiens
  misc_feature: GYAE6OF01CT88G.39.81.H04.1.454.CMB.1.raw
  modified_base (446)..(446): a, c, t, g, unknown or other
  misc_feature (446)..(446): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaaatatggtatctagttggtgcgacaggcccctggacaagggtcttggagtggagtgggatggatcgagcggcttacgaagtggtaccacgaacaaactatacgacacaacgaaccctccgagggacagacgtacacatcgaccacagaccacatccacgagcacggcctaacagtcggacctggaacggngccgtgacgactcgtacgaacggaccgacggtccgttgtacttacgtgtcgacgaggagtacggtaggggtaaatttcgtttagacgttacggttacccttcgtttacgtaccgttacggacggggtaccgaccggggtaacccgtcggg

SEQ ID NO: 196949 - DNA, 634 bp, Homo sapiens
  misc_feature: GYAE6OF01AITLQ.39.81.H04.1.454.CMB.1.raw
  modified_base (364)..(364): a, c, t, g, unknown or other
  misc_feature (364)..(364): n is a, c, g, or t
tcagtcgcactagtcacgaccggtgctcgatttagtagtgtagattcgcggggacccaaaaccaacacccctccttgggagaatccctagatcacagctcctcaccatggactggacctggagcatccttttcttggtggcagcaacaacaggtgcccactcccaggttcagctggtacagtctggagctgagatgacgaagccgtggggcctcgagtgaaggtctcctgcgaaggcttcgtggttacctacctttaccaactatggtatcgtaggttggtgcgacacggtcccgtggacagggtcttggaggtggagtgggagtggatcgaggcgtcttacgagtcggtcaacaacaatagtnacgacgaacgacctcgacgggcagacgtacacatacgaccaactacgaacaccactaccgaacgacgacgacccggtacacgagtacggaccgtggacggacgccgtagagacttacgacgtaacgaaccggtccggaccgttagtacttacgtggtacgagtaggagacgttaaggggtaatttacgttacggacggttcccggtacctttacgttcggtaacggttaccgggtacggggtacccggttaacgggtaccccgttacggg

SEQ ID NO: 196950 - DNA, 677 bp, Homo sapiens
  misc_feature: GYAE6OF01BQZV3.39.81.H04.1.454.CMB.1.raw
tcagtcgcactagtcacgaccggtgctcgatttagtagtgtagattcgcggggccccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcgagttggtgcgacacggccctggacaagggtcttggagtggagtgggatggatcagcgtcttacgaagtggtaccaacaacaaacttatcgacaacgaacgaaccctccgaagggacaggacgtaccgaaacctagtaccgaaccaaccgtaacgaaccaacaacgtaccccgaaacggaacgacccgaaccgggcccttaacaacggtaccggtaaccgtaggaacgggaccgtaccgtaggaacgtagtaccgtacggaaccgacgaccgggtacccgttagttacttacgtgtacggaagtaggaagtacggttaacgggttaaatttacggtttacgacgttacggttacccttcgttaacgacgttacgggtacggggacccggtacgggtacccgtggtacctacccgttcctaccgtccgacgtccctaacccgg

SEQ ID NO: 196951 - DNA, 555 bp, Homo sapiens
  misc_feature: GYAE6OF01E4T0L.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttggagtggatgggatggatcgagcgcttacagtggcaacacaaactatgacacaacgaacctccgagggcagagtcaccagtgaccacagacacactaccacgagcacggacctacgatcggacctggaggacgcgtagacgatcgagacgaccgacggtccgtagtattacgtgtgacgtagagtacgtacgggaattcgtttagacgttcgttacctgtttacgacgtacgtaggggacctagggtaaccctcgg

SEQ ID NO: 196952 - DNA, 643 bp, Homo sapiens
  misc_feature: GYAE6OF01B4ULQ.39.81.H04.1.454.CMB.1.raw
  modified_base (451)..(451): a, c, t, g, unknown or other
  misc_feature (451)..(451): n is a, c, g, or t
tcagtcgcactagtcacgaccggtgctcgatttagtagtgtagattcgcgggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcaggtgaaggtctcctgcaaggtcttctggttactacctttacaactagtggtatcgaggttgggtgcgacgagccctggacaagggcttggagtggagtgggagtggatcgaggcgtcttaacgagtcggtacaacaacgtaaactatcgactaacgacgaacccgtcgacggggacagacgtcaacatagaaccagagacacataccacgacgcgacggacctacacgtcggaccnggaggacgcgtagatacgtctacggacgaacgtaccggtcgttagttacgttacgtggtacacgggaacgtaacggtacggttaaacgggtaattttacggtttacggtaacggttccgggttaacccgttttgtttaccgtaacggttaccgggtacggggtaaccgtacccggggtaacccgttaccggg

SEQ ID NO: 196953 - DNA, 596 bp, Homo sapiens
  misc_feature: GYAE6OF01CARFR.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggccctggacaagggcttgagtggagtgggatggatcgagcgcttacaatggtcacacaaactatcgcaacgagaacctccgagggcaagactacaccagtcgaaccacagaccacactaccgacgacgcaaccggcctaacgatacggacctaggaacggacgcctaggaagactcgtacggaaccgacgaccgggtccgttagttaacgttacgtggtgacggtagaggaggtacgggtaaattgttttagacgttcggttacccttgtttacgtaccgttacggtacggggtccgtaagggtaacccgtcggg

SEQ ID NO: 196954 - DNA, 752 bp, Homo sapiens
  misc_feature: GYAE6OF01D90HE.39.81.H04.1.454.CMB.1.raw
  modified_base (190)..(190): a, c, t, g, unknown or other
  misc_feature (190)..(190): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctgganctgagatgacgaagccgtggggcctcgagtgaaggtcctccgtgcgaaggtcttcgtggtttaccacctttaccaacttagtggtatcgtagttgggtgcgacacggcccctggacaagggcttaggagtggatgggatagggatcgagcgtcttacaagtcggtacaacgaactaaaactgtagactaaccaaacgggtaaacccctccggaaggggacctaaaggtacgtaccgaacccgtaggtaaccgaacccaaacgacgaaccgaactaccgtacccgaacgacgaccgtaccggaccctaacgacgtacgggtaccctagggaacggacgtaccgtaggaacgtacgtacgtacggaacccgggaacgtacccggtcgttaacgttaacgtttacgtcgtacgggtacgaacggtaaggtaacggtaaccggggttaaagtttacgttttaaccggtaccggtttaccggtttacccctttacggttttaacggtaccgtttaaccgggttaccccgggggtaccgtaaccggggtaaccccggtttaacccggg

SEQ ID NO: 196955 - DNA, 663 bp, Homo sapiens
  misc_feature: GYAE6OF01C3FFA.39.81.H04.1.454.CMB.1.raw
  modified_base (280)..(280): a, c, t, g, unknown or other
  misc_feature (280)..(280): n is a, c, g, or t
  modified_base (358)..(358): a, c, t, g, unknown or other
  misc_feature (358)..(358): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttcgtggttaccacctttaccaacttagtggtatcgtagttggngcgagaggctccgtggacaagggcttaggagtggagtgggatggatcgagcgacttacaagtggtacacaacaaactnacgacaacaacgaacctccgaaggcaagacgtaccaccatacggaaccaacgaacgaacaacaacgtacccgaacgacgacccgaaccggtaccctaacgtacgacgggtacccgtaggaacgggacgcccgtaggagactcgacgaaccgaccggacggtacccggttagtaacgtttacgtggtacgacgtaaggaaggtaacgggttaacggggtaaaatttaggtttacgaaccgtttacggtaccctttacgttacggtaaccgtagggtaccgggggtacccgaacggggttaccccgg

SEQ ID NO: 196956 - DNA, 582 bp, Homo sapiens
  misc_feature: GYAE6OF01D4MOM.39.81.H04.1.454.CMB.1.raw
  modified_base (410)..(410): a, c, t, g, unknown or other
  misc_feature (410)..(410): n is a, c, g, or t
  modified_base (474)..(474): a, c, t, g, unknown or other
  misc_feature (474)..(474): n is a, c, g, or t
  modified_base (533)..(533): a, c, t, g, unknown or other
  misc_feature (533)..(533): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacacggcccctggacaagggcttgagtggatgggatggatcgagcgcttacaagtggtacacaacaaactatgcacagaacctcgagggcagacgtcacatcgaaccacagacacatccagagcacggcctanatcggacctgacggagcctggactactcgtacgaaccgtacgacggtccgtagtaactttacgngtcgacgaaggtagacgtacggggtaaatttacgttttagacgtttcggtaccccgttntttacgaccgttaacggttacgggggacctaacggggtacccctacggg

SEQ ID NO: 196957 - DNA, 620 bp, Homo sapiens
  misc_feature: GYAE6OF01CPN0I.39.81.H04.1.454.CMB.1.raw
  modified_base (347)..(347): a, c, t, g, unknown or other
  misc_feature (347)..(347): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcgagttgggtgcgacacggcccctggacaaggcttgagtggagtgggatggatcgagcgctacaatggtacacgacaaactntcgacaacacgaacctcgagggacaggactacaccagtacgaccacagacactacaccaacgagacgaccggacctaacgagtcggaccgtggaacggacgccgtaggagtactcgtacggaaccacgaccggtcgttagtacttacgtggtcgacggaggaacgtaggttaacggggaaattttcggtttagaacggtttcccggttacccgttgtttacggaacccgtttacgggtccgggggtaacccgtacggggtaccccgttacggg

SEQ ID NO: 196958 - DNA, 703 bp, Homo sapiens
  misc_feature: GYAE6OF01C5C4J.39.81.H04.1.454.CMB.1.raw
  modified_base (359)..(359): a, c, t, g, unknown or other
  misc_feature (359)..(359): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtctcctgcaaggcttcgtaggttacctacctttaaccaacttatggttatcgtaggttgggtgcgacgacggcccgtaggaacgaagggtcttggaggtggagtggatggactcgagcgtactacgagtgtacanaacaactatgacacaacgaccgtacgaggcagtacgtacaccgtagtacgaaccacgaacgaaccaacgtaacctacccgaacgcgtaaccgaccggtacctaaccggaacgtcgggtaacccgtgggaacgtaccgaccttaggaacgacgttaccgacggaaccgaccggtacccggtccggttagttaaccgttacgttcggacggtacggaaggtaacggtaacgggttaacggggttaaaatttcggttttaacggaccgtttaccgggttacccctttgtttaccggtaacccgttaggggtacccgggacccggtaaacgggttacccggttaccgg

SEQ ID NO: 196959 - DNA, 712 bp, Homo sapiens
  misc_feature: GYAE6OF01EUFVH.39.81.H04.1.454.CMB.1.raw
  modified_base (459)..(459): a, c, t, g, unknown or other
  misc_feature (459)..(459): n is a, c, g, or t
tcagtcgcactagtcacgaccggtgctcgattttagtagtgtagattcgcgggggacccaaaaaccacacccctccttgcgagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttggtgcgacaggccctggacaagggcttggagtggatgggatggactcgagcgtacttacgaagtggtacaacgaacctaaaactacgtgacaacgaacgaaccctacccgaaggggaccaaggaacgtaccaaccaatacgaaccaacaacgaccaacactaccaacggagaccgaaccggcctaanaacgtcggacccttaggacggacgtaccctaggaacgacttaccgtacggaaccggaccgtaaccggggtcccggttaaggttaactttacgtacggtacggccggtaaagggaacggtaacggttaacgggggttaaaacttttaggtttttacgggtaacccgtttacggggttaacccccttttaccggttttacgggaaccgtttaaccgggttcggggggtacccctaaacgggggttaaacccccgg

SEQ ID NO: 196960 - DNA, 619 bp, Homo sapiens
  misc_feature: GYAE6OF01CPW3N.39.81.H04.1.454.CMB.1.raw
  modified_base (273)..(273): a, c, t, g, unknown or other
  misc_feature (273)..(273): n is a, c, g, or t
  modified_base (326)..(326): a, c, t, g, unknown or other
  misc_feature (326)..(326): n is a, c, g, or t
  modified_base (354)..(354): a, c, t, g, unknown or other
  misc_feature (354)..(354): n is a, c, g, or t
  modified_base (401)..(401): a, c, t, g, unknown or other
  misc_feature (401)..(401): n is a, c, g, or t
  modified_base (542)..(542): a, c, t, g, unknown or other
  misc_feature (542)..(542): n is a, c, g, or t
tcagtcgcactagtcacgaccggtgctcgatttagtagtgtagattcgcggggacccaaaaccacacccctccttgggagaatcccctagatcacagctcctcaccatggactggacctggagcatccttttctggtggcagcaacaacaggtgcccactcccaggttcagctggtacagtctggagctgagatgagaagcctgggcctcgagtgaaggtctcctgcgaaggcttctggttacacctttaccaatatggtatcgagttgggtncgacacggtccctggacaagggtcttggagtggatgggtatggatcgagcgtnttaacgaagtcggtacacgaacaaactntcgacacagtaaccctcgaggcagtacgcacgatcgaacacagacanactcagacgacacggcctagactaggaccgtagacggtactcgagacgtactacgtcggaaccgtaacgaccggaccgttaggtacttaccgtagtacggcgtaacggaggtaacggtaccggggttaaattacggtttanaacccggttggttaacccccttgtttacgaaccggttacggttacggggacccgtaccggggtaacccgttaccggg

SEQ ID NO: 196961 - DNA, 662 bp, Homo sapiens
  misc_feature: GYAE6OF01A4YV4.39.81.H04.1.454.CMB.1.raw
  modified_base (536)..(536): a, c, t, g, unknown or other
  misc_feature (536)..(536): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcgagtgaaggtctcctgcaaggcttcgtggttaccacctttaccaacttatggtatctaggttgggtgcgacgacggcccctggacaagggcttggagtggagtgggatggatcgagcgtcttaacaagtggtacaacaacaaactatgacaacaacgtaaccctccgagggcaagacgtaccaaccgatacgaacccacgaacgaacacaactacccaacgacgaccgacccggacctaacgacgtacggacctaggacggtacgcctaggaacgtactacgtacggaaccgaccgaccggtccgttagttacgtttacgnggtacggacgaaggtaggacggttaacggggtaaaatttggtttaggaccggtttacggttacccctttagtttacgtaaccgttacgggtaccggggacccggtaaccgggtacccggtacccgg

SEQ ID NO: 196962 - DNA, 734 bp, Homo sapiens
  misc_feature: GYAE6OF01D37TO.39.81.H04.1.454.CMB.1.raw
  modified_base (597)..(597): a, c, t, g, unknown or other
  misc_feature (597)..(597): n is a, c, g, or t
  modified_base (641)..(641): a, c, t, g, unknown or other
  misc_feature (641)..(641): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtggggcctcgagtggaaggttctccgtgacgtaaggtctttcgtacggttaacctacccttttaccaacgttagtgggttaatccgtaaggtttggggtacgccggtaaccgaccgggtcccccgttagggaaccgtaaggggtccgtttaggagggttagggtaggtaggggagttcgggaacttcgacggtaccgtacttaaccgtaaagtcggtaccaaaccgtaaactaaaacgtacgtcgaaccaaacgaaccgaaacccgttccggaagggtccaaacggtaccgtacaaccgtactaccggaaccaacgaagtaacccagaacctaccgaacgacgaccgaccggtaactacgaggtaccgacgtaggacgtacgcgtagganctacgtcgaaccggaccgtacggtcgttacttagttacggtggngtaacggagtaggtaggtaaggtacgtttagttcggaccgttcggttacccttgttacgtacggtacgtaccggggacctaccggtaccgtcg

SEQ ID NO: 196963 - DNA, 648 bp, Homo sapiens
  misc_feature: GYAE6OF01DEQ9N.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttctggtggcagcaacaacaggtgcccactcccaggttcagctggtacagtctggagctgagatgacgaagcctggggcctcgagtgaaggtctcctgcaaggtcttctggttacctacctttaccaactatggtatcgtaggttgggtgcgacacggccctggacaagggcttggagtggagtggatggatcgagcgtacttacgaagtcggtacaacaacaaactatcgacaacaacgaaccctcgagggaccaggacgtcaccagtacgaaccacaacgaacacactaccgacgagaccacggacctacacgtacggaccgtaggacggacgccgtagaacgtataccgtacggaacgtaaccggaccggtaccggttagttaacgttacgtggtacggacggtaaggaggtaacggttaacggggtaaatttcggtttacggaaccgtttcgggttaaccccttgtttacgaccgttacgggtaccgggacccgtaacgggtacccgttcggg

SEQ ID NO: 196964 - DNA, 719 bp, Homo sapiens
  misc_feature: GYAE6OF01DNZYU.39.81.H04.1.454.CMB.1.raw
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatggacgaagccgtggggcctcgagtgaaggtcctcctgcgaaggtcttcgtggttaacctacctttaaccaacgttatggttactcgtaggttgggtgaccgacgacggcccgtggacgaagggtcttggagtggagtgggatggatcgaggcgtacttaacgaagtcggtacaacgaactaaatagtacgaccaacgtaacgaaaccctcggaacgggaccaagtaacgtaccaaacccgtagtaccgaaacccaacgacgaaccaacaactacccgaacgacgccgaaccggacctaacgacgtacgggaacctagggaacggacgaccgtagaacgtacgtcgtacggaaccgtacggaccgggtaccgttacgttaacgttaccgtggacggtacggaaggtacggtaacggtacggggttaaattttacgttttacggtaccgttaccggtttaacccgtttacgtttacggtaacccgttagggtccgggggtacccgtaaccggggtaacccccgg

SEQ ID NO: 196965 - DNA, 653 bp, Homo sapiens
  misc_feature: GYAE6OF01BKQEO.39.81.H04.1.454.CMB.1.raw
  modified_base (379)..(379): a, c, t, g, unknown or other
  misc_feature (379)..(379): n is a, c, g, or t
  modified_base (501)..(501): a, c, t, g, unknown or other
  misc_feature (501)..(501): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtcgcccactcccaggttcagctggtacagtctggagctgagatgacgaagccgtggggcctcgaggtggaacggtcctccgtgacgaaggtctttacgtagttacctacctttaaccaacttatggtatcgtaggttggtgcgacacggtccccgtaggacgaagggcttggaggtggagtgggatggatcgagcgtacttaacgagtcgtacacaaacaactnacgacaacgtaacgaaccctacggaggacaggactaccgaacatacgaacccaacgacgaacacacgtaccgacgacgaccaaccgggcctaacacgtacggaccgtaggacggaccgacgnggacgtagtaccgacggtaccgaacgtacggcgttacgttacgttgtcgtacgacgtaggagtaacgggttaaggtaagtttagttgtaaccggttcgttacctttcgttacgtaccgttcgtaggggacccgtaacgggtacccgttccgg

SEQ ID NO: 196966 - DNA, 781 bp, Homo sapiens
  misc_feature: GYAE6OF01ELORE.39.81.H04.1.454.CMB.1.raw
  modified_base (214)..(214): a, c, t, g, unknown or other
  misc_feature (214)..(214): n is a, c, g, or t
  modified_base (335)..(335): a, c, t, g, unknown or other
  misc_feature (335)..(335): n is a, c, g, or t
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgagcctggggcctnagtgaaggtctcctgcaaggcttctggttaccacctttacaactatggtatcgtaggttggtgcgacacggccctggacgaggtcttaggagtggagtgggatggatcgagtccgacttanaacgtggtaccaaccgaactaaacgtgtacgactaaaccgaacgaacccgtccgaacggggaccaaggtacggtaccaacccgtaacgtacggaaacccaacgaacggaacctaaccgtaactaccccgaacggaacgacccgaaacccgggtacccctaacgtaacggttacccggaacccggttagggaacggtaaccgggtcccgttaaggaaccggtaagtaaccggtaccgggaaccggtaaacccgtacccggggttacccgtttaacggttaacgtttaaccggtcggttacgggaccgggaaggttaacgggtaaacgttaaccggggggttaaaatttacggtttaacggaacccgtttaccgggtttaaccccttacggtttacgtaaccggttaaccggttaccgggggtacccgtaacggggttaacccccggg

SEQ ID NO: 196967 - DNA, 776 bp, Homo sapiens
  misc_feature: GYAE6OF01A7NN8.39.81.H04.1.454.CMB.1.raw
  modified_base (272)..(272): a, c, t, g, unknown or other
  misc_feature (272)..(272): n is a, c, g, or t
  modified_base (347)..(347): a, c, t, g, unknown or other
  misc_feature (347)..(347): n is a, c, g, or t
tcagtcgcactagtcacgaccggtgctcgatttagtagtgtagattcgcggggacccaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttggtncgacaggccctggacaagggcttgagtggatgggatggatcgagcgacttaacaagtggtcaacgaacaaaactntcgacacgaacgaaccctaccgaggggaccaagacgttaccaaccgacgtacgaaacccaacgaacggaaccaacgtaactaccccgaacggaacgacccgaaccgggtaccctaacgtaacgtacgggaccccgtaggaacgggtacgacccgtaggaacggtacttaccgtacggaaccggaaaccgtacccggggtacccgttacggtttaaactttaccggttagggttacggaaccggggtaaaggtaacggtaaccgggtttaaaaccgggggggttaaaaacttttacggtttttaacgggtaaacccggtttaccgggttaacccccttttacgggttttaaccgtaaacccgggttttaacccgggttacggggggtaacccccgtaaaccgggggggttaaccccctttaacccggggg

SEQ ID NO: 196968 - DNA, 636 bp, Homo sapiens
  misc_feature: GYAE6OF01A59YE.39.81.H04.1.454.CMB.1.raw
  modified_base (425)..(425): a, c, t, g, unknown or other
  misc_feature (425)..(425): n is a, c, g, or t
tcagtcgcactagtcacgaccggtgctcgatttagtagtgtagattcgcgggacccaaaaaccacacccctccttgggagaatcccctagatcacagctcctcaccatggactggacctggagcatcctttcttggtggcagcaacaacaggtgcccactcccaggttcagctggtacagtctggagctgagatgacgaagccgtggggcctcagtgaaggtctcctgcaaggcttctggttactacctttaccaactatggtatcgtaggttgggtgcgacacggcccctggacgaagggcttggagtggagtggggatggatcgagcgtcttaacgaagtggtacacgaacaaactagtcgacaacacgtaaccctcgagggacagacgtcaaccatacgaccacacgacacactccacgacncgaccgacctacgagtcggacctggacggacgtccgagacgtatccgtaggaaccgacgtaccggccgttagttacgttacgtgtacggacggaaggaggtacggtaacggggttaaatttacggttttagaaccgtttcggttaccccttagttttacggaacccgttacggtaccgggggacccgtaacggggttacccgttacccggg

SEQ ID NO: 196969 - DNA, 612 bp, Homo sapiens
  misc_feature: GYAE6OF01A5784.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcgagcgcttacaatggtcacacaaactatgacacacgaacctcgagggcagagtcacatgaccacagacacactccgacgagcacggcctacgatcggacctggaggagccctaggagactcgtaggaaccgacgaccgggtccgtaggtaactttacgtggtcgacggaagtaacggacgtaaccgggggtaaaatttacgttttaggaaccgtttcggttaccccgtttacgttttacggtaaccgtttaccggtacgggggtacccgtaaccgggggtaacccccttacgggg

SEQ ID NO: 196970 - DNA, 627 bp, Homo sapiens
  misc_feature: GYAE6OF01DXFH1.39.81.H04.1.454.CMB.1.raw
  modified_base (616)..(616): a, c, t, g, unknown or other
  misc_feature (616)..(616): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggtcttctcggttactacctttaaccaacttatggtatcgtaggttgggtgcgacgacggtcccctaggacgaagggtcttggaggtggagtgggatggatcgaggcgtacttacaagttggtaccacgaactaaactagtcgacaacgaacgtaaaccctcggacgggtacaacggtacgtaccacagtacgaacccaacgaacgacaacactacccgaacgacgaccgaccggtcctaacacgtccggaacgtgggacggacgtccgtagacgtactcgtacggaaccgacgaccggtccgtagttaactgtaggcgtacgaggacgtagtacgggtaaattgtttgacttcggtacccttgtcgtactacggtggaccgnggtaccgtcgg

SEQ ID NO: 196971 - DNA, 815 bp, Homo sapiens
  misc_feature: GYAE6OF01EUKQB.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttaccacctttaccaactatggtatcgaggttggtgcgacacggccctggacaagggtcttggaggtggagtgggatgggactcgacgcgtacttaacgaagtcggtacaaccgtaactaaaactagtcgaccaacgaacgtaaccctcggaacgggcaacggacgtaccaaaccgtactacgaaacccacgaacgaaccaactaaccgtacccgaacggaaccggacccgtaaacccgggtaccctaaacgtacggtaccgggaaccgttacgggaacgggtaaccgtacccggttaaggaacggttaaccgtttaccggaacgggtaaacccggtaaccggtaacccccgggggttaccggtttaaggtttaaccgttttaaccggttagggtaccggggaacggtaaaacgggtacgggttaaaccgggttaaaacggggggtttaaaactttttacggttttaaccgggtaaccggtttacccgggttaaccccttttcgtttaacggtaacccgtttacggggtacccgggggtaacccggtaaaccggggttccccggttaacccggg

SEQ ID NO: 196972 - DNA, 758 bp, Homo sapiens
  misc_feature: GYAE6OF01BO3QU.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacacctttaccaactatggtatcgaggtttgggtgccgacgacggtcccctggacgaaggggtcttaggaggttggagtggggattgggactcgaggcgtacttacgaattcggtaccaacgaacctaaactatcgacaacacgaaacccgtccgaagggaccaaggacgtaccaaccgagtcgaacccaacgaacgaaccaaccataccccgaacgtacggacccgaaccggtaccctaacgtaacgtaccgggaaccctagggtaacgggaacctccggtaaggaacgtacgttaccgtacggaaacccgggtaaccgtacccggggtccgtttaaggtttaaccgtttacgtcggggtacgaaccgggtaaggacggtaaacgggttaacggggttaaaagtttacggttttaggtaaacccggttccggttaccccgttttacggtttacggacccggtttacgggtacccgggggaacccgtacccgggggttaaacccgttcccgggg

SEQ ID NO: 196973 - DNA, 645 bp, Homo sapiens
  misc_feature: GYAE6OF01AJJ8U.39.81.H04.1.454.CMB.1.raw
  modified_base (331)..(331): a, c, t, g, unknown or other
  misc_feature (331)..(331): n is a, c, g, or t
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacacaggtgcccactcccaggttcagctggtacagtctggagctgagatgacgaagcctggggcctcagtgaaggtctcctgcaaggcttctggttacacctttaccaactatggtatcagttgggtgcgacgcggccctggacaagggcttgacgtggagtgggatggatcgagcgtacttanaagtcggtacaacaactaaactatcgacaacgacgaacccgtcgagggcagacgtaccaccgatcgaccacacgacacactccacgacgaccacgtacctacagtcggacctaggacggacgtacctaggactacgtcgtacggaacccggaacgaccggggtaccgttagtttaaccgtttaaccggtggtaccgacggaaggtaacggtaacgggttaacgggggtaaatttacggttttacggacgtttaccgggttaaccctttgttacggaacgttacgggtcggggtacccgtaacggggttaccccg

SEQ ID NO: 196974 - DNA, 754 bp, Homo sapiens
  misc_feature: GYAE6OF01E30A7.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatcctttttcttggtggcagcaacaacaggtgcccactcccaggttcagctggtacagtctggagctgagatgacgaagccgtggggcctcgagtgaaggtctcctgcaaggtcttcgtggttaccaccttaccaactatgtatcaggttgggtgcgaccgacggccccgtaggacgtaagggcttggagtgggagtgggatggatcgaggtacgtacttaacaagtcggtacaacaactaaactagtcgacaaccgaacgaacccgtccgaagggccaaggtaacgtccaacacgtacgaacccaacgaacgaaccacctaccgtacccgaacggacgacccgaaccggtacctaacgacgtacggaccgttgggacggtacgtacctaggacgtaccgtcgtacgggaaccggtaaccggaccgggttccgttaacgttaaccttaacgggtcggttacgaacgggttaaggaacgggtaacggttaaaccggggtttaaaattttcggtttaacgtaccggtttacccgggtttaacccccgttttacgtttaacggtaaacccgggtttaccggggtaacccgggggaccccgggttaaacccggggtaaccccggttacccggg

SEQ ID NO: 196975 - DNA, 657 bp, Homo sapiens
  misc_feature: GYAE6OF01BMDQC.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcaggttgggtgcgacaggcccctggacaagggcttggagtggatggggatggatcgagcgacttacaatggtacacaactaaactatgacacacgaacctccgagggcagacgtccaaccgatacgaacccacgaacgaccacactacccgaacgtacgaccgaacccggtacctaacgagtaccgggaccctgggaacgggacgcccgttagacggtactaccgtcggaaccgaccgtaaccggggtcccttaggttaactttaccgtggttcgacggtaaggaggtacggttaacggggtaaatttacggttttagaccggtttcggttaaccctttcgttacgtaccgttacgggtacggggtaacccgtacggggtaacccgttcggg

SEQ ID NO: 196976 - DNA, 627 bp, Homo sapiens
  misc_feature: GYAE6OF01B5EBG.39.81.H04.1.454.CMB.1.raw
  modified_base (325)..(325): a, c, t, g, unknown or other
  misc_feature (325)..(325): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacacctttacaactatggtatcagttggtgcgacacggcccctggacaaggtcttgagtggatgggatggatcgagccgtntaacaagtggtacacaacaaactatgacacgaagaaccctccgagggacaaggacgtaccacctagtcgaaccaacgacgaaccaacacgtacccgaacgacgacccgtaacccgggacccttaacgaacgtaccggaacctagggacggacgtcccgtagacgtactcgtacgaacgaccgacggtaccggttgtaacttacgtgtcgacggagtacgaggttaacgggtaatttcgtttagacgttcggttacccttgtttacgtacgttacggagggtcccggtaaggacccgtaccgg

SEQ ID NO: 196977 - DNA, 616 bp, Homo sapiens
  misc_feature: GYAE6OF01B7F3W.39.81.H04.1.454.CMB.1.raw
  modified_base (505)..(505): a, c, t, g, unknown or other
  misc_feature (505)..(505): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttaccacctttaccaactatggtatcagttgggtgcgacacggccctggacaagggcttgagtggatgggatggatcgagcgcttacaatggtacacacaaactatcgacacacgaacctccgaggcagagtcacatcgaccacagacacactaccaacgacgacaccggacctaacgagtacggacctaggaacgggacgccgtaggaacgtacgttccgtacggaacccggaaccgacccgggtccgttagttactttacgnggtgacggtaggaggtacggtaacggggtaaatttcgttttaggacgttcggttacccctttgtttacggtaccgttacggtacggggaccgtaacgggtacccgttcggg

SEQ ID NO: 196978 - DNA, 818 bp, Homo sapiens
  misc_feature: GYAE6OF01D6MPQ.39.81.H04.1.454.CMB.1.raw
  modified_base (356)..(356): a, c, t, g, unknown or other
  misc_feature (356)..(356): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactccccaggttcagctggtacagtctggagctgagatgacgaagccgtggggcctcagtgaaggtctcctgcaggcttctggtacacctttacactatgtatcaggttgggtgcgacgacggccctggacaagggtcttgagtggagtgggagtggatcgaggcgtcttaacaagtcggtacaactaactaaactntacgaccaacgaacgtaacccgcgaaggggcaaacggacgtaccaaccgtaactacggaacccaacgaacggaacctacctaactaccccggaacgacgacccgtaacccgggacccttaacgaacgttaccgggaacccgtagggaaccgggtacgtacccgttacgggaagtaacctcgggtaaccggaaccggaacccgggtacccggggttaacccgtttacggtttaaacgtttaccgggttacgggtacgggtaaccgggttaaggaaggggttaaacggggttaaacgggggttttaaaaacgtttttaaccgggtttttacggtaacccggtttttaccggggtttaccccctttttaacgggtttaacccggggtttaaacggttaaaccccggggttaccgggggggttaaacccccggtaacccggggggttaaaccccgttacccggggg

SEQ ID NO: 196979 - DNA, 571 bp, Homo sapiens
  misc_feature: GYAE6OF01EGMZ4.39.81.H04.1.454.CMB.1.raw
  modified_base (345)..(345): a, c, t, g, unknown or other
  misc_feature (345)..(345): n is a, c, g, or t
  modified_base (415)..(415): a, c, t, g, unknown or other
  misc_feature (415)..(415): n is a, c, g, or t
  modified_base (529)..(529): a, c, t, g, unknown or other
  misc_feature (529)..(529): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggccctggacaagggcttgagtggatgggatggatcagcgcttacgaatggtcaacactaaactntgcaacgagaacctcgagggcaagagtcaccagtcgaccacagacacactccacgagacgacgcctaacngtacggacctaggacggacgccgtgacgtatcgagacgacgacggccgtagtacttcgtagtcgacggagaggacgtacggggtaaattagtttacgacgttcggtacccgttntttacgtacgttacggtacgggaccgtacgggtacccgtcgg

SEQ ID NO: 196980 - DNA, 649 bp, Homo sapiens
  misc_feature: GYAE6OF01D2794.39.81.H04.1.454.CMB.1.raw
  modified_base (357)..(357): a, c, t, g, unknown or other
  misc_feature (357)..(357): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttaccacctttacaactatggtatcaggttgggtgcgacgacggccctggacgaagggcttgaggtggatgggatggatcgagcgacttaacgaattggtacaacaactaaactntagcaacacgaaccctccgaggcaaggacgtacaccagtcgaaccagaacgacacataccaacgacgaccgacgctaacgtagtcggaccgtaggacggacgcctagagtactcgtacgaaccgaccgacgggtccgttagttaacttacgtacggtacggacggtaaggaacggtacggttaacggggtaaatttaggttttacgtacggtttaccggttaacccgtttcgtttaacggttaaccgttacgggttacggggtaccggtaccggggttaacccgttaccggg

SEQ ID NO: 196981 - DNA, 625 bp, Homo sapiens
  misc_feature: GYAE6OF01ALQ4A.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttggtgcgacaggcccctggacaagggcttggagtggagtgggatggatcgagcgcttacaagtggtcaacacaaactatgcacagaacctccgaggcagacgtcacatcgaccacagacacactaccacgacgccacggcctacgagtcggacctggaggacgcgtagacgactcgtagaccggaacgaccgggtccgtagttaacttacgtggtacggacggaggaggtaacggtacgggggtaaaatttacggttttaggtaacgttccgggttaaccccttacggttttaccggaaccgtttaccgggttaccgggggaaccccgtaaccgggggtaaaccccgttaccgggg

SEQ ID NO: 196982 - DNA, 589 bp, Homo sapiens
  misc_feature: GYAE6OF01ERPJF.39.81.H04.1.454.CMB.1.raw
  modified_base (334)..(334): a, c, t, g, unknown or other
  misc_feature (334)..(334): n is a, c, g, or t
  modified_base (377)..(377): a, c, t, g, unknown or other
  misc_feature (377)..(377): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctccttcaaggcttctggttacacctttaccaactatggtatcagttggtgcgacaggccctggacaagggcttgagtggagtgggatggatcgagcgctacaatggtcanacaaactatgacacagaacctcgaggcagagtcacatgaccanagacacactccaacgagccacggacctaacagtcggacctggaggacgccgtgacgatcagaccgacgacggtccgtagtacttacgtggtcgacggtagaaggacggttaacggggtaaaatttaggttttcggaacgttcggttaccccttacgttttacgaaccgttacggtacgggggaaccctaacggggttacccgtgggtacccg

SEQ ID NO: 196983 - DNA, 606 bp, Homo sapiens
  misc_feature: GYAE6OF01EU0VP.39.81.H04.1.454.CMB.1.raw
  modified_base (349)..(349): a, c, t, g, unknown or other
  misc_feature (349)..(349): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcgagtgaaggtctcctgcaaggcttctggttacacctttaccaactatggtatcagttgggtgcgacacggcccctggacaagggtcttggagtggatggggatggatcgagcgcttacatggtacacaacaactntgacacagacctcgaggcagagtcaccatcgaaccacgagacaacactccaacgacgaccgacggacctaacagtacggacctaggagacgctagagtactcgtagaaccgacgaccggtcggttagtacgtttacgtggtacggcgaaggtacggtaggtaaccggggtaaatttcgttttaggacgttcggttaccccttgtttaccggaacgttacgggaccgggtaccggtaaccggggtacccgttaccggg

SEQ ID NO: 196984 - DNA, 566 bp, Homo sapiens
  misc_feature: GYAE6OF01EUBWT.39.81.H04.1.454.CMB.1.raw
  modified_base (344)..(344): a, c, t, g, unknown or other
  misc_feature (344)..(344): n is a, c, g, or t
  modified_base (410)..(410): a, c, t, g, unknown or other
  misc_feature (410)..(410): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacaccttttaccaactatggtatcagttggtgcgacaggcccctggacaagggcttgagtggatgggatggatcgagcgcttacaatggtcacgacaaatntgcactagaacctccagggcagacgtcaccatgaccacagacacactccaacgagcacggacctanatcggacctggagacgccgtgaagactctaggacgaaccgacggtcgtagttacttaacgtcggtagcgagtacggagtacggggtaaattcgtttagacgttcggttacccttgtttacgaacttacgggtgggaccgaagggtacccttacggg

SEQ ID NO: 196985 - DNA, 567 bp, Homo sapiens
  misc_feature: GYAE6OF01CXYK4.39.81.H04.1.454.CMB.1.raw
  modified_base (406)..(406): a, c, t, g, unknown or other
  misc_feature (406)..(406): n is a, c, g, or t
  modified_base (440)..(440): a, c, t, g, unknown or other
  misc_feature (440)..(440): n is a, c, g, or t
  modified_base (448)..(448): a, c, t, g, unknown or other
  misc_feature (448)..(448): n is a, c, g, or t
  modified_base (491)..(491): a, c, t, g, unknown or other
  misc_feature (491)..(491): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacaccttttaccaactatggtatcagttggtgcgacaggcccctggacgaagggcttgagtggagtgggatggatcaggctacttacaatggtcacaacaaactatgcaacagaacctccgagggcagacgtacaccatcgaccacacgacacactccacgancgaccggcctaacagtcggacctaggacgggacnccgtgganattccgagaccgacgaccggtcgtatagttacgtgtcgaaggngtagacggttagggaaatttgttagtacgtcggttaccctgtttacgacgtacgaggggcctaagggtaccctcgg

SEQ ID NO: 196986 - DNA, 676 bp, Homo sapiens
  misc_feature: GYAE6OF01BWY9A.39.81.H04.1.454.CMB.1.raw
tcagtcgcactagtcacgaccggtgctcgatttagtagtgtagattcgcggggcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggtcttggagtggatgggatggatcagcgacttacaagtggtacacaacaaactatgacacacgaacctccgagggcagacgtacacatcgacacagacacactccgacgacgaccacggcctacgagtcggacctggacgacgcctaggacgactcgtacggaaccgaacgtaccgggtaccgtagttaacgttaccgtaggtacggacggaaggtaacggtagggttaaccggggtaaaatttacggttttacggaacgttaccgggttaacccctttcggttttaaccggtaccgttaccgggtacggggggaaccccgtaaccgggggttaacccccttggggttacccctaacccgggtttacccgtaccccgttaccggaaccccggttcccccgtaaacccccggg

SEQ ID NO: 196987 - DNA, 721 bp, Homo sapiens
  misc_feature: GYAE6OF01COIT8.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtggggcctcgagtgaaggtctctgcaaggcttcgtggttacctacctttaccaatagtggtatcgaggttgggtcgcgaacgcggtccccgtaggacgaaggggtcttaggacggtggtagtggagtggatcgagcgtactacgaagtggtacaactaacaaactgtcgacaacgaacgtaacccgtaccgagggcaagacgtacaacgatacgaccaagacgacactacaccgaacgacgaccgaaccggtacctacgtaacgtacggaaccgtagggaacggacgaccgttagaacggtacgtacgtacggaacgaaccgggtacccggtaccggttagttaaccgtttaacggtcggtacggaacgggtaacgtaagggtaacgggttaacggggttaaagtttttaacgggtttacgtaaccggtttccggttaaccctttcggtttaacggtaccggtttacgggtaccgggggtaaccgtaacccgggggttaaccctttacccgggg

SEQ ID NO: 196988 - DNA, 624 bp, Homo sapiens
  misc_feature: GYAE6OF01CO26Q.39.81.H04.1.454.CMB.1.raw
  modified_base (505)..(505): a, c, t, g, unknown or other
  misc_feature (505)..(505): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtctcctgcaaggcttctgttacacctttaccactatggtatcagttggtgcgacacggcccctggacgaagggcttgaggtggagtgggatggatcgagcgtacttacaagtggtacaacgaactaaaactatcgacaacgaacgaccctcgagggcagacgtcacagtcgaccacgacgacacactaccacgacgaccgacggacctacgagtcggacctggaacggacgccgtaggacgtactcgtacgaccgacgaccggtcgttagtacgtttacgnggtcggacgaaggacggtaacggtagggtaaaatttcggtttaggtaaccgttccgggttacccttacgtttacggaccttacgggtaccggggaccgtaacggggtacccgttacggg

SEQ ID NO: 196989 - DNA, 650 bp, Homo sapiens
  misc_feature: GYAE6OF01BIY30.39.81.H04.1.454.CMB.1.raw
  modified_base (318)..(318): a, c, t, g, unknown or other
  misc_feature (318)..(318): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacacggccctggacgagggcttggagtggagtgggatggatnagcgtcttacaagtggtacacgaactaaactatagacaacacgaaccctcgagggcaagagtacaccatacgaaccacgacgtacacgatcccgaacgacgacccgaccggacctaacgacgtacgggaaccctggaacgggcgtaccctaggaacggtaactccgtacggaaccgaaccgaccgggtaccgttagttaacgtttaacgtggttacgaccggtaaggaacggtaacggtaaccggggttaaagttcgttttagacggttcggtttaacccttcgtttaacggacgttacggtacggggacccaaggggtaaccccgttcggg

SEQ ID NO: 196990 - DNA, 655 bp, Homo sapiens
  misc_feature: GYAE6OF01BRS2R.39.81.H04.1.454.CMB.1.raw
  modified_base (352)..(352): a, c, t, g, unknown or other
  misc_feature (352)..(352): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcgagtgaaggtctcctgcaggcttcgtggttacacctttaccaactatggtatcagttgggtgcgacgacggccctggacgaagggcttggagtggagtgggatggatcgagcgacttacagtggtacacacaaactangacacaacgaacctcgagggacagacgtaccaccagtacgaaccacacgaacacactacccgacgacgaccgaccggtacctaacgtagtaccggacccgtaggaacgggacctccgtagacgtactccgacggtaaccgaaccggaccgggtcccgttaggttaacttacgtggtacggacggtaaggtacggtaacggttaacgggtaaatttcggttttacggacgtttcccggttaaccctttcggtttacggaccgtttacgggaccggggtaccgtaacgggtaacccggttccggg

SEQ ID NO: 196991 - DNA, 734 bp, Homo sapiens
  misc_feature: GYAE6OF01DM7F2.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacctacctttaccaactatggtatcgtagttgggtgcgacacggccctggacgaaggcttgagtggagtgggatggatcgaggcgtacttaacgaagttcggtacaacaacaaactagtcgacaacgaacgtaaccctaccgaagggcaaggacgtacccaacctaacgtacggaacccaacgaacgaaccaacgactacccgacggaaccgaccgaaccggtccctaacgaacgtcggtaaacccgtagggaacggtacgcccgttaaggaacgtacgttaccgacggaaacccgtaaccggaacccgggttccgtttaacggttaactttaaccggtacgggttcggaacccggttaaaggaacgggtaacggttaaaccgggggttaaaattttacggttttacgaaccggtttcccgttaacccgttacgtttacggtaaccgttaccgggtacggggtaccccgtacgggtaacccccgttcgggg

SEQ ID NO: 196992 - DNA, 616 bp, Homo sapiens
  misc_feature: GYAE6OF01AI9VC.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgtccactcccaggttcagctggtacagtctggagctgagatgacgaagcctggggcctcagtgaaggtctcctgcaaggcttctggttacacctttaccaactatggtatcagttggtgcgacaggcccctggacgaagggcttggagtggagtgggatggatcgagcgtcttacgaagtcggtcaacactaaactagtgacacacgaaccctcgagggcaggacgtacaaccatacgaccacacgacacactaccgacgacgaccgacgcctaacacgtacggaccgtaggacggacgtccgtagacgtactcgtacggaaccgacgaccgggtacgttaggtacttacgtgtacgacggagtaggacgttaacggggtaatttacgtttagaccgttcgttaccccgttcgtttacgaccgttacggttacggggacccgtacgggtaacccgttcggg

SEQ ID NO: 196993 - DNA, 664 bp, Homo sapiens
  misc_feature: GYAE6OF01D5PXJ.39.81.H04.1.454.CMB.1.raw
  modified_base (396)..(396): a, c, t, g, unknown or other
  misc_feature (396)..(396): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctctgcaggcttctggttacacctttaccaactatggtatctagttgggtgcgacacggcccctggacgaagggtcttgagtggagtggggatggatcgagcgtcttaacagtggtacacaacaaactatagacaacgaacgaaccctcgaggacagagtcaccatcgaccanacgacacactaccgacgacgacgacgacctacgacgtacggaccgtaggaacggacgaccgtagacgtacgttaccgacggaaccggaaccgaccgggtaccgttaggttaacgttacgttggtacggacggaaggtacggtaacgggtaacggggttaaactttacggttttacggaccggtttaccggttaccccgtttacgttttaccggtaaccgttaccgggtaccggggtacccgtaaaccggggttaccccgttaccgggg

SEQ ID NO: 196994 - DNA, 624 bp, Homo sapiens
  misc_feature: GYAE6OF01A4P8S.39.81.H04.1.454.CMB.1.raw
  modified_base (275)..(275): a, c, t, g, unknown or other
  misc_feature (275)..(275): n is a, c, g, or t
  modified_base (346)..(346): a, c, t, g, unknown or other
  misc_feature (346)..(346): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtncgacaggcccctggacaagggcttgagtggatgggatggatcgagcgcttacaagtggtcacacaaaactntcgacacacgaacctcgagggcagacgtcaccagtcgaaccacagaccaacactacccacgacgccaacggacctacgagttacggaccgttaggacggacgcccgtaggaacgactccgtaggaaccgaacgaccgggtccgttagttaacttacgtggtacggacgaaggagtacggttaacggggtaaactttagttttagacggtttacccggttacccttcgtttacgaccgttacggtaccggggacccgaacggggttaccccgttccggg

SEQ ID NO: 196995 - DNA, 625 bp, Homo sapiens
  misc_feature: GYAE6OF01EF9RI.39.81.H04.1.454.CMB.1.raw
  modified_base (255)..(255): a, c, t, g, unknown or other
  misc_feature (255)..(255): n is a, c, g, or t
  modified_base (355)..(355): a, c, t, g, unknown or other
  misc_feature (355)..(355): n is a, c, g, or t
  modified_base (396)..(396): a, c, t, g, unknown or other
  misc_feature (396)..(396): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcgagtgaaggtctcctgcaaggcttctgttacacttacaatntggtatcgtagttggtgcgacacggcccctggacaagggtcttaggaggtggagtgggatgggatcgagcggtacttaacagtcgtacaacacaaacttncgacacaacgacctcgaggcaagcgtacacagtacgaccanagacaacactaccgacgacgacgacgcctacgagtaccggactggacggacgccgtagacgtatacgacggaaccgacgtacgggtcccgttagttaacgttacgtggtacgaggaagtaggtacggttaacgggttaatttacggtttcggtaaccggttccggttaaccccttcggtttacgtaacggttacgggaccgggtaccgtaaccggggtaccgttaccgg

SEQ ID NO: 196996 - DNA, 570 bp, Homo sapiens
  misc_feature: GYAE6OF01CDIBW.39.81.H04.1.454.CMB.1.raw
  modified_base (343)..(343): a, c, t, g, unknown or other
  misc_feature (343)..(343): n is a, c, g, or t
tcagtcgcactagtcacgaccggtgctcgatttagtagtgtagattcgcgggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcgagcgcttacaatggtcacacaaactntgcacagacctcagggcagagtcacatgaccacacgacacactaccacgagccaccggcctacagtcggaccctggacggacgccgtgaacgatcgtacgaccgacgaccgggccgttagttacttactggtcgacgagagagtacggggtaaattgttttagacgttcggtaccccttgtttacgtacttacggtacggggacccgtacggggtaacccgtccggg

SEQ ID NO: 196997 - DNA, 775 bp, Homo sapiens
  misc_feature: GYAE6OF01CRAWM.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtggggcctcagtgaaggtctcctgcaaggcttctggttactacctttaccaactatggtatcgtaggttgggtgcgacacggtcccctaggacaagggtcttggagtggagtggggatggatcgagcgtacttacgaagtcggtaccaacaactaaaactcgtacgacaaccgaacgtaaacccgtccgaacggggtacaacggtaacggtacccaaccgtagtaccgaaccctaacgaacggaacccaacctaacgtaccccgaacgggaacgaccccgaacccggtacccttaaccgacggttaccgggaacccgttacgggaacgggaccggtacctaagggtaacgtaacgtccgtaacggaacccggtaaccggtaccgggttaccggttgtttaacgtttacgtacgggtacggaacgggtaggtaacggtaacggttacgggggtaaacttttaggtttacggtaaccggtttcccgggttttaccccttaggttttaccggtaaccggtttaccggggtccggggtacccggtaaaccggggttaaccccgttacccggg

SEQ ID NO: 196998 - DNA, 665 bp, Homo sapiens
  misc_feature: GYAE6OF01A4DFJ.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatcctttctggtggcagcaacaacaggtgcccactccccaggttcagctggtacagtctggagctgagatgacgaagccgtggggcctcagtgagtctctgcagtctctggttacaccttacaactatggtatctaggttggtgcgacgacggccctaggacgaagggtctaggagtggagtgggatgggactcgaggcgtacttaacaagttcggtacaacgtaactaaactatcgacaacgtaacgaaccctcgaggaccaagacgtacaccatacgaacccacgaacgaccacactaccgacgacgaccgaaccggtcctaactagtaccggaccgtaaggacggacgtaccgtaggaacgtactacgtacggaaccgtaaccggacccggttaccgttagttacttacgtggacgacggaaggtaaggaacggttaagggttaaatttacggttttcggaaccggtttacggttaccctttagtttaccgtaacgttacgggtaccggggtaccctaacgggtaccccgttacggg

SEQ ID NO: 196999 - DNA, 660 bp, Homo sapiens
  misc_feature: GYAE6OF01A761I.39.81.H04.1.454.CMB.1.raw
tcagtcgcactagtcacgaccggtgctcgatttagtagtgtagattcgcggggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacacctacttgaattggttcagcagacggccaggcccaatcctaccgaaggccgtacccttaaagttttataaacggttttccgtaaacccgggtacttaccggttcggggttaccccaaggaaccgtaaggtaactttacgaacggtccgggactaagggttcggggtaccaagggtaccctaacgtaggtaaactttaccaacgtactaagtaaaaactcgaaggaccgtaggggtacgggtagggaccttagggaaggtacgtttgggttttaggggttttaattacgtggtactagtagacgaacggtaaacactacgtacggccttaccgtactacgtttacggaccgagggaacctagcgtaggacgaatacgaaacgactgtacgtctacgacactagtcgttacg

SEQ ID NO: 197000 - DNA, 655 bp, Homo sapiens
  misc_feature: GYAE6OF01DP4HA.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatctagttgggtgcgacacggcccctaggacgaagggtctgagtggagtgggatggatcgaggcgacttacaagtggtacaacaacaaactatcgacaacgacgaaaccctccgaaggggtacaaggacgtaccaaccgatacggaaccaacgaacgaacctaacgactacccaacggaacgaccgaacccgggtcctaaacgactacgggaccctaggacggaacgtcccgtaggaagcgttaccgtacggaacctaccggaccggtccgttagttaacttacgtggtacggacgaaggtacgaggttacggggtaaatttagtttaggacgttcggttaacccttgtttacgtacgttacggtgggaacccgtaaggggtacccgtacggg

SEQ ID NO: 197001 - DNA, 676 bp, Homo sapiens
  misc_feature: GYAE6OF01CEKYL.39.81.H04.1.454.CMB.1.raw
  modified_base (310)..(310): a, c, t, g, unknown or other
  misc_feature (310)..(310): n is a, c, g, or t
  modified_base (556)..(556): a, c, t, g, unknown or other
  misc_feature (556)..(556): n is a, c, g, or t
tcagtcgcactagtcacgaccggtgctcgatttagtagtgtagattcgcggggacccaaaaaccacacccctccttgggagaatccctagatcacagctcctcaccatggactggacctggagcattccttttcttggtggcagcaacaacaggtgcccactcccaggttcagctggtacagtctggagctgagatgacggaagccgtggggcctcgaggtaggaacggtctccgtgacgtaagggtctttacgttacggttaacctacccttttaaccaaacttagttacggtaatcgtaggtttgggngcgaacgacggtcccgtaggacgaagggtcttaggaggtggagtgggatggatcgagcgtactaacgaagtcggtacaacaacgaaactagtacgacaacgaacgacccgtacgagggacagacgtacaaccgtatacgaaccaacgaacgaaccacactaccgaacgacgaccacggacctacgagtcggactggagcgacgtgactctcgacgaccgacgaccggtcgttaatacgtttacggngtacggacgtaggaacgtacgggttaaggtaaactttggtttacgacggttcccggtttaccctttagttacggtaaccgttacgggtccggggtaaccctaacggggttaccctccggg

SEQ ID NO: 197002 - DNA, 566 bp, Homo sapiens
  misc_feature: GYAE6OF01BF69Z.39.81.H04.1.454.CMB.1.raw
  modified_base (476)..(476): a, c, t, g, unknown or other
  misc_feature (476)..(476): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggccctggacaagggcttgagtggatgggatggatcgagcgcttacaagtggtcaacaacaaactatgacaacacgaacctccgagggcagacgtcaccatgaccacagaacacactccaacgacgcgacgcctaacgatcggactggacggacgccgtagagacttcgagaacgacgacggtcgtagtattacgngtacgcgagaggacgtacgggtaaattgtttacgacgttcggtacccttgtttacgacttacggtaggggaccctagggtacccgtacgg

SEQ ID NO: 197003 - DNA, 614 bp, Homo sapiens
  misc_feature: GYAE6OF01C3QAG.39.81.H04.1.454.CMB.1.raw
  modified_base (200)..(200): a, c, t, g, unknown or other
  misc_feature (200)..(200): n is a, c, g, or t
  modified_base (516)..(516): a, c, t, g, unknown or other
  misc_feature (516)..(516): n is a, c, g, or t
  modified_base (577)..(577): a, c, t, g, unknown or other
  misc_feature (577)..(577): n is a, c, g, or t
  modified_base (584)..(584): a, c, t, g, unknown or other
  misc_feature (584)..(584): n is a, c, g, or t
  modified_base (590)..(590): a, c, t, g, unknown or other
  misc_feature (590)..(590): n is a, c, g, or t
  modified_base (607)..(607): a, c, t, g, unknown or other
  misc_feature (607)..(607): n is a, c, g, or t
tcagtcgcactagtcacgaccggtgctcgatttagtagtgtagattcgcggggtgatcaggactcctcagttcaccttctcacaatgaggctccctgctcagctccgtggggctgctaatgctcgtgggtcccaggatccaggtggggatgttgtgatgactcagtctccagtcctccctgcccgtccacccgttggacncgccgcctccactctcctgcaggtactacgtacaaacgcctagtatacattgataggaaccaccttacttagtaattgtttacagtcagacggccaggccaactcctacgacgacgtaccttaaagtttacgttaaacggtttccgtaaaccgggtactaccgggtaccggggtaccccaagactaagtacttacgaggacggcgtaggtggtcaggacctacgtagtaattcaacaaccgttagtaaaactcgagtacggtagggacggtaggtcgtaggtaaggtaggtttagggtttagggtttacttaacgngtacgtagtacgacgtaacgaactacgacgtcgtctacgtctaggttcgacgtaggacagngagcganacgaanacgtgagtctacgcacncgtgtac

SEQ ID NO: 197004 - DNA, 670 bp, Homo sapiens
  misc_feature: GYAE6OF01ENPK2.39.81.H04.1.454.CMB.1.raw
  modified_base (570)..(570): a, c, t, g, unknown or other
  misc_feature (570)..(570): n is a, c, g, or t
  modified_base (584)..(584): a, c, t, g, unknown or other
  misc_feature (584)..(584): n is a, c, g, or t
  modified_base (589)..(589): a, c, t, g, unknown or other
  misc_feature (589)..(589): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtcgcccactcccaggttcagctggtacagtctggagctgagatgacgagccgtgggcctgagtgaaggtctctgacgaggtcttcgtgttacctacctttacaacttagtaggtatcgtaggttgggtcgacgacgacggtccccgtaggacgtagggtcttggaggttggagtgggtatgggactcggacgaccgtacgtttaacgaaggttcggtacaaaccgtaaactaaacgtagtccgaaccgaacgtaaccgaaaccggttcccgaaggggaccctaaggtaaccgtccaaaccggtacttacggaacccaacgacgaacctacaaccgtaccgaacgacgtaccgaccgtactacgacgtcggactagggacgacgtccgagacgcgtagtacggacacgaccgggtntacggtatacggtnacggngaacgtggaggttagttaagttctaggtacgtcttaccgtgttaacgtacgtaccggtagggaccgtacggtccggtaccg

SEQ ID NO: 197005 - DNA, 682 bp, Homo sapiens
  misc_feature: GYAE6OF01EMHP5.39.81.H04.1.454.CMB.1.raw
tcagtcgcactagtcacgaccggtgctcgatttagtagtgtagattcgcggggacccaaaaaaccacacccctccttgggagaatcccctagatcacagctcctcaccatggactggacctggagcattcctttttcttggtggcagcaacaacaggtgcccactcccaggttcagctggtacagtctggagctgagatgacgaagccgtgggcctcagtgaaggtctctgcaaggtcttcgtgttactacctttacaacttatggtatcgtaggttggtgacgacacggcccctaggacgaagggtcttgagtggagtgggatggactcgagtcgtacttaacaagtcggtacaactaacgtaaaacttagtacgacaacgaacgtaaccccgtacgaacggggtacaaggtacgtaccgaaccaagtacgaaccaacgaacgaaccaacactaccgaacgacgaccgaccggacctaacgagtaccgacgaggacgacgtccgtagacgtactcgtacgaacgaccgacggtccgttagttacttacgtggtacgaggaaggtacgtacgggtaacgggttaaagtttacgtttaggacccgtttacggttaccccgtttagttaccgtaaccggtttacgggtaccggggaacccggtaccgggtaaccccggttacgg

SEQ ID NO: 197006 - DNA, 804 bp, Homo sapiens
  misc_feature: GYAE6OF01ADZU2.39.81.H04.1.454.CMB.1.raw
  modified_base (180)..(180): a, c, t, g, unknown or other
  misc_feature (180)..(180): n is a, c, g, or t
  modified_base (611)..(611): a, c, t, g, unknown or other
  misc_feature (611)..(611): n is a, c, g, or t
tcagtcgcactagtcacgaccggtgctcgatttagtagtgtagattcgcgggacccgaaaaccaacacccctccttgggagaatccctagatcacagctcctcaccatggactggacctggagcattcctttcttggtggcagcaacaacaggtcgcccactcccaggttcagctgtacngtctggagctgagatgacgaacgccgtggggcctcgaggtaggaacggtctccgtgccgaaggtccttcgtacggttacctaccgttttaccaacgttagtcggttactcgtaaggttgggtcgaccgacgtacggccccgttagggaccgtaagggtccttaggagtgggtaggttacggggatacgggtaatcggacgtcgtacgtttaacaaggttcggtaaccaacctaacgtaaactacgtacggaacctacgaaaccgtacccgtacgaaggggacctaagggtaccgttaaccaccgtaacgtaccgaaccggacctaacggacctaaccaccgtaacccgaacggacgtacccgaccgtaacccgtaccgaacggtaccggtaaccgacgggtaacggaccgacccttagggaaccgttaacncggttaacccggaaccgtaaccggtaacgggacccgtttggtaaaccgttacggttcgggacggaaccgtaggtaaacggtacgggttaaaaccgggttagttttaccgggtacgtaaccggtttcggtaaccccgtttagtacgggttaaccgttacgggaaccggggtacccgtaacgggtcccctagggg

SEQ ID NO: 197007 - DNA, 642 bp, Homo sapiens
  misc_feature: GYAE6OF01ALW19.39.81.H04.1.454.CMB.1.raw
tcagtcgcactagtcacgaccggtgctcgatttagtagtgtagattcgcggggacccaaaaaccacacccctccttgggaggaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttaccacctttaccaactatggtatcagttgggtgcgacgaggcccctggacgaagggcttgagtggagtggggatggatcgagtcgactttacaagtggtacaacaacaaactatcgacaacaacgaaccctcgagggcaagacgtacacatcgaaccagacgaacacactaccacgagccacgctaacacgtacggacctacggaggacgccgtagaacgacgtcgtaggaaccgaccgtaccgggtaccgttagttacgttaccgtggtacgacggtaaggtaacggtaacgttaacggggtaaatttacggttttagaaccggttcgggttaccctttacgtttacggtaaccgttacgggttacggggaccgtaaccggggtaacccgttccggg

SEQ ID NO: 197008 - DNA, 566 bp, Homo sapiens
  misc_feature: GYAE6OF01BV7PT.39.81.H04.1.454.CMB.1.raw
  modified_base (425)..(425): a, c, t, g, unknown or other
  misc_feature (425)..(425): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatggggatggatcgagcgcttacatggtcacaacaaactatgcacagaaccctcgagggcagagtcaccatcgaccacagacacactccacgagcacggcctacatcggacctgaggcncctgacgactcgagaccgacgaccggtcgtagttacttactggtcgcgaggagtacgtacggggtaaattacgttttaggacgttcggtaccctttgtttacgtaccttacggtacggggacctacgggtaccccgtcggg

SEQ ID NO: 197009 - DNA, 622 bp, Homo sapiens
  misc_feature: GYAE6OF01DG6UU.39.81.H04.1.454.CMB.1.raw
  modified_base (410)..(410): a, c, t, g, unknown or other
  misc_feature (410)..(410): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtcgcgacacggtcccctggaacgaaggggcttggaggttgggagtggggatgggatcgaggcgtctacaagtcggtacaacaacgtaaactatagacacaacgaacctccgagggcaacgcgtacaccatcgaaccanagacacactaccgaacgacgacaaccggcctaacaagtcggaccgtggaaggacgacccgtaggaacgacttccgagaaccgacgaccggtaccgtgttactttacgtcggtcggacgaggagaacggttagggaaacgttgttttacggacgttcggtaacccttgttaccggtactacgggtcgggaccgaccgggtaacccgtaccggg

SEQ ID NO: 197010 - DNA, 648 bp, Homo sapiens
  misc_feature: GYAE6OF01C8XBS.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggtcttggagtggagtgggatggatcgagcgctacaatggtcacaacaaactatgcaacacgaacctccgagggcagatcacatcgaccacacgacacactccaacgacgaccacggaccctagacgtcggacctaggacggagcccgtaggacgtactaccgtacggaaccgaacgaccggggtaccgttaggttaacttacgtggtcgaccgggtaaggaagtacggttaacgggggtaaaattttcggttttaacggaccggtttccgggttaaccccttttcggttttacgtaaccggtttaaccggtcggggggtaaccccggtaacggggttaacccccgttacgggg

SEQ ID NO: 197011 - DNA, 686 bp, Homo sapiens
  misc_feature: GYAE6OF01B5G03.39.81.H04.1.454.CMB.1.raw
  modified_base (251)..(251): a, c, t, g, unknown or other
  misc_feature (251)..(251): n is a, c, g, or t
  modified_base (352)..(352): a, c, t, g, unknown or other
  misc_feature (352)..(352): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgagccgtggggcctcgagtgaggtctctgcagctcgtgtacacttacactntgtatcgtagttggtgcgacgacggccctaggacgaagggtcttaggaggtggagtggggatggagtcgagtcgtacttacaagtgtacacgaactaaatntagcaacgaacgaaccctcgacgggacaaggacgtaccacagtcgaaccaacacgaacactacgacccgaacgacgaccgaaccggtaccctacgagtacggacctagggaacggtacgccgtaggaacgtagtaccgtacggaaccgtaccgtacggttaccgttaggttaaccttacggtacggtcggaacggtaaggaacggtacgggttaacggggtttaaactttaacggtttttcggaacccggttttacccggttaccgtttaccggtttaacggttaccgttacgggttaccggggaacccggttaacgggttaccccgtaccggg

SEQ ID NO: 197012 - DNA, 751 bp, Homo sapiens
  misc_feature: GYAE6OF01CU3CI.39.81.H04.1.454.CMB.1.raw
  modified_base (331)..(331): a, c, t, g, unknown or other
  misc_feature (331)..(331): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagcctggggcctcgagtgaaggtctcctgcaaggcttctggtacacttacaactatggtatcagttggtgcgacgaggcccgtggacgtaaggcttgaggtggagtgggatggatcgagtcgtacttanaagtggtacaacaaccaaactagtacgacaacgaacgtaaccctcggaagggacaaggtacgtaccaacccgaagtacggaaacccacgaacgaccaacgaactaccgaccgaagccaaccggtacctaacgacgttacggaacccgtagggaacggtacgtcccgtaaggaacgacgttaccggtaacggaaacccggtaaccggtaacccggggttacccgttaaggtttaaacccgtttacggtacgggtacgggtaaccggtaagggaaacggtaaccgggtttaaaccggggttaaaagttttaccgggttttaacgggtaacccgtttaacccggggttaccctttaaccggtttacggtaaccgtttaccgggtacgggggaccccgtaaaccggggtaccccggtttacggg

SEQ ID NO: 197013 - DNA, 664 bp, Homo sapiens
  misc_feature: GYAE6OF01BRKKM.39.81.H04.1.454.CMB.1.raw
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtctcctgcaaggcttctggttacacctttaccaactatggtatcagttgggtgcgacacggcccctggacaagggcttggaggtggagtgggagtggatcgaggcgtcttaacaagtggtacacaacaaactatgacacacgaacctccgaggcagacgtcaccagtcgacccacacgacacactccaacgagccaaccggcctaacagtacggacctggaagggacgccgtaggaagtacttcgacggaaccgacgaaccgggtcgttagttactttacgtgggtacggacggtaggaaagggtacgttaaacgggggtaaaattttcggttttaacggaccggtttacccgggtttaccccgtttacgttttacggaaccggtttaccgggttaccggggggaccccttaaaccgggggtaacccccgtttccgggg

SEQ ID NO: 197014 - DNA, 596 bp, Homo sapiens
  misc_feature: GYAE6OF01B28H3.39.81.H04.1.454.CMB.1.raw
  modified_base (344)..(344): a, c, t, g, unknown or other
  misc_feature (344)..(344): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatcctttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcgagcgcttacaagtggtcacacaaactntgcacagaacctccgagggcagacgtcacatcgaccacagacacactccaacgacgcacggcctacagtacggacctggaacggacgccgtagacgtatccgtagaccgaccgaccggccgtagttacttacgtgtcggacgacggagacggtacggggtaaaatttcgttttacggaaccgttcggttaaccccttcgtttacggaaccgttacggttagggggacccgtaacggggtaaccccgttcggg

SEQ ID NO: 197015 - DNA, 736 bp, Homo sapiens
  misc_feature: GYAE6OF01BQZ6T.39.81.H04.1.454.CMB.1.raw
  modified_base (451)..(451): a, c, t, g, unknown or other
  misc_feature (451)..(451): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcgagtgaaggtctcctgcaaggtcttctggttaccacctttaccaactatggtatcaggttgggtgcgacgacggcccctaggaacaagggtcttggagtgggagtggggatgggactcgacggtcgtacttaacgaagttcgggtacctaaaccaacctaaaaacttagtacggaccaaacgtaaccgaaaccccgttccgaacggggtccaagtacgtaccaccgatacgacccanacgtacacactaccacgacgacgaccgacctaacgacgtacggactaggacggacgtaccgtacgaacgtacgtaccgtacggaaccgaaccggtaccgggtaccgttacgttacgtttaccgtaggtacggaacggtaacggtaacggtaacgggttaacgggggtaaaacgtttacggttttacggtaaccggttaccgggtttaacccgtttacggtttacgttacccggttaaccgggttaccggggtacccggtaaccggggtaaccccggttacccggg

SEQ ID NO: 197016 - DNA, 640 bp, Homo sapiens
  misc_feature: GYAE6OF01D4IWT.39.81.H04.1.454.CMB.1.raw
  modified_base (348)..(348): a, c, t, g, unknown or other
  misc_feature (348)..(348): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacgacggccctggacaagggcttgagtggatgggatggatcgagcgcttacaagtggtacacaacaactancgcacaacgaacctccgagggcaaggagtccaccatcgaaccacgaagaccacactccaacgacgaccaccggccactagtacggaccgtggaacgggagccgtaggacgtactacgtacggaaccgaacggacccgggtaccgtttacgttaacgtttacgtacgggttcggaccgggtaaggacggtagggtacggggttaaaatttaggttttcgaacggtttcgggttaccccttcgtttaacgtaccgttaccggtaggggacccggtacgggtaacccgttacggg

SEQ ID NO: 197017 - DNA, 725 bp, Homo sapiens
  misc_feature: GYAE6OF01CTS5E.39.81.H04.1.454.CMB.1.raw
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcgagtgaaggtctcctgcaaggtcttcgtggttactacctttaccaactatggtatcgtagttgggtgcgtacgacggcccctaggacgaagggtcttggagtggagtggagtggatacgagcgtacttacaagtcggtacaacgaacaaacgtatagcaacaacgaacccgtaccgagggacagacgtaccgacagtacgaaccacgaagaccaacactacccgaacgacgtaccaacccggaccttaacgagtaccggtaccttagggaaccggacgtcccgtgaacggtctacggtcggaacccgtacgtaacccggggtcgttacgttaacgttaccggttaggtcggtacggtaaaggtacggtaaacgggttaaccggggttaaaattttaaccggttttggtaacccggtttaccgggttttaaccccctttcggtttaacggtaaccgttaaccggggttcgggggtaaaccccgttaacgggggtaaccccgtttaccgggg

SEQ ID NO: 197018 - DNA, 661 bp, Homo sapiens
  misc_feature: GYAE6OF01CI0H5.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtggggcctcgagtgaaggtctcctgcaaggcttctggttacctacctttaccaactatggtatcgaggttgggtgcgacacggcccctaggacgaagggcttggaggtggagtgggatggatcgagcgtacttaacaagttcggtacaacaacaaaactagtacgaccaacgaacgaaccctaccggagggcaaggacgtaccaccagtaccgaaccaacgacgaaccacgtaacctacccgaacggacgacccgacccggtaccctaacgacgtacgggacccgtagggaacggaccgtaccgtaggagtactcggtacggaccgaacgaccggtccgttattacgttacgtgacgacgtaggagtaggttaagggtaaatttggtttacgacgtttccggttaccttcgttacgtacggttacggtgggacccgtaacgggtacccgttcgg

SEQ ID NO: 197019 - DNA, 657 bp, Homo sapiens
  misc_feature: GYAE6OF01BV1N9.39.81.H04.1.454.CMB.1.raw
tcagtcgcactagtcacgaccggtgctcgatttagtagtgtagattcgcggggtgatcaggactcctcagttcaccttctcacaatgaggctccctgctcagctcctggggctgctaatgctctgggtcccaggatccagtggggatgttgtgatgactcagtctccagtctccctgcccgtcacccttggacacgcccggcctccatctcctgcaggtctagtcaaagcctcgtatacattgataggaaacacctattagtaattggtttacagcaggacggccacggccaatcctaccgaacggccgtaccttaatttagttaacggttttacgtaaccgggtacttcggtcggggtaccccagaccagtactcgaggcggacgtaggtcgggtcacggctacgtagtacttacacaactagaaactcgagtcggaggggtgaggtacgtaggacggtagtttacggggttttaggggttttaacttacgtagtacgtagtacggaacgaaagggtaaccaaccgtacggtccggttacccgttaccggttacttacggtttaccgggaccgaacggggtaccctagggaccgtagggtaacgagtaaccgaacgtaacggtgacggtcctacggacctaccgtgttcgttaccg

SEQ ID NO: 197020 - DNA, 664 bp, Homo sapiens
  misc_feature: GYAE6OF01A6ZLJ.39.81.H04.1.454.CMB.1.raw
  modified_base (273)..(273): a, c, t, g, unknown or other
  misc_feature (273)..(273): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctgggcctcagtgaaggtctcctgcaaggcttctggttacacctttaccaactagtgtatctagttggngcgacacggccctaggacgaagggcttggagtggagtggggatgggactcgaggcgtacttaacgaagtcggtacaaccaactaaactagtcgacaacgaacgtaacccgtcgaaggcaagacgtccaaccatacgaccacaacgacacactaccacgacgtccgaacgtacctaagacgtacggaccctagggaacggacgtaccgtaggaacgtacgtccgtacggaaccggtaccggaccgggtcggttacgttaacttacgtggtacggaggtacggaagtaacgggttaacgggttaaatttggtttacggaccgttcggttaccctttcggtttaacgtacccggttcgtaaccgggggcccgtaaacggggtacccgttccggg

SEQ ID NO: 197021 - DNA, 575 bp, Homo sapiens
  misc_feature: GYAE6OF01AP8VI.39.81.H04.1.454.CMB.1.raw
  modified_base (431)..(431): a, c, t, g, unknown or other
  misc_feature (431)..(431): n is a, c, g, or t
tcagtcgcactagtcacgaccggtgctcgatttagtagtgtagattcgcggggacccaaaaaaccacacccctccttgggagaatcccctagatcacagctcctcaccatggactggacctggaggatcctcttcttggtggcagcagccacaggagcccactcccaggtgcagctggtgcagtccgggactgaggtgaagagcctgggcctcagtgaaggtctcctgcaaggcttctggaatcaccctcaccgacgtctatatgcactggttgcgacacggcccctggacaagggcttggagtggatgggatggatacgaacggtaacaggtggtctacgaactaaattactgacaacgaaggtaagtttcgagggctagggtcacgagtcgaccgagggacacgtaccatacaatacgacgtacctaanagtagtaactgacgcgaggctgagtactcgtagaccgacgaccggtccgtagttattagtcgtagcgaagagtatgacgttctcttactacgtaggttggttacgggtaatttaagtacgtttcggttccgacccggttacggg

SEQ ID NO: 197022 - DNA, 686 bp, Homo sapiens
  misc_feature: GYAE6OF01DK5TE.39.81.H04.1.454.CMB.1.raw
  modified_base (274)..(274): a, c, t, g, unknown or other
  misc_feature (274)..(274): n is a, c, g, or t
  modified_base (281)..(281): a, c, t, g, unknown or other
  misc_feature (281)..(281): n is a, c, g, or t
  modified_base (336)..(336): a, c, t, g, unknown or other
  misc_feature (336)..(336): n is a, c, g, or t
  modified_base (359)..(359): a, c, t, g, unknown or other
  misc_feature (359)..(359): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttctggtggcagcaacaacaggtgcccactcccaggttcagctggtacagtctggagctgagactgacgaagcctggggcctcagtgaaggtctcctgcaaggcttcgtggttacacctttacaactatggtatcagttgggngtccganacggccctggacgagggtcttgaggtggagtgggatggactgagtcgtacttaanagtggtacaacgaacaaaacttntgacaacgtacgaaaccctcgaagggcaagacgtaccaaccatcgaacccaacagaaccgaccaactcccgaacgacgcccgaacggaccctaacgagtcggaaccctggacggacgctggacgactcgtacgaaccgaccgtaccggtaccggttagttaactcgtacgggttacggacggtaagtaacggtacgggttaaggggtaaacttttagggttttacgtaaccggtttacccgggttaccccgttttacgtttaacgggttaacccgttacgggtaccgggggtaccccggtaaacccggggtccccgtttacccgggg

SEQ ID NO: 197023 - DNA, 566 bp, Homo sapiens
  misc_feature: GYAE6OF01CHCRQ.39.81.H04.1.454.CMB.1.raw
  modified_base (344)..(344): a, c, t, g, unknown or other
  misc_feature (344)..(344): n is a, c, g, or t
  modified_base (410)..(410): a, c, t, g, unknown or other
  misc_feature (410)..(410): n is a, c, g, or t
  modified_base (470)..(470): a, c, t, g, unknown or other
  misc_feature (470)..(470): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacacggccctggacaagggcttggagtggatgggatggatcagcgcttacatggtacacaacaaactntgacacaacgaacctcgaggcagacgtcacatgaccacacgacacatccacgacgcacggcctaanagtcggacctggaagacgcgtagagatcgagaccgacgacggtccgtagttactacgtgngacgagtagaggtacgggtaaatttcggtttagacggtttcggtacccttgtttacgaccgttacgggcggggaccgaagggtaacccgttacggg

SEQ ID NO: 197024 - DNA, 568 bp, Homo sapiens
  misc_feature: GYAE6OF01B7966.39.81.H04.1.454.CMB.1.raw
  modified_base (480)..(480): a, c, t, g, unknown or other
  misc_feature (480)..(480): n is a, c, g, or t
  modified_base (541)..(541): a, c, t, g, unknown or other
  misc_feature (541)..(541): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcgagtgaaggtctcctgcaaggcttctggttacacctttaccaactatggtatcagttggtgcgacacggcccctggacaagggcttgagtggatggggatggatcagcgtacgttacaagtcggtcaacaacaaactatgcaacacgaacctccgaggcagacgtcaaccgatcgaacccacagaaccacaactcccaagacgcgacggacctacacgtgacctgagaccgcgtgacgatcagcgaacgcggcctagtattcgtgngcgagagacgtagggaaacttgtttagacgtttcggtacccttaggttacgtacgttacgngggggaccctagggtacccgttacggg

SEQ ID NO: 197025 - DNA, 587 bp, Homo sapiens
  misc_feature: GYAE6OF01C0H6B.39.81.H04.1.454.CMB.1.raw
  modified_base (258)..(258): a, c, t, g, unknown or other
  misc_feature (258)..(258): n is a, c, g, or t
  modified_base (358)..(358): a, c, t, g, unknown or other
  misc_feature (358)..(358): n is a, c, g, or t
  modified_base (399)..(399): a, c, t, g, unknown or other
  misc_feature (399)..(399): n is a, c, g, or t
  modified_base (430)..(430): a, c, t, g, unknown or other
  misc_feature (430)..(430): n is a, c, g, or t
  modified_base (432)..(432): a, c, t, g, unknown or other
  misc_feature (432)..(432): n is a, c, g, or t
  modified_base (439)..(439): a, c, t, g, unknown or other
  misc_feature (439)..(439): n is a, c, g, or t
  modified_base (445)..(445): a, c, t, g, unknown or other
  misc_feature (445)..(445): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctctgcaaggcttctggttacacctttacaactntggtatcagttgggtgcgacacggcccgtggacgaagggtcttaggagtggagtggatggatcgaggcgtattacgaagtcggtacaacgaacaaaactntcgacaacaacgtaacctccgagggacaggactacacctancgaccacagacacatccagacgcacgcctanancggaccngacgcnctagactatcacggaacgaccgaccggtctagttacttacgtgtcgacgaaggcgtaagtacgggtaaatttgtttagacgtttcggtacctttcgttacggtaccgttacggtacgggtacccgaagggtaccccgtcggg

SEQ ID NO: 197026 - DNA, 735 bp, Homo sapiens
  misc_feature: GYAE6OF01EDUFS.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttcgtggttacacctttacaacttatggtatcagttgggtgcgacacggccctggaacaagggcttggagttggatggggatgggatcgaggtcgacttacaagtcggtacaacgtaacaaaactagtacgacaacgacgtaaaccctccgaaggggcctaaaggacgttaccaaacccgagttaccggaaaccctaacgaacggtaaccctaaccaacgttaccccgaacggaacggacccgaacccgggtaccctaacgacgttacgggacccttaggggacggaacgtcccgttaggaacggtacttcggtacggaaccgtaaccgtaaccgggtcccggttagtttaccgtttacggtcggtacggccggaaggtaacggtacggttaacgggggttaaatttacgtttttaggaaccgtttcgggttaacccctttagtttacgggtaccttaacccggggtgggggaaccccttagggggtaaccccttacggg

SEQ ID NO: 197027 - DNA, 736 bp, Homo sapiens
  misc_feature: GYAE6OF01C9EIC.39.81.H04.1.454.CMB.1.raw
tcagtcgcactagtcacgaccggtgctcgatttagtagtgtagattcgcggggacccaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgacaaggcttcgtggttactacctttacaactatggtatcagttgggtgcgacacggccccgtggacgaaaggggccttaggagtaggagtgggacgtgggaatcgaggcggtacttaacgaagttacggtacaacaacgtaaaactattacggaccaaccgaacgaaccccttccgaacggggaccaaaggtacggtacaacccgagttaccgaacccgaacgaacgaaccgaaccaacgtaccccgaacggaaccggaccgaacccggtaccctaacgtacgttaccgggaacccgttagggaacgggacgcccgtaggacgtaacgtcgtacggaacgaaccgaccgggtaccgtgttaacgttacgtcgtacggacggtaagacggtacggtaacggggtaaaactttacggtttacggaacggttaccggttaaccccgttgtttacggtaccgttaacgggttacggggacccggtaaaccggggttccccgttaaccggggg

SEQ ID NO: 197028 - DNA, 958 bp, Homo sapiens
  misc_feature: GYAE6OF01B38BK.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtggggcctcgagtgaaggtctccgtgacgaaggtcttcgtacggttaacctaccgttttaaccaaacgttagttacgggttacttccgtagggtttcggggtcggaccggtaaccgaccgggtcccccgttaggggaaccgtaacgggggttcctttagggtaacgggttaggggtaacggttagggggtaattacgggggtaacttacccggaacggtacccggttaaccttttaaaccgaaacggtttccggggtaaccctaaaccgtaaaaccttaaaaaccgttagttaccgggaaccctaaaccgtaaacccgggtaaaccccttacccggggaaacggggacctaaacgggtaaccggttaacccggaaccctaaacggttaacccggaaacccgaaaccgaacggtaaaccaacccgtacttaaccccggaacggtaaccgacccggtaacccggtaccgttaacgtaacggttaccgggaaccgtacgggaacggtaaccgtccgtaaggacgtagtttaccgggaacggaacccggtaaccggtacccgggtaccgttacggttaaccggttacggttacggtacggtaacgggaacggttaacggaacgggtttaaacgggttaaacgttttacgtttaccgggtaccggttttaccggttaacccctttggtttaacccggtaaccgttaccggggtacccgggtaacccgggttaaaccggggtccccggtttaccggg

SEQ ID NO: 197029 - DNA, 571 bp, Homo sapiens
  misc_feature: GYAE6OF01BOAVG.39.81.H04.1.454.CMB.1.raw
  modified_base (380)..(380): a, c, t, g, unknown or other
  misc_feature (380)..(380): n is a, c, g, or t
  modified_base (424)..(424): a, c, t, g, unknown or other
  misc_feature (424)..(424): n is a, c, g, or t
  modified_base (478)..(478): a, c, t, g, unknown or other
  misc_feature (478)..(478): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcgagcgcttacaatggtacacaacaactatgcacagaacctcgagggcagagtcacatgaccanacgacacataccacgacgcacggctacacgtcggacctgacggngcctaggacgatcgtacgacgaccgacgggtccggtgttacttacgtgtacggngaaggagaggtacggggaaattagttttagacgttcggttacccttgtttacgaccgttacggtacgggggcctaacggggtacccgtacggg

SEQ ID NO: 197030 - DNA, 661 bp, Homo sapiens
  misc_feature: GYAE6OF01A1PLE.39.81.H04.1.454.CMB.1.raw
tcagtcgcactagtcacgaccggtgctcgatttagtagtgtagattcgcgggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagcctggggcctcagtgaaggtctcctgcaaggcttctggttacacctttaccaactatggtatcgagttgggtgcgacacggccctggacaagggcttggagtggagtggggatgggatgacggtcgtacttaacgaagttcggacaacaactaaactagtcgacaacaacgaaccctacgaagggcaaggacgtacaaccatacgaaccacacgaaccacaactaccaacggacgccgtaaccggaccctaacgaacgtacggaccgtaggacgggacgtccctagggaagttacgtcgtaacgaacccggtaacgaccgggtaccgttagttacttacggtggtcggacggaaggaggtacggtaagggtaaacttttggtttacgacgtttcggttacccttgtttacggtaccgttcgggtaccggggaccggtaaccgggaccgttccgggg

SEQ ID NO: 197031 - DNA, 642 bp, Homo sapiens
  misc_feature: GYAE6OF01DIQD0.39.81.H04.1.454.CMB.1.raw
  modified_base (263)..(263): a, c, t, g, unknown or other
  misc_feature (263)..(263): n is a, c, g, or t
  modified_base (549)..(549): a, c, t, g, unknown or other
  misc_feature (549)..(549): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagcctgggcctcagtgaaggtctccgtgacaaggtcttctggttaactacctttacaactntggtatcagttggtgcgacgacggcccctggacgaacgggtcttgaggtggagtgggagtggatcgagcgactttaagaagtggtacaacctaaacaaaaccttatcgacaacgaacgtaaccctccggaaggaccgtaaggaacgtaccaccaacgttacggaaacccaacgaacgaacacctaactaccgaccgacggacgacccggacctaacgagtacggaacgtggaacggacgccttaaggatacttcggagacgaccgacggtccgttagtatacgtgngacgaagtagaacgtagggtaaatttgtttagacgttcggttaaccctcggttacgtacgttacggtccggggactacgggacccgttccggg

SEQ ID NO: 197032 - DNA, 728 bp, Homo sapiens
  misc_feature: GYAE6OF01BA9ZE.39.81.H04.1.454.CMB.1.raw
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggtcttctggttaccacctttaccaactatggtatcgtaggttgggtgcgacgacggccccgtggacgaagggcttaggaggtggagtgggatgggactcgacggcgtactttaacgaagtcggtaccaacaaacctaaactacgtcgaccaacgaacgaaccccgtacgagggacaaggacgtaccaacctagtacgaacccacaacggaccaaccaacgtacccaacggaccgaccgaacccggtaccctaacgacgttacccgggaccgtagggaacgggaccgtcccgtaaggaacgtaccttccggaacggaacccggaaccgtaccgggtacgttagttacgttacgtgggacgacggaggtaacggtacggttaaacggggtaaattttacggttttaggaacccggtttacgggttacccctttagtttacggtacccggttaacgggtaccggggtaccgtaacccggggtaccgttaccccggg

SEQ ID NO: 197033 - DNA, 620 bp, Homo sapiens
  misc_feature: GYAE6OF01AU5SE.39.81.H04.1.454.CMB.1.raw
  modified_base (344)..(344): a, c, t, g, unknown or other
  misc_feature (344)..(344): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcgagcgcttacaatggtcacacaaactntgcacagaacctccagggcagagtcaccatcgaccacagacacactccacgagcacggcctacagtcggacctggacgggacgccgtagagactccgtggaaccgaccgaccgggccggttagttacgtttacgtcggtacggacggaggaagtacggttaacgggggtaaaattttacgttttacgggaaccgtttcgggttaccccctttcgttttacggaaccgtttaccggttacgggggaccccgtaaacggggtaacccccggttacggg

SEQ ID NO: 197034 - DNA, 699 bp, Homo sapiens
  misc_feature: GYAE6OF01CYUSL.39.81.H04.1.454.CMB.1.raw
  modified_base (272)..(272): a, c, t, g, unknown or other
  misc_feature (272)..(272): n is a, c, g, or t
tcagtcgcactagtcacgaccggtgctcgatttagtagtgtagattcgcggggacccaaaaaccacacccctccttgggagaatcccctagatcaacagctcctcaccatggactggacctggagcatccttttctggtggcagcaacaacaggtgcccactcccaggttcagctgtacagtctggagctgagatgacgaagcctggggcctcagtgagtctcctgcagcttctggttacacctttaccacttatggtatctaggttggtcncgacacggtccctggacgagggcttggagtggatgggatggaactcgaggtcgtactttacgaagttcgggtacaaccaacgtaaactagttcggaccaaccgaacgtaaacccgttccgaaggggaccaacggacgttacccgaaccagtacgaacccaacgacgacctaacactacccgacgacgacccgaaccggtcctaacgacgtcgggacccgtaggacggacgacccgtaggacgtactaccgacggaacccggaaccggtaccgggtcccggttagttaactttacggtgtacggacggtacggaacggtacggttaacggggtaaaattttcgttttacggaccggtttaccggttaccctttcgtttacggaaccgtttcgggaccggggtaccgtaaccggggtcccgttacgggg

SEQ ID NO: 197035 - DNA, 755 bp, Homo sapiens
  misc_feature: GYAE6OF01DY1SO.39.81.H04.1.454.CMB.1.raw
tcagtcgcactagtcacgaccggtgctcgatttagtagtgtagattcgcggggacccaaaaaaccacacccctccttgggagaatcccctagatcacagctcctcaccatggactggacctggagcattcctttttcttggtggcagcaacaacaggtgcccactcccaggttcagctggtacagtctggagctgagatgacgaagccgtggggcctcgagtgaaggtcctcgtgacaaggtcttcgtcggttaacctacctttaaccaacttatggtactcgtaggttgggtcgacgacgaccggtcccgtaggacgtaggtcgttaggaggtggagtgggagttggactcgagtcgtacttaagaacgttcggaccaactaactaaactagtacgacctaacgaaccgtaacccgtacgaacgggtacgaacgtaacgtaccgaacacgtaaccgaaccaaccgacgtaaccacgtaaccgtacccgaacgacgaccgaacccggtaccaaccgtacgttacggaccgtaggacggacgtccgtaggacgtagtccgacggtaacccggaaccgttacggtaccggtttaagtttaccgtacggttacggtggaacgtagggaaggttaacggttaaacggggttaaattttaccgggtttacggacggttttaccggttaacccctttaggttaaccggtaccggttacgggacccggggtaaccggtaacccggggttaccccgttaccgg

SEQ ID NO: 197036 - DNA, 616 bp, Homo sapiens
  misc_feature: GYAE6OF01BZMFZ.39.81.H04.1.454.CMB.1.raw
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcgagtgaaggtctcctgcaaggcttctggttacacctttaccaactatggtatcgtagttgggtgcgacgacggccccgtggacgaagggtcttggagtgggagtggggatggatcgagcgtacttacaagtggtacacaacaaactatcgacacaacgaacctcgagggcagacgtcacatacgaaccacaacgacaacacacccagacgcaccgtcctacgactcggaccgtggaacggcgtaccgtagagtactcgtacgaccgaacggaccggtcgtagttacttacgtaggcgacggagacgtaggtaacgggtaaagttacgtttagtaacggttccgttacccgttcgtttacgtaccgttacgggtaccgggtaccgtacgggtaacccgtcgg

SEQ ID NO: 197037 - DNA, 642 bp, Homo sapiens
  misc_feature: GYAE6OF01DGZHE.39.81.H04.1.454.CMB.1.raw
  modified_base (412)..(412): a, c, t, g, unknown or other
  misc_feature (412)..(412): n is a, c, g, or t
  modified_base (458)..(458): a, c, t, g, unknown or other
  misc_feature (458)..(458): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgacaaggcttcgtggttaccaccttttaccaactatggtatcaggttggtgcgacgacggcccctaggacaacgggcttgaggtggagtggagtggatcgagcgtcttaacagtggtacacaacaactatgacacaacgaaccctcgaggcagacgtacacactacgaccacgagaccacacnccgaacgagaccacggactacgagtcgacctggacgacgcctaganacgttcgacgaccgacgaccgggtaccgttaggttacttacgtaggtcggacgtaggaaggtacgggttaacggggttaaatttaacggtttacgtaaccggtttccggttaacccgtttcgtttacggtaaccgtttaccggggtccggggtaacccgaacggggttaacccccggttacggg

SEQ ID NO: 197038 - DNA, 652 bp, Homo sapiens
  misc_feature: GYAE6OF01AD69G.39.81.H04.1.454.CMB.1.raw
  modified_base (536)..(536): a, c, t, g, unknown or other
  misc_feature (536)..(536): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtctcctgcaggcttctggttacacctttaccaactatggtatcgtaggttgggtgcgacgacggccccgtggacgaagggtcttgaggtggagtggggatggatcgaggcgacttacaagtggtacacaacaaactatcgacaacaacgaaaccctccgaagggacaagacgtaccaccgacgtacgaacccaacgacgaccacactacccgaacgacgaccgaccggtacctacgacgtcggacctggacggacgccgtaggacgtactcgtacggaaccgaccggaccggtaccgttagttactttacgngtcggacggtaggagtaggttaacgggtaaatttcgtttaggtaaccggttcggttaccccgtttagtttacgtacgttacgggtaccgggacccgtaacgggtacccgttacggg

SEQ ID NO: 197039 - DNA, 630 bp, Homo sapiens
  misc_feature: GYAE6OF01CWJE7.39.81.H04.1.454.CMB.1.raw
  modified_base (123)..(123): a, c, t, g, unknown or other
  misc_feature (123)..(123): n is a, c, g, or t
  modified_base (498)..(498): a, c, t, g, unknown or other
  misc_feature (498)..(498): n is a, c, g, or t
tcagtcgcactagtcacgaccggtgctcgatttagtagtgtagattcgcgggacccaaaaaccacacccctccttgggagaatcccctagatcacagctcctcaccatggactggacctggancatccttttcttggtggcagcaacaacaggtgcccactcccaggttcagctggtacagtctggagctgagatgacgaagccgtggggcctcagtgaaggtctcctgcaaggtcttctggttactaccctttaccaactatggtatcgtaggttgggtgcgacgacggccccgtaggacgaagggtcttggaggtggagtgggatggatcgagtccgtacttaacgaagttcggtacaacaacgtaaactagtagacctaacgaacgaaccctaccggacgggacgtaagacgtaccaacctaacgtacgaacccaacacgacaacctactaccaacggacgacgaccggacctacgaagtcgacctaggaggacncgtagacgatcgagaccgaccgacggtcgttagtactcgtggtgagtagagtaggtaggtaacgtttagttacgacgttcggttacccgttgttacgacgttacggtagggccgtaaccgggtccgtaccgg

SEQ ID NO: 197040 - DNA, 584 bp, Homo sapiens
  misc_feature: GYAE6OF01ALBSW.39.81.H04.1.454.CMB.1.raw
  modified_base (358)..(358): a, c, t, g, unknown or other
  misc_feature (358)..(358): n is a, c, g, or t
  modified_base (504)..(504): a, c, t, g, unknown or other
  misc_feature (504)..(504): n is a, c, g, or t
  modified_base (510)..(510): a, c, t, g, unknown or other
  misc_feature (510)..(510): n is a, c, g, or t
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaggtctctggttaccacctttaccaatatggtatcgagttgggtgcgtacgacggccctaggacgaagggtcttgaggtggagtgggagtggatcagcgacttacaagtggtacactaacaaactntacgcaacgaacgaaccctcgagggacagacgtacacatacgaaccacagaccacactaccgacgacgccgacggcctaacgacgtcggacctaggacggacgccgtagagtactcgtacgacgaccgacggtcgtgttacttcgngtacgngtagagtaggtaacgggtaattgtttagacttcggtaccttcgttacgacgttcggcggtaccgtaggtacccg

SEQ ID NO: 197041 - DNA, 641 bp, Homo sapiens
  misc_feature: GYAE6OF01BYHPV.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtgggcctcagtgaaggtctcctgcaagcttcgtgttacacctttacaactatggtatcgtagttgggtgcgacacggcccgtggacgaagggcttggagtgggagtgggagtggatcgagcgtacttaacgaagttggtacaaccgaacaaaactatacgacacaacgtaacccgtccgagggcaagacgtacaccatacgaccaacgacgaacacacgtaccaacgacgaccgaccggtacctaacgacgtacggaccgtaggaacggacgccgtagacgtataccgtagacggaaccgcgggtaccgttagttacgttacgtgtacggacgaggaagtacggtaagggtaaacttggttttacgacgttccggttaccctttcgtttacggtaccgttacggtacggggacccgtaacgggtacccgtccggg

SEQ ID NO: 197042 - DNA, 664 bp, Homo sapiens
  misc_feature: GYAE6OF01BLTEN.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggtcttctcggttacacctttaccaactatggtatcagttgggtgcgacacggccctaggacaagggcttgagtggagtgggatggatcgagcgtacttaacgaattggtacaacgaactaaacgtatgacaacgtaacgaaccctaccgagggacagacgtaccacagtcaaccacgacgacacactacacgacgcgacggacctacgagtcggacctaggacgacgtcgtaggacgtactacgacgaccgaacgtaccggtcccgttaagttacttacgtcggtacggacggaacggtacggtaaggttaacggggtaaactttaacggtttacgtacggttaccggttaaccccgtttacggtttaccgtaaccgggtttaccgggacggggttaaccccggtaccggggtaacccggtttacccggg

SEQ ID NO: 197043 - DNA, 689 bp, Homo sapiens
  misc_feature: GYAE6OF01ED2CT.39.81.H04.1.454.CMB.1.raw
  modified_base (366)..(366): a, c, t, g, unknown or other
  misc_feature (366)..(366): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggtcttctggttacacctttacaactatggtatcgagttgggtgcgacgacggccctggaacgaagggtcttggaggtggagtggggatggactcgaggcgtacttaacgaagtggtacaacaactaaactntcgacaacgaacgaaccctcgagggcaagacgtaccacagtcgaacctacgaagtacactactacccgaacgacgaccgacggtacctaacgagtacggaacccgtaggaacgggtacgtcgtaggaacgtacgtacgtacgaaccggaaccgtacccgggtcggttaagttacgtttaccggtgtacggacgaagggtaacggtaacgggtaacggggttaaactttacggtttacgggtaccggtttacccggttacccgttacgtttacggtaacgttaccgggtaccggggaccgtaaccggggtaacccgttaccggg

SEQ ID NO: 197044 - DNA, 603 bp, Homo sapiens
  misc_feature: GYAE6OF01DCJB6.39.81.H04.1.454.CMB.1.raw
  modified_base (409)..(409): a, c, t, g, unknown or other
  misc_feature (409)..(409): n is a, c, g, or t
  modified_base (413)..(413): a, c, t, g, unknown or other
  misc_feature (413)..(413): n is a, c, g, or t
  modified_base (431)..(431): a, c, t, g, unknown or other
  misc_feature (431)..(431): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggtagcagcaacaggtgcccactcccaggttcagctggtgcagtctggagctgaggtgaagacgcctggggcctcagtgaaggtctcctgcaaggcttctggttaccattcacctacctttgctctcagcgtgggtcgcgtacgacggcccctgggacgaacgggtcttggaggttggagttcggggttccgtactaacgaaccaaccaaacagtcgccccgtaaggaaacgttccgagggacagacgtccacaatcgaaccagacgacncganccgacgacacagccacanacggatgagcagctgagtattacgacgacgacggcctagtcgttattacgtggtacgcgtaggtcttcgttacgtcaaacgtgtagtaggtgaaacggttaaaagggtttcgtacgttcggacggggtaccgaacgggtacccgttaggtacccgtccgtcctccgtacccg

SEQ ID NO: 197045 - DNA, 773 bp, Homo sapiens
  misc_feature: GYAE6OF01C2FWP.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatgggctggacctggagcatccttttcttggtggcagcaacaacaggtcgcccactcccaggttcagctggtacagtctggagctgagatgacgaagcctggggcctcgagtgaaggtctcctgacaaggcttcgtggttacaccttttaccaactatggtatctaggttgggtcgcgtacgacggcccctaggacgaagggcttgagtggagtgggatggatcagcgtcttacaagtggtaccacgaacaaaactgtcacaacgacgaaccctccgagggcagacgtcacatcggaaccaacgagaacaactactacccgaacggacgacccgaaccggtaccctaacgaacgttaccgggtacccgttaacggggaaccgggtaccgtacccgttagggaaacggtacgttaacccgtacgggaaacccggaacccggtaacccgggtcccggtttaacggttaactttaacccggttcgggtacggaacccggtaagggtaaaccggtaaacgggttaaccggggggttaaaaattttacggtttttacggaaacccggtttaccggggtttaaccccctttacgggttttaacggaacccgtttaacccgggtaccggggggaaacccccgtaacggggggttaaccccccgttaccggggg

SEQ ID NO: 197046 - DNA, 681 bp, Homo sapiens
  misc_feature: GYAE6OF01AW6EH.39.81.H04.1.454.CMB.1.raw
tcagtcgcactagtcacgaccggtgctcgatttagtagtgtagattcgcggggacccaaaaaccacacccctccttgggagaatccccctagatcacagctcctcaccatggactggacctggagcatccttttcttggtggcagcaacaacaggtgcccactcccaggttcagctggtacagtctggagctgagatgacgaagcctggggcctcagtgaaggtctcctggcaaggcttctggttaccaccttttaccaactatggtatcgtagttgggtgcgacaggcccctggacgaagggcttggagtgggagtgggatggatcgagcgcttacaagtggtacacacaaactatgcacacgaaccctcgaggtcagacgtacaccatcgaaccacgacgacacactacccgacgacgacgaccggacctaacgagtacggacccgtaggacggacgtccgtagaagtactacgtacggaaccgaaccggacccgggtaccgttacgttaacgtttaccgtacggtacggacggtaaggtaacggtacgggtttaaacccgggggtaaattttacggtttacggtaccggttaccggtttacccccgtttacgttttacggtaaccggttaccgggtacgggggtaaccccgtaaccggggtaaccccgttacccgggg

SEQ ID NO: 197047 - DNA, 609 bp, Homo sapiens
  misc_feature: GYAE6OF01ASKNT.39.81.H04.1.454.CMB.1.raw
  modified_base (381)..(381): a, c, t, g, unknown or other
  misc_feature (381)..(381): n is a, c, g, or t
  modified_base (405)..(405): a, c, t, g, unknown or other
  misc_feature (405)..(405): n is a, c, g, or t
  modified_base (455)..(455): a, c, t, g, unknown or other
  misc_feature (455)..(455): n is a, c, g, or t
  modified_base (501)..(501): a, c, t, g, unknown or other
  misc_feature (501)..(501): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtggggcctcgagtgaaggtcctcctgacaaggtcttcgtggttacctacctttaccaactatggtatcgtaggttggtgcgacgacggcccctaggacaagggtcttaggaggtggagtgggatggatcgagcgtactaacgagtggtacacaacaactatcgacacacgaccncgaggcagctacacatacgaccanagacacacaccacgcgaccgacggacctacgacgtacgactggacggacncgtagagtctacgacgacgaccgaccggtacgtagttacgttacgngtacgagaacggtagtaacgggttaagggtaaatttcggtttagaccggtttacgtaccctttagttacgtaccggtacggtacgggaccgtaacgggtcccgtacgg

SEQ ID NO: 197048 - DNA, 637 bp, Homo sapiens
  misc_feature: GYAE6OF01CCAPX.39.81.H04.1.454.CMB.1.raw
  modified_base (437)..(437): a, c, t, g, unknown or other
  misc_feature (437)..(437): n is a, c, g, or t
  modified_base (442)..(442): a, c, t, g, unknown or other
  misc_feature (442)..(442): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacaggcccctggacaagggcttgagtggatgggatggatcagcgcttacaatggtacacgaacaaactatggactaacagaaccctcgagggacagacgtcacatcgaaccacaagacacatccacgacgcaacgctacagtggacctgacggtacgccgngaagntactcggaacgaaccgaccgggtaccgtacgttaacgttaaccgtgtacggccggaaggtaacgacggtttacggggggaaaaatttacgtttttagggaaccgtttaccggggtaaccccctttcgttttacggaaccgtttaaccgggcggggggtaaccccttaaacggggggaaccccggtttacccgggg

SEQ ID NO: 197049 - DNA, 629 bp, Homo sapiens
  misc_feature: GYAE6OF01EJL6S.39.81.H04.1.454.CMB.1.raw
  modified_base (274)..(274): a, c, t, g, unknown or other
  misc_feature (274)..(274): n is a, c, g, or t
  modified_base (348)..(348): a, c, t, g, unknown or other
  misc_feature (348)..(348): n is a, c, g, or t
tcagtcgcactagtcacgaccggtgctcgatttagtagtgtagattcgcggggacccaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacacctttaccaactatggtatcagttgggngcgacacggccctggacaaggcttgagtggatggggatggatcgagcgcttacaagtggtcaacgaacaaactntgacacacgaacctccgagggcaaggacgtacaaccagtacgaccaacaagaccaacgactacccgaacgtacgaccacggacctaacagtacggacctagggacgacgacctaggaacgtctacgtaggaccgtaccgaccgggtcgttacgttaagttaccgtggtacgaggtaacggaagtacggttaacggggtaaatttacgtttacggtaacgttccggtaccctttgttaccgtaacgttacggtcgggacccggtaacgggtacccgttcggg

SEQ ID NO: 197050 - DNA, 737 bp, Homo sapiens
  misc_feature: GYAE6OF01DFP9C.39.81.H04.1.454.CMB.1.raw
  modified_base (346)..(346): a, c, t, g, unknown or other
  misc_feature (346)..(346): n is a, c, g, or t
  modified_base (370)..(370): a, c, t, g, unknown or other
  misc_feature (370)..(370): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttcgtggttacacccttttaccaactattgggtaatcgtaggtttgggtgacgtacacggcccctggacgaagggtcttggagtggagtgggatggatcgagcgtactanaagtcggtacaacgaacaaacgtntcgactacaacgtaaccctccgaagggcaaggtacgtacaaccgacgtacgaaaccctacgaacgaacctaaccacgtacccgaacgacgtacccgacccggaccttaacgaacgtcggtaacccgttggaaacggtaccgaccgttaggaacgacgttaccggtacggaacccggaacgtacccgggtaccgttacgttaacgtttaccgtggttacggaccggtaaggaagggttacggtaaacggggtttaaatttacggtttaaccggtaacggtttccggttaaacccccgtttggtttaacccgtaaccgttaaccggggtaccgggtaaccccgtaacggggtaacccccgtttaccggg

SEQ ID NO: 197051 - DNA, 611 bp, Homo sapiens
  misc_feature: GYAE6OF01ECEHV.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacgaggtgcccactcccaggttcagctggtacagtctggagctgagatgacgaagccgtgggcctcgagtgaggtctcctgcagcttctgttactaccttacaattatggtatcgtagtggtgcgacacggccctggacgagggcttgagtggagtgggagtggatacgagcgtcttaactagtcggtacacgaactaaactatgacaacacgtaaccctcgagggacaaggtacgtacaccaagtcgaaccaacgaacgaactaacactacccgaacgacgaccgacccggtacaacgacgtacggaccgtaggaacggaccgtccgtagaagtactcgacgaaccgaccgtacggtcgttcgtattacgtgtacgagagaggtagtaacgggttaattcggtttagacggttcgttaccttgttacgtacgtacggcgggtaccgacggtccgtaccgg

SEQ ID NO: 197052 - DNA, 615 bp, Homo sapiens
  misc_feature: GYAE6OF01B30U5.39.81.H04.1.454.CMB.1.raw
tcagtcgcactagtcacgaccggtgctcgatttagtagtgtagattcgcggggcacccaaaaaccacacccctccttgggagaatcccctagatcacagctcctcaccatggactggacctggagcatccttttcgttggtggcagcaacaacaggtgcccactcccaggttcagctggtacagtctggagctgagatgacgaagcctggggcctcagtgaaggtctcctgcaaggcttctggttacacctttaccaactatggtatcaggttgggtgcgacacggccctggacaagggcttggagtggagtgggatggatcgagcgtcttacaagtggtacacaacaaactatgcacagaacctcgagggcagactcaccatcgaccacagacacactccacgacaccgacggacctaacacgtcggaccctaggacggacgccgtagacgtactcgacggaaccgacgaccgggtccgttagttacttacgtggtacgacggtaagaggtaacggttacggggtaaaatttaggttttacggaccgtttcgggttaaccccttggtttacggtaaccgttacgggtcggggtacccgtaacggggtaaccccg

SEQ ID NO: 197053 - DNA, 733 bp, Homo sapiens
  misc_feature: GYAE6OF01BDVTY.39.81.H04.1.454.CMB.1.raw
  modified_base (405)..(405): a, c, t, g, unknown or other
  misc_feature (405)..(405): n is a, c, g, or t
tcagtcgcactagtcacgaccggtgctcgatttagtagtgtagattcgcgggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacacctttacaactatggtatcagttggtgcgacaggccctaggacgaaggcttggagtggagtgggatggatcagcgtacttacaagtggtacaacgtaacaaatatgaccaacaacgaacctccgaagggctaaggacgtacacctaagtcgaaccgtanacgaacaactacgtaccgaacgacgaccacggacctaacagtacggacctaggaacggtcgaccgtagaacgtacgtacgtacggaaccgaaccggtaccgggtacccggtttaaggaaccgttttaacggtcggtacgggtaaaccggaacggtaaacggggttaccggttaaacgggggttaaaaattttcggttttaacgggaacccgggttttaacccgggttaaccccgttttaccggttttaacgggttaaaccccgtttaccgggggttaacccggggtaacccggttaaaccccggggggtaaacccctttacccggggg

SEQ ID NO: 197054 - DNA, 631 bp, Homo sapiens
  misc_feature: GYAE6OF01BLVBO.39.81.H04.1.454.CMB.1.raw
  modified_base (357)..(357): a, c, t, g, unknown or other
  misc_feature (357)..(357): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcgagtgaaggtctcctgcgaaggcttcgtggttacacctttaccaactatggtatcaggttggtgcgacgacggccctggacgaaggcttggagtggagtggatggatcagcgtacttaacaagtggtacaacgaactaaactntcggacaacgaacgaaccctccgaagggcaagacgtccaacatagaaccacagaacacactaccaacgacgacgaccggcctaacagtacgacgtagaggacgacgagacgatcgtacgaccgaaccgacggccgtagttacttacgtcgtacggacggaaggagtaacggtacggggtaaatttacgtttaggacgtttccggttacccgttacgtttaccggtacgttaaccgggttaggggtacccggtaacggggtaacccgttaccggg

SEQ ID NO: 197055 - DNA, 612 bp, Homo sapiens
  misc_feature: GYAE6OF01EYDMA.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccttggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacacggcccctggacaagggcttggagtggagtgggatggatcgagcgacttacaagtggtacaacaacaaactatacgcaacaacgaaccctcgagggcagacgtcaccatcgaccacagacacatacccgacgacgcgacggacctacagtcggacctggacggacgcctaggagacttcgacgacgaccgacgggtccgttagttacgttacgtggtcgacgaggaaggacggttacggggtaaaatttgtttacggtacgttacggttacccttacgtttacggaccgttacggtacggggaccgaccggggtaaccccgtgggtaacccg

SEQ ID NO: 197056 - DNA, 725 bp, Homo sapiens
  misc_feature: GYAE6OF01CI4OO.39.81.H04.1.454.CMB.1.raw
  modified_base (273)..(273): a, c, t, g, unknown or other
  misc_feature (273)..(273): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctgagtgaaggtctcctgcaaggtcttcgtggttacctaccctttacaactagttaggtntcgtaggttgggtgccgacgacggtccccgtagggaacgaagggtcgttggaggtggagtgggtatggatcgacgtcgtacttaacgagttcggaccaacaactaaaacttagtcgaccaacgaacgtaaccctccggaggacaggtacgtacaccatcgaacccacgtaacacacacgtaccgacgacgccgaccgtaccaacgtacgtacggaccgtaggaacggtacgaccgtaggaacgtacttcggaacggaccgtaccggtaccggtaccggtagtttacgttaaccggttggacggtacggaggtaaggtacgggttaacgggtaaattttcggttttaaggtacccgtttaaccgggtttaccccttaacggtttaccggtaaccgggtttaccgggtacccgggggttaaacccggtaacccggggtttaacccgtcccgggg

SEQ ID NO: 197057 - DNA, 657 bp, Homo sapiens
  misc_feature: GYAE6OF01EHA8D.39.81.H04.1.454.CMB.1.raw
  modified_base (184)..(184): a, c, t, g, unknown or other
  misc_feature (184)..(184): n is a, c, g, or t
  modified_base (539)..(539): a, c, t, g, unknown or other
  misc_feature (539)..(539): n is a, c, g, or t
  modified_base (545)..(545): a, c, t, g, unknown or other
  misc_feature (545)..(545): n is a, c, g, or t
tcagtcgcactagtcacgaccggtgctcgatttagtagtgtagattcgcggggcccctagatcacagctcctcaccatggactggacctggagcatccttttcttggtggcagcaacaacaggtgcccactcccaggttcagctggtacagtctggagctgagatgacgaagccgtggggcctnagtgaaggtctctgcaaggtcttctaggttaccacctttaaccaacttataggtatcgtaggttgggtgacgacgacggtcccgtaggaccgaagggcttggagtggagtgggatggatcgagcgtacttaacgacgtggtaccaacgaactaaaactatacgacctaacgaacgaaacccgtccgagggtaccaagacggtacaaccagtacgaacccacgagaacacaactaccgaacgacggtcgaaccgggtacctaacgtaacggttacggaacccgttaggaacggggactaccggtaagacgaacgttacgtacggaacgaccgtacggtccgttagtacgttaccgngtaggngaacgtaggtagttacgggtaaattacgtttcgacgttccgtacttacgttacgacgtcggtggaccggtacggaccgttggacctccgtctaccgtcgccgtctaacccgg

SEQ ID NO: 197058 - DNA, 819 bp, Homo sapiens
  misc_feature: GYAE6OF01C19KV.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactccccaggttcagctggtacagtctggagctgagatgacgaagccgtggggcctcagtgaaggtctcctgcaaggtcttcgtaggttacccattccacctaccttttgctctcgagcgtgggtcgccgacgacggtccccgtaggacgtaagggcttaggaagggttcggtacgttcggggtttacccgtacgtaaaccaaaccgaaccaaaaacccgtagtaccggaccccgtaaaggtaaacggtttacccggaaacggggtccaaacggtaacgttacccgaaaacccgtaacgttaccgaaaccccgtaaaccgaacgtaacccaaccgtaaccgtaaccccgaaaccgggaacccaaccgacggtaacccctaacgtaacgttaaccgggaaacttacgggaacgtccgaacggtaccgtaggtaacgttaagtttacgggaaaccgaaccggtaaccggacctaacgttacgttaactttacggtcggttacggtcggtacggttccttaccgttacgaccgttaaacgttggtacggtacgggttaacggaaaaacggtttaaaacggggtttacgtaacggtttccggacggggtaaccccggtaacgggtaaccccgttgggtacccgttacccggttctcccgtacg

SEQ ID NO: 197059 - DNA, 599 bp, Homo sapiens
  misc_feature: GYAE6OF01DRJSF.39.81.H04.1.454.CMB.1.raw
  modified_base (320)..(320): a, c, t, g, unknown or other
  misc_feature (320)..(320): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttggtgcgacacggccctggacaagggcttgagtggatggatggatcgagcgnttacaagtggtacacaacaactatgacacacgaacctccgaggcagagtcacatcgaccacaagacacactcccaagacgcgacggcctaacgagtccggaccgtggaggacgccgtaggacgtacgtccgtaggaaccgtaccgaccgggtccgttagtacttacgtggtcggacggaaggagacggttacggggtaaatttacgtttagaccgtttcgggtaccccttggtttacgaaccgttacggccggggaaccgtacgggtaaccccgtcggg

SEQ ID NO: 197060 - DNA, 650 bp, Homo sapiens
  misc_feature: GYAE6OF01BEGHW.39.81.H04.1.454.CMB.1.raw
  modified_base (357)..(357): a, c, t, g, unknown or other
  misc_feature (357)..(357): n is a, c, g, or t
  modified_base (434)..(434): a, c, t, g, unknown or other
  misc_feature (434)..(434): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcgagtgaaggtctcctgcaaggcttctggttaccaccttaccactatggtatcaggttggtgcgacacggcccctggacaaggcttggagtggagtgggatggatcgaggcgcttaacgaattggtacctaacaactaaactntcgacacaacgaaccctccgagggaccagacgtaccaccgtagtacgaaccacgacgaacaacactacccacgtacnccgacgtacctacagtaccggactagacggcaccgtgacgtactcgtacgaccgtaacgccgggtaccgtagttacgttccgtaggacgacggtagacggtaaggtacggggttaaatttcggtttacggaccggttcggtttaaccccgttagtttaccggttaaccggtacggtaccggggtaaccgtaaccggggtaccccgtttacccgggg

SEQ ID NO: 197061 - DNA, 796 bp, Homo sapiens
  misc_feature: GYAE6OF01EDPY8.39.81.H04.1.454.CMB.1.raw
tcagtcgcactagtcacgaccggtgctcgatttagtagtgtagattcgcgggacccaaaaaccacacccctccttgggagaatcccctagatcacagctcctcaccatggactggacctggagcattcctttttcttggtggcagcaacaacaggtcgcccactcccaggttcagctggtacagtctggagctgagatgacgaacgccgtggggcctcgagtggaaggtcctcctgcgtaagtcttcgtcggttaacctacctttaacctaacttagtggttatcgtaggttggggtgccgacgaccgggcccgtaggaacgaagggtcttaggaggttgggaggtgggagtaggtactcgagtcgtacttagaagtggtaccaacaactaaacttagtacgaccgaacgaacgtaacccgtaccggagggtaccaaggacctacgaacctaacgtaccggaaaccaacgaacgaaccaacctacctaccgaacgacgtaaccgacccgtaacctacgtacgtaccggaaccgtacggacggtaccgtaccgacgtacgtacgtaccgtacggaaccggtaccggtaccgggttccggttacgtttaacgtttacggtacggtcgggtaacgggaaggtaacgggttaaacgggtaacggggtttaaattttacgggttttaaggttaaccccggttttaccggtttaacccggttttacgtttacgggtaaccccgggtttaacgggtacccgggggttaaacccgtaaccgggggttaaccccggttacccggg

SEQ ID NO: 197062 - DNA, 703 bp, Homo sapiens
  misc_feature: GYAE6OF01BVWOW.39.81.H04.1.454.CMB.1.raw
  modified_base (363)..(363): a, c, t, g, unknown or other
  misc_feature (363)..(363): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcgagtgaaggtctcctgcaaggcttcgtggttaccacctttacaactatggtatcgagttggtgcgacacggcccctaggacgaagggtcttggagtggagtgggatggatcgaggcgtcttaacgaagtcggtacaacgaacaaacgtntacgacaacgacgtaaccctccgagggacaagtacgtaccaacctagtacgaacccacaacgaaccaacactacccgaacgacgaccgaccggacctaacgacgtacggacctagggaacggtacgccgtaggagtactaccgacggaaccgaaccgaccggtccgttagttacgttacgtacgggtacgacggaagggtaaggtacgggttaaacggggttaaatttcgggttttaacggacggttttaccggttaccccgttttaggtttaaccggtaacccggtttaacggggtacccggggtaacccggtaacccggggttaaccccgttaccggg

SEQ ID NO: 197063 - DNA, 719 bp, Homo sapiens
  misc_feature: GYAE6OF01D54LZ.39.81.H04.1.454.CMB.1.raw
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacctacctttacaactatggtatcgaggttgggtgacggacacgggcccctggacgaagggtcttggaggtggagtggggagtggatcgaggccgtacttacgaagttggtacaaccgtaacaaactatacggaccaacgaacgaacccctccggaagggactaacggtacgtacccaaccgtagtacgaacccaacaacggaccaaccgaacgttcccaacggacgaaccgacccgggaccctaacgacgtaccgggaccttagggacggtaccgtacccgtaggaacggtactccgtacggaaccggtaaccgtaccgggtaccgttagttactttaacgtggtacggacggtaaggacggtacgggttacgggggtaaattttcgggtttacgaccggtttaccgggtacccctttacgttacggtaccgttacgggtccggggaccgtaaccgggtacccggttacccggg

SEQ ID NO: 197064 - DNA, 744 bp, Homo sapiens
  misc_feature: GYAE6OF01DLCM1.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagctattcctttttcttggtggcagcaacaacaggtcgcccactcccgaggttcagctggtacagtcgtggagctgagatggacgacgccgtgggcctacgagtgaagtctcgtgcaaggtcttcgtagttacctaccttacaacgttgtgtatcgtaggtttgggcgacgacgaccggtcccgtaggaacgaacgggtcttaggaggttaggagtagggagtggactcgacggtacgtacttaagaagtcggaacaaccgaacgtaaatgtacgaacaacgaaccgaccctacggaggaacacgggtactaccaaacgtgaaccgaaccaacgtaacgaacaaccgtacgtaccgaccggaacgacccgaaccggtaccgtaacgacggtaccgggaacgtagggacgtaccgtacgttagaacggtctaaccggacggaaccgaaccggtccgggttaccgtttaacgttacgttaccgttagggaccggaacgggttaacggaggttaccgggttaaacgttaagttttacggttacgtacggttacccgtttacccgttagttaacccgggtaacggtacggttacccgggacccggttaacgggtccccgttaccgg

SEQ ID NO: 197065 - DNA, 675 bp, Homo sapiens
  misc_feature: GYAE6OF01BH67Q.39.81.H04.1.454.CMB.1.raw
  modified_base (190)..(190): a, c, t, g, unknown or other
  misc_feature (190)..(190): n is a, c, g, or t
  modified_base (217)..(217): a, c, t, g, unknown or other
  misc_feature (217)..(217): n is a, c, g, or t
  modified_base (266)..(266): a, c, t, g, unknown or other
  misc_feature (266)..(266): n is a, c, g, or t
  modified_base (331)..(331): a, c, t, g, unknown or other
  misc_feature (331)..(331): n is a, c, g, or t
  modified_base (347)..(347): a, c, t, g, unknown or other
  misc_feature (347)..(347): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctgganctgagatggacgagccgtggggcctanagtggaggtctccgtgcaaggtcttcgtggttacctaccttaacaactntgtatctaggtggtgacgtacgcggtccgtaggacgagggtcttggagtgggtagtgggataggntcgagtacgtacttanagtcgtacaacaactaactcacgacaacgtaacgtaccgacggaggaccgaagtacgactaaccgataccgaacacacgaacacacgtaccacgacgacctacgacctacgacgtacggccgtaaggacgtaacgcgtacgacgtactacgacggtaacgtaccggtaccgtaccgttagtttaactcggtacggtaggacggtaaacggtaggttaaacgggtaaacgggtttaattttacggttacgtaacgttaccggttaccgttacgttacgggtaaccggttacgggaccggggttaacggaaccggttccccggttaacgg

SEQ ID NO: 197066 - DNA, 679 bp, Homo sapiens
  misc_feature: GYAE6OF01BHNXZ.39.81.H04.1.454.CMB.1.raw
  modified_base (352)..(352): a, c, t, g, unknown or other
  misc_feature (352)..(352): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttctggtggcagcaacaacaggtgcccactcccaggttcagctggtacagtctggagctgagatgacgaagccgtggggcctcgagtgaaggtctcctgcaggcttctggttacacctttacaactatggtatcgagttgggtgcgacgcggccctggacgtaaggcttgagtggagtggatggatcagcgacttaacgatggtaccacgaactaaaactntagacctacaacgtaaccctccgaagggccaaggacgtacctaacacgtacgaacccagacgaactacaactccgaacgacgacaccggcctaacacgtacggaacccgtggaacggtacgaccgtaggaacgtacgtaccgtacggaaccgaccgtaccgggtacccgttaggttaaacgttacgtggtacggaaccggtaaggtaacggtaaccgggttaacgggggtaaactttaacgttttacgggaacggttaccggttaccccgtttagttaccggtacgttacgggacgggtacccgtaaacggggtaccccgttacggg

SEQ ID NO: 197067 - DNA, 786 bp, Homo sapiens
  misc_feature: GYAE6OF01CGYG8.39.81.H04.1.454.CMB.1.raw
  modified_base (192)..(192): a, c, t, g, unknown or other
  misc_feature (192)..(192): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcttgggtggcagcaacaacaggtcgcccactcccaggttcagctggtacagtctgganctgagagtgacgagccgtggggcctcgaggtcggaacggtctccgtgacgaaggtcttcgtaggttaacctaccctttaaccgaacttagtaggttatacgtaggttgggtcgaccgaacgtcgggtccccgtaggacggaagggtcgttaggaggtagggtaaggtggtagtagcgtacgacggtcgttactaaccgtagttcggtacaactaaacgtaaactcgtacgacccaaccgtaaaccggtaacccgtccgaacgggacctaacgggtacctaaccgaaccgtacgaaccggtaacccaacgaacgaaccgtaacccaacgtacccgaacccggtaacggacccgtaacccgggtaaccctaacgggtaaccgtaaccgggtacccgtaggggaacgggaacccggtaccgtaggtaaccgtacgttaccgaaccggaaccgtaccggtacccgggtacccgtttagttaacccgttaagtccggaggaccggtaaaggtaggtaacggtaacggttaacgtttcgttacgtacgttcgtacccttgttacgacccgttggacgggacccgtaagggtccgtaccgg

SEQ ID NO: 197068 - DNA, 756 bp, Homo sapiens
  misc_feature: GYAE6OF01CXQ5R.39.81.H04.1.454.CMB.1.raw
  modified_base (328)..(328): a, c, t, g, unknown or other
  misc_feature (328)..(328): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcttggtggcaagcaacaacaggtcgcccactcccaggttcagctggtacagtctggagctgagatgacgagccgtggggcctcgagtgaaggtcctaccgtgacgaaggtcttcgtacggttacctacctttacaacttgtggtatcgtaggttgggtcgcgaccgcgggacccctaggacgaagggtctaggnggtggaggtggtaagtggacgtcgaggccgtattaacgaagttcggacctaacaacgtaaactgtaccgacaaccgaaacgtaacccgtacgggagggtactacggaaccgttaccaaaccgtagtaccggaaccaaacgacgaacctaacgtaacacccggacgaacgtaccgaacggtccctaagacgtccggaccgttagggacggtcgtaccgtagaacgtactccggaacggtaccaacgggttacccggtacgttacggtttatacgggttcgacgggaggtaaaggtaacggtacgggttaaacggttaaagttttcggtttaaccgggaccggtttttacccgtaacccggttttgttacccggtaacggtttaccgggggaccgggtaaacccgttaccgggggtccccgtttaacggg

SEQ ID NO: 197069 - DNA, 673 bp, Homo sapiens
  misc_feature: GYAE6OF01A3Y3D.39.81.H04.1.454.CMB.1.raw
  modified_base (428)..(428): a, c, t, g, unknown or other
  misc_feature (428)..(428): n is a, c, g, or t
  modified_base (442)..(442): a, c, t, g, unknown or other
  misc_feature (442)..(442): n is a, c, g, or t
  modified_base (458)..(458): a, c, t, g, unknown or other
  misc_feature (458)..(458): n is a, c, g, or t
tcagtcgcactagtcacgaccggtgctcgatttagtagtgtagattcgcggggcacccaaaaaccacacccctccttgggagaatcccctagatcacagctcctcaccatggactggacctggagcattccttttcttggtggcagcaacaacaggtcgcccactcccaggttcagctggtacagtctggagctgagatgacgaacgccgtggggcctcgagtgtaacggtcctccgtgacgaacggtccttcgtacggttaacctacccgttttaaccaacttagttggttactcgtagggtttcgggtacgcgacgtaccggtcccgtaggaacgtagggtcgttaggaggtggtaggtgggagtaggatcgagtcgtacttagagtcgtacaacacaacttgacgacagacgaccgtacgagganacgcgaccacgtanacgacacacgacaacnccgtacacgacgcgaccgtactagtacgtacgacgtaggacgacgtcgtagaactcgtacgtacgaccggtaccggacgttccgttaagttacttacggcgtacggacggaacgtaggtaaagggttacggtttaatttacggttacggtaaccgttcccggttacttacggttaccgtacgggttacggtaccggggaccgttaaccgggaccg

SEQ ID NO: 197070 - DNA, 623 bp, Homo sapiens
  misc_feature: GYAE6OF01EWIJ5.39.81.H04.1.454.CMB.1.raw
tcagtcgcactagtcacgaccggtgctcgatttagtagtgtagattcgcgggacccaaaaaccacacccctccttgggagaatcccctagatcacagctcctcaccatggactggacctggagcatccttttcttggtggcagcaacaacaggtgcccactcccaggttcagctggtacattctggagctgagatgacgaagcctggggcctcgagtgaaggtctcctgcaaggcttctggttacacctttacaactatggtatcagttgggtgcgacacggccctggacaagggcttggagtggagtggggatgggatcgagcgtcttaacaagttcggtacaacgaactaaaactagtcgacaacaacggaaccctccgaagggcaaggacgtcacgatacgaccacagacaacactaccgaacgacgacaccggacctacgacgtacggaccgtaggacgacgcctaggaacgtactcgtacggaaccgacgtaccggcgtacgtaacgttacgtgtcggcggaacgaggtacgtaacggggtaattacggtttagacggttcggttacccgttgtttacgtacgttacggtaggggtacccgacgggtaacccgtccgg

SEQ ID NO: 197071 - DNA, 640 bp, Homo sapiens
  misc_feature: GYAE6OF01B0X22.39.81.H04.1.454.CMB.1.raw
  modified_base (258)..(258): a, c, t, g, unknown or other
  misc_feature (258)..(258): n is a, c, g, or t
  modified_base (344)..(344): a, c, t, g, unknown or other
  misc_feature (344)..(344): n is a, c, g, or t
  modified_base (384)..(384): a, c, t, g, unknown or other
  misc_feature (384)..(384): n is a, c, g, or t
tcagtcgcactagtcacgaccggtgctcgatttagtagtgtagattcgcggggacccaaaaaccacacccctccttgggagaatcccctagatcacagctcctcaccatggactgggacctggagcatccttttcttggtggcagcaacaacaggtgcccactcccaggttcagctggtacagtctggagctgagatgacgaagccgtggggcctcagtgaaggtctcctgcaggcttctggttacacctttacaatntgtatcagttgggtgcgacaggccctggacagggcttggagtggatgggatggatcgagcgtactacaagtggtacacacaaactngacacacgaacctcgaggcagacgtacaccatcgaaccanacgacactactacccgacgacgacgacccggtacctaacgacgtacgggtaacccgtagggaacggtacgaccgtaggacgtactcgtacggaccggaaccgtaccggtcgttagttacgtttaccgtaggacggacgaaggaggttaggtaaacggggttaaatttcggttttagaacggtttccggttaacccgtttcgttaacggtaaccttacgggtacggggtaacccgtacggggaaccccgttaccggg

SEQ ID NO: 197072 - DNA, 695 bp, Homo sapiens
  misc_feature: GYAE6OF01A496S.39.81.H04.1.454.CMB.1.raw
  modified_base (402)..(402): a, c, t, g, unknown or other
  misc_feature (402)..(402): n is a, c, g, or t
  modified_base (651)..(651): a, c, t, g, unknown or other
  misc_feature (651)..(651): n is a, c, g, or t
tcagtcgcactagtcacgaccggtgctcgatttagtagtgtagattcgcggggacccgaaaaccacacccctccttgggagaatcccctagatcacagctcctcaccatggactggacctggagcattccttttcttggtggcagcaacaacaggtgcccactcccaggttcagctggtacagtcgtggagctgagatgacgaagccgtggggcctcgagtgaaggtctcctgcaaggcttcgtcggttacctacctttaccaactattggtactcgtaggttgggtgcgtacgacggtccctaggacgaagggtcgttaggagttggagtgggatgggtatcgacgcgtaccttaagaacgtggtacaacaaactaacgtctagacaacgacggtaaaccncccggagggcaacgtacgtacgaaacctagtacgaaccgacaacgaccactaaccgaccccgaagggtaaccacccggtaccgtacccttaaacgcggtttacccggaacccgtaggacggtactaccgtggaaccgtagtcccgaaggacccgtaaacggccggtaccgttagttaacctttaggcggtagaccgagacgggtacgtaaagggtaaatttgtttaccggacttaccggttacccgttnttaaccgcgggtacgttcgggaaccgtttcccggaaggtttccg

SEQ ID NO: 197073 - DNA, 661 bp, Homo sapiens
  misc_feature: GYAE6OF01BPZC7.39.81.H04.1.454.CMB.1.raw
tcagtcgcactagtcacgaccggtgctcgatttagtagtgtagattcgcggggacccaaaaaaccacacccctccttgggagaatcccctagatcacagctcctcaccatggactggacctggagcatccttttctggtggcagcaacaacaggtgcccactcccaggttcagctggtacagtctggagctgagatgacgaagccgtggggcctcgagtgaacggtctcctgcaaggcttcgtggttaccacctttaccaactagtggtatcgtaggttgggtcgcgacgacggccccgtaggaccaaggtcttggaggtggagtgggagtggactcgagcgtacttacgaacgttggtacaacgtaactaaactatcgacaacacgaacccgtaccgagggacgaagagtaccacgagtaccgaaccacacgaacactacgtacccgaacgacgaccgacccggtcctaacgagtaccggaccgtaggaacggcgtaccgaggtacgtacgtccgtacgaaccgaaccgtacccgggtaccgttagttacgtttacgtggtacgaccggaaggtacgtacggtacgggtaaatttcgtttagacgttccgtacccttcgttacgtacgtacggtacgggaccgtacgggtacccgttcgg

SEQ ID NO: 197074 - DNA, 627 bp, Homo sapiens
  misc_feature: GYAE6OF01B1CT6.39.81.H04.1.454.CMB.1.raw
  modified_base (345)..(345): a, c, t, g, unknown or other
  misc_feature (345)..(345): n is a, c, g, or t
  modified_base (360)..(360): a, c, t, g, unknown or other
  misc_feature (360)..(360): n is a, c, g, or t
  modified_base (385)..(385): a, c, t, g, unknown or other
  misc_feature (385)..(385): n is a, c, g, or t
  modified_base (493)..(493): a, c, t, g, unknown or other
  misc_feature (493)..(493): n is a, c, g, or t
  modified_base (536)..(536): a, c, t, g, unknown or other
  misc_feature (536)..(536): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcattcctttttcttggtggcagcaacaacaggtgcccactcccaggttcagctggtacagtctggagctgagatgacgacgccgtggggcctcgagtaggaaggtcctcctggacgaaggtcttcgtcgttacctacctttacaactgtaggtatcgtaggttggtcgcgacgacggcccgtaggacgaagggtcttgaggtggagtgggatggatacgnggtacgtacgttaanaacgttggaccaactaacaaacttncgacaacgacgtaaccgcgagggacaggacgtaccacacgtacgaccaacgaacgacacactaccgacgacgaccaccgtacagacgtacggacgtggacggctacgngaactctacgtacgacgaccgtacggtcgtagttacgtcgtgnggacgtaggagtacggtaaggttaatttcgtagtacgttcggttaccttcgttaggtaccgttccggagggacccgtacggtcccgtccgg

SEQ ID NO: 197075 - DNA, 642 bp, Homo sapiens
  misc_feature: GYAE6OF01AHPMW.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcgaaggcttctggttacaccttttaccaactatggtatcgtaggttgggtgcgacacggcccctggacgaagggcttggagtggagtgggatggatcgaggcgtcttacaagtgacacacaaactatgaccaacgaacgaaccctccgagggaccaggacgtaccaaccatacgaacccaacacgaccacactacccgacgacgaccgacggcctacacgtacggaccgtaggacggacgccgtaggacgacttccgtacggaaccgaaccggtaccgggtccgttagttaacgtttacgtaggtacgacggaagacggtagtaaggggtaaacgtttgtttcggacgttcgttacccgtttcttacggtaaccttacgggtacgggaccgtaaccggggtacccgttcggg

SEQ ID NO: 197076 - DNA, 631 bp, Homo sapiens
  misc_feature: GYAE6OF01A5QPK.39.81.H04.1.454.CMB.1.raw
  modified_base (549)..(549): a, c, t, g, unknown or other
  misc_feature (549)..(549): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcattccttttcttggtggcagcaacaacaggtcgcccactcccaggttcagctggtacagtctggagctgagatgacgaagccgtgggcctcgagtgaaggtcctccgtgacaacggtcttcgtacggttaacctaccttttaaccgaattagtaggttatcgtaggttcggtcgccgaacgccggcccgtaggacgaaggtctggaggtggagtgggagtggatacggagtcgtacgttaacaagtcgacaactaactaaactacgtacgaccgaacaaccgacccgtacggacggacagacacacgatacgacagaacgacacgacgtacgacgagtaccgacgtacctacgagtaccgacgtagaggaccgtcgtagacgtatacgtagaccgtacgacggtcctagttacgtcgtgacgnaggacgtacgtacggtaattggttacgtacgtacgttaccgttgttacgtacgtacggtacggacgaaccggtccgtaacgg

SEQ ID NO: 197077 - DNA, 618 bp, Homo sapiens
  misc_feature: GYAE6OF01E0WTP.39.81.H04.1.454.CMB.1.raw
  modified_base (270)..(270): a, c, t, g, unknown or other
  misc_feature (270)..(270): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagcctggggcctcagtgaaggtctctgcaggcttctgttacacctttacaactatggtatcagttggngcgacgacggccctggacagggtctggaggtggagtggggatggatcgagcgcttaacaagtcggtacactaacaaactatgacacacgaacctcgaggcagactcacatacgacacagacacactaccacgacgaccgaccggtacctaacgacgtacggaccgtaggacgggtaacgccgtagaacgtactgacgaaccggaaccgaccgggtccgttagttacgtttacgtggtagaccggtaggaggtacggtaagggtaaatttcgttttaggtaccgttacggttaccctttgtttacgtaccgtttacggtacggggacccgtaacggggtcccgttacgg

SEQ ID NO: 197078 - DNA, 719 bp, Homo sapiens
  misc_feature: GYAE6OF01BAM3C.39.81.H04.1.454.CMB.1.raw
  modified_base (387)..(387): a, c, t, g, unknown or other
  misc_feature (387)..(387): n is a, c, g, or t
  modified_base (512)..(512): a, c, t, g, unknown or other
  misc_feature (512)..(512): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtcgcccactcccaggttcagctggtacagtctggagctgagatgacgaagccgtgggcctcgagtgaaggtctcctgacaaggtcttcgtggttacctacctttacaactatggtactcgtaggttgggtgcgacgtacggccccgtaggacgtaagggtcttaggaggtggtacgtggggatgggactcgagtcgtacttaacgaagtggtacccaactaaactaaacgtntacggacctaacgaaccggtaaccctccgaagggtacaacggtactaccaccgaataccgaaaccacgaacgaccaataaccgacccaaggacgccaaccggtacctaacaggtaccgtaaccgngggaaccggacgtaccgtagaacgtataccggtacgaaccggaccggtacggtaccgttagttacgttacgtcggtagacggaaggtaacggtaacgggttaagggttaatttacggttttaggacccggtttaccggttaaccccgtttggttaaccgttacggtaccgggttaccggggaaccgtacggttaaccccggttcggg

SEQ ID NO: 197079 - DNA, 748 bp, Homo sapiens
  misc_feature: GYAE6OF01CHKZY.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaaacaacaggtgcccactcccaggttcagctggtacagtctggagctgagatgacgaagccgtggggcctcgagtgaaggtcctctgacaggtcttcgtggttactacctttacaactgtggtatcgtaggttggtgcgacgacggtcccgtaggacgaagggtcttggaggttggaggttgggagtggatcgacggtcgtacttaagaacgttcggtacaaactaacgtaaaactgtacgacctaacgaacgtaaacccgtcggacgggacaaggtactaccaaccgtagtaccgaaccaacgacgtaaccaacgtacgtacccgaacgacgacccgaacggtacctaacggacgtacggacctagggacgtcgtaccgtagggaactcgtccgaggaaccgaccgggtacggtaccgtttagttacgttaccgtgggacggtaaccggtaaggaacggttacgggttaaacgggttaactttttacggttaccggtaaccggtttacccgtttaaccccgtttaggtttaaaccggacccggggtttaaccggggacccggggtaacccggttaaaccggggttaaccccgtttccgggg

SEQ ID NO: 197080 - DNA, 632 bp, Homo sapiens
  misc_feature: GYAE6OF01AIV19.39.81.H04.1.454.CMB.1.raw
  modified_base (220)..(220): a, c, t, g, unknown or other
  misc_feature (220)..(220): n is a, c, g, or t
  modified_base (234)..(234): a, c, t, g, unknown or other
  misc_feature (234)..(234): n is a, c, g, or t
  modified_base (270)..(270): a, c, t, g, unknown or other
  misc_feature (270)..(270): n is a, c, g, or t
  modified_base (524)..(524): a, c, t, g, unknown or other
  misc_feature (524)..(524): n is a, c, g, or t
  modified_base (614)..(614): a, c, t, g, unknown or other
  misc_feature (614)..(614): n is a, c, g, or t
tcagtcgcactagtcacgaccggtgctcgatttagtagtgtagattcgcgggggacccaaaaccacacccctccttgggagaatcccctagatcacagctcctcaccatggactggacctggagcatcctttctggtggcagcaacacaggtgccactccaggttcagctggtacagtctggagctgagatgacgaagcctggggcctcagtgaaggtcncctgcaaggcttcnggttacacctttacaactagtggtatcagttgggtncgacaggcccctggaccagggcttgcgtggacgtggggatcgggatccgagcggacttacgaatgggtaccacgacaaacctatcggaccacaacggaaccttacccgaacggggtccaggacgtacgacctacgtacgacccacgaacgacacatcccgacgacgcaccgggtcctacacgtcggacctggaacggacggacccttggacgtaactcgtacgaccggaacgaccggggcctaggtacttacgngtcgaccggagtagaccggtaggggaatttacggttacggtacgttaccggttaacccgtcttaacgtacgttacggtacggtacccggngggtaacccgttaccggg

SEQ ID NO: 197081 - DNA, 687 bp, Homo sapiens
  misc_feature: GYAE6OF01BSLJR.39.81.H04.1.454.CMB.1.raw
  modified_base (354)..(354): a, c, t, g, unknown or other
  misc_feature (354)..(354): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctctgcaggcttctggttacaccttacaactatgtatcgagttgggtgcgacgacggccctggacgaagggcttagaggtggagtgggagtggatcgagcgtacttacagtcggtacaacaactaatanacgacaacgacgacctcgaggcagacgtacaccgatacgaaccacgacgtaacactactaccgaacgacgtaccgaccgtaccacgtacgtacggacccgtaggacggaccgtacgtacgagtacgtacgtacgaaccgtaacggtacccgggtccgttaacggttaccgtttacggtacggttacggacggtaacgggtaacggttaacggggtaaacgggttaaagtttacggtttaggtacccgtttacgggttacccctttacggtttacggtaaccggttaccgggtaccggggtacccgttaaaccgggggtccccgtttacccggg

SEQ ID NO: 197082 - DNA, 824 bp, Homo sapiens
  misc_feature: GYAE6OF01AL9AO.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtcgcccactcccaggttcagctggtacagtctggagctgagatgacgaacgccgtgggcctcgagtaggaacgtctccgtgacgaacggtcttcgtacggttaacctacctttaaccaacgtagtaggtactcgtaggttcgggtgaccgacgtacggtcccgtaggaacgtagggtcgttaggaggtaggaggtgggtaactgggtaactcggacgtacgtacgttaacgtaacgtcggtaacctaacgaaactaaacgttacgtacgaaccaaaccgtaaccggtaaacccgtaccggaaacggaccggtaacgtaccgtacccgtaaaccgacgtaaccccgaaacctaaccgaaccgaacccgaacccgtaacgtaccccggaaaggacccgtaacccggtaacccccggtaacctaaccgaacgtacccgggtaaaccgttcgggaaaccggtaaccgtacccggtaggtaacgtaactaccggtaacgggaacccgtaacgggtacccggtacgttacgttacgttagtaccgtaggacggtaaggtaacggtacgggttaacggttaaacgtttcggttaacgttaccggttaaccgttacccttaggtttaccggtacggttaccgggtacggggtaaccccgttacgggcccgttaccgg

SEQ ID NO: 197083 - DNA, 901 bp, Homo sapiens
  misc_feature: GYAE6OF01BNCL9.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttcgtggttaccacctttaccaactatggtatcagttgggtgacgacgacggccccgtggacaagggtcttggagtggagtgggatggactcgaggcgtacgtttaacaagttcgggtaccaacgtaacctaaaacgtactcggacctaaccgtaaccgaaacccgttacccggaacggggacctaacgggtaacgttacccgaaaccctaacgttacggaaaccccaaacgaacggtaaacccaaccgtaaccgttaccccgaaccgggaaaccgtacccgaaacccggggtaaccccgttaaaccgtaacggttaccggggaaacccgtttcggggaaacggggtaaccccggtaccggttaacgggtaacggttaaccggtttaccggtaaccgggtaaacccgggtaacccggtaaccccgggggttcccgtttaaaccggtttaaacgttttaacccggttgggtttaccgggaaccggtaaacgggtaaacggttaaacggggttaaccgggggttaaaaacgttttcggtttttaaaccgggtaaccggttttacccggggtttaaccccgttttacggttttacccggtaacccggtttaaccggggtaccggggggtaacccggttaaacccgggggttacccgggttaaccccggg

SEQ ID NO: 197084 - DNA, 747 bp, Homo sapiens
  misc_feature: GYAE6OF01EQACH.39.81.H04.1.454.CMB.1.raw
  modified_base (271)..(271): a, c, t, g, unknown or other
  misc_feature (271)..(271): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaacgccgtggggcctcgagtgaaggtctcctgcaggcttctgttacaccttacactatgtatcgagttggngcgacacggccctggacgaagggcttggagtggagtgggagtggatcgagcgtacttaacgtaagtcggtaccaaccgtaaactaaaacgttagtacgaccaaccgtaacgaaacccctaccggaacggggaccaagggtaaccgtacccgaaacccgtacgtacggaaaccccaacgaaccggaaccctaacaaccctacccgaacggacgtaccggaacccggtaccctaacgacgtacggaccgtacgggaacgggaccgtaccgtaggaacgtctaccggtacggaacccgaaccggtacccgggtcgttaagtttaacgttacgtaggtacggaggtaacggtagggtaacggttaacggggttaaatttcggtttacggtacgtttcccgggttaaccctttggtttaaccgtaaccggtttacccgggtacgggggaacccggtaacccggggtaacccgttaccgggg

SEQ ID NO: 197085 - DNA, 613 bp, Homo sapiens
  misc_feature: GYAE6OF01CO9MB.39.81.H04.1.454.CMB.1.raw
  modified_base (356)..(356): a, c, t, g, unknown or other
  misc_feature (356)..(356): n is a, c, g, or t
  modified_base (414)..(414): a, c, t, g, unknown or other
  misc_feature (414)..(414): n is a, c, g, or t
tcagtcgcactagtcacgaccggtgctcgatttagtagtgtagattcgcggggacccaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcgtaggttgggtgcgacgacggtcccctggacgaagggcttggagtggagtgggatggatcgagcgtctacaagtcggtacacaacaaactntcgacacacgaacctcgaggctagacgtcacgatacgaccacagacacactccacganacacgacctacgatcggacctggaaggacgcctaggacgtactcgtacggaaccgaccgaccggtccggttattaacgttcgtaggtcgacggagtacggtaagggtacgggttaaatttcggttttagaaccgtttcggttaccccttgtttaccggtacgttaccggtcggggtacccgacgggtaccccgttcggg

SEQ ID NO: 197086 - DNA, 661 bp, Homo sapiens
  misc_feature: GYAE6OF01C88QQ.39.81.H04.1.454.CMB.1.raw
  modified_base (190)..(190): a, c, t, g, unknown or other
  misc_feature (190)..(190): n is a, c, g, or t
  modified_base (224)..(224): a, c, t, g, unknown or other
  misc_feature (224)..(224): n is a, c, g, or t
  modified_base (276)..(276): a, c, t, g, unknown or other
  misc_feature (276)..(276): n is a, c, g, or t
  modified_base (343)..(343): a, c, t, g, unknown or other
  misc_feature (343)..(343): n is a, c, g, or t
  modified_base (368)..(368): a, c, t, g, unknown or other
  misc_feature (368)..(368): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttctggtggcagcaacaacaggtcgcccactcccaggttcagctggtacagtctgganctgagatgacgagccgtgggctcgagtgaagtcnctgacagtcttctaggttactaccttaccacttgtggtatcgaggttgggtncggacgtcggtccctaggaacgagggtcttaggaggtggagtggtagtggatcggacgtcgtactanagtcggtacaactaaactaacgtangaccagtaccgtaacgcgtaaggctaacggacgtacccaacgtacgacgtaacccaacgaacgaaccacgtaacctacccgaacgtacgacccgacgtaacctacgaacgtacgggtaccttaggacggaccgtccgtaggtacgtacgtcggtaacggaaccgtacggtccggttacgtaacgttaatcggtggtacgacggtacgtaggtaccgggttaagtaagtttcgttacgacgttccggttaccttagtacgtacggacggtcggtaaccgacgggttcctaccgg

SEQ ID NO: 197087 - DNA, 658 bp, Homo sapiens
  misc_feature: GYAE6OF01E3MC9.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggccccgtggacaagggcttggagtgggatggggatggatcaggcgacttacaagtggtcaacaacaaaactatgacacacgaacctccgagggcagactacacagtcgaccacgagacacacgtaccacgacgccaaccggcctaacgagtcggaccgtaggaaggacgacccgtaggacgactacgtacgaacccggaacggacccgggtccggttagttaacgtttacgtggtacggacggaaggtaagggtaacgggtaacgggggtaaaattttacgttttaggaccggttaccgggtttaccccgttacgttttaccgaccggttaccggtaccgggggtacccggtaaaccggggtaccccggttaccggg

SEQ ID NO: 197088 - DNA, 252 bp, Homo sapiens
  misc_feature: GYAE6OF01DAP7F.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttactacctt

SEQ ID NO: 197089 - DNA, 652 bp, Homo sapiens
  misc_feature: GYAE6OF01EQYT0.39.81.H04.1.454.CMB.1.raw
  modified_base (512)..(512): a, c, t, g, unknown or other
  misc_feature (512)..(512): n is a, c, g, or t
  modified_base (639)..(639): a, c, t, g, unknown or other
  misc_feature (639)..(639): n is a, c, g, or t
tcagtcgcactagtcacgaccggtgctcgatttagtagtgtagattcgcggggcccctagatcacagctcctcaccatggactggacctggagcatccttttcttggtggcagcaacaacaggtgcccactcccaggttcagctggtacagtctggagctgagatgacgaagccgtggggcctcgagtgaaggtcctcctgcgaaggtcttcgtggttaacctacctttaaccaacttagtggtatcgtaggttgggtcgcgacgacggcccgtggacgaaggtctgagtggagtgggagtggacgtcgaggtcgtacttaacgaagttcggtaccaacaacgtaaactatacgacaacgaacgaaccctcggaggcaacgacgtaccaacagtcgaaccacaacgacacacgtaccacgacgaccaccggacctacgacgtaccggacgtggaacggcgtacgtaggatacgtcgtacggaaccgacgtacggtaccttagtactttcggngtacggacgaggtaagtacggttaacggtttaactttgttacgacgttaccggttaccgtttcgttaacggtaccgtcgggtacgggaccgtaaccggtaccgtcggtaccctccgtcttcccgacnccgaccctaccgg

SEQ ID NO: 197090 - DNA, 560 bp, Homo sapiens
  misc_feature: GYAE6OF01DQN3X.39.81.H04.1.454.CMB.1.raw
  modified_base (256)..(256): a, c, t, g, unknown or other
  misc_feature (256)..(256): n is a, c, g, or t
  modified_base (360)..(360): a, c, t, g, unknown or other
  misc_feature (360)..(360): n is a, c, g, or t
  modified_base (400)..(400): a, c, t, g, unknown or other
  misc_feature (400)..(400): n is a, c, g, or t
  modified_base (430)..(430): a, c, t, g, unknown or other
  misc_feature (430)..(430): n is a, c, g, or t
  modified_base (447)..(447): a, c, t, g, unknown or other
  misc_feature (447)..(447): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaagcttctgttacacctttacaactntggtatcgtagtgggtgcgacacggccctggacaaggcttaggagtggagtggatggatcgagcgattacaagtggacacaacaactatcgacacaacgaaccncgaggcaaggcgtaccacatcgaaccagacgaccaacacnccgaacgacgacacgtcctaacagtcgacnggagcgccgtagacgtntccgagaacgacgaccggtcgttagtacttagtgtcgacgagagaggtagggtaattgttgacgttcgtacccttgttacgtaccgtacggtgggaccgtgggtaaccgtcgg

SEQ ID NO: 197091 - DNA, 650 bp, Homo sapiens
  misc_feature: GYAE6OF01DJB5L.39.81.H04.1.454.CMB.1.raw
  modified_base (340)..(340): a, c, t, g, unknown or other
  misc_feature (340)..(340): n is a, c, g, or t
  modified_base (360)..(360): a, c, t, g, unknown or other
  misc_feature (360)..(360): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgagccgtggggcctcagtgaggtctcctgcaaggtcttcgtgttacctacctttacaactagtggtatctaggttggtgacgacgacggcccctaggacgaagggtcttggagtggagtgggagtggatcagcgtacttanatcggacaacaactaaactntcgacaacaacgacctcgaggcagacgtcacagtcgaaccacacgacacactaccgacgacgaccgacggtacctacgagtcggaccctagggacggacgtccgtagaacgtatccgtaggaacccgacggaccggccgttagtacctttacgtggtacggaacggaggtacggtacggtaaacggggttaaatttacggtttaggtaacggtttccggttacccgtttacgtttacgggtaacgtttaccgggacgggggtaaccctaacgggggtacccttaccgggg

SEQ ID NO: 197092 - DNA, 828 bp, Homo sapiens
  misc_feature: GYAE6OF01BXZP5.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtggggcctcgagtagaaggtctccgtgacgaaggtcttcgtcggttacctacctttacaacttagtaggtactcgtaggttgggtcgacggacgacggtccccgtagggaacgaaggggtcttaggaggttggagtgggattgggactacgaggtaccgtacttaacgaagttcgggaccaacgtaacgtaaaaccttagttacgaaccgtaacgaaaccggtaaacccgtaccggaacggggtaccaagggtaaccgttacccgaaacccgtaaggttaacccggaaaccctaaacggaaccgaacccgtaaccgtaacccgttaaacccggaaaccccgggtacggaaccccgtaaccccgggtaaacccgttaacggaaccggtttaaccgggacccgttaacgggggaaaccgggtaccggtaccgttacgggaacgttaaccgttacgtaacggtaccgaaccgggtacccgggtacgtacgttaacgttacggtgtaccgggacgtaaggtaggtacgggtaacgggttaagttttaacgttcgggaacttccggttacccttaggttacgtaccgttccggaggggttaacccacggggttacccgttaccggg

SEQ ID NO: 197093 - DNA, 695 bp, Homo sapiens
  misc_feature: GYAE6OF01D8A5E.39.81.H04.1.454.CMB.1.raw
  modified_base (349)..(349): a, c, t, g, unknown or other
  misc_feature (349)..(349): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttggtgcgacacggccctggacaaggcttgagtggagtgggatggatcgagcgtcttaacaagtggtacaacaactaaactntacgacacgacgaacctcgagggcaagcgtacaccatcgaccacacgacacactaccaacgacgaccgacggacctaacgtagtacggaccgtaggacgggacgtaccgtaggaacgtacgtaccgtacggaaccgaccgtaccgggtacccggttacggtttaacgtttacgtacggtacggaccggtaaggtaacgggtaacggttaaaccgggggttaaattttacggttttacggtaaccggtttaccggttaacccccgtttacgttttaaccggttacccgtttaaccggggttaccgggggtaaccccggttaaccggggtaacccccggttacccggg

SEQ ID NO: 197094 - DNA, 906 bp, Homo sapiens
  misc_feature: GYAE6OF01C5F9R.39.81.H04.1.454.CMB.1.raw
  modified_base (423)..(423): a, c, t, g, unknown or other
  misc_feature (423)..(423): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcttgggtggcagcaacaacaggtgcccactccaggttcagctggtacagtctggagctgagatgacgagccgtggggcctcgagtggaaggtctcgtgcgaaggtcttcgtcggttaacctacccttttaaccaaacgttagttcggtattaccgtaggttcggggtcgacggaccgtacggtaccccgttaggaccggaagggtcttagagggttcggaagtggggtatgggtactcgacggtcgtacgttaacgaagttcgggactaaccgtaacgaaaacgtttancgtaaccaaacggtaaacgtaacccgttacggaacggtaccgtaacggggtacttaccaaacccgtagtaacccggaacccaaacgaaccgggtaacctaaaccgtaccggttaaccgtaaccgggaaccgggacccgtaaacccgggtacctaaaccggtaacgggtacccggtaacggtaacgggacggttaccgaccgttacggaaggtttacccacggttaaccgaaaccggttccccggaacgggttacccgggttagtttaaaccggttacttcccgggggaagtaaacccgggtaagggtaaccgggttaaacggggttaaacccggggtttaaacttttttaccggggtttaagtaaccccggggttttaccggttacccccgtttttaacgggtttaaccgggtaacgtttacccgggggttaacccgggggacccggtttaaacccggggttcccccgtttaaaaccgggggg

SEQ ID NO: 197095 - DNA, 788 bp, Homo sapiens
  misc_feature: GYAE6OF01DJ4JL.39.81.H04.1.454.CMB.1.raw
  modified_base (382)..(382): a, c, t, g, unknown or other
  misc_feature (382)..(382): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtcgcccactcccaggttcagctggtacagtcgtggagctgagatgacgacgccgtgggcctcgagtgaggtctcctgacgagtcttcgtacggttacctaccgtttaccaacgttagtcggtatcgtaggttgggcgacgacgacggccccgtaggacgtaagggtcttagaggtggagtggagttggatcgaggcgtactaactagtcgtaccaacaactaaactntacggaccaacgtaacgaacccgtaccggagggtacaaggtacgtaccaacccgtagtaccgaacccaagaacgaacctacgaacctaccgaaccgtaacgacccgaacccggtacctaaccgacggtaccggtacccgtgggtaaccggtaccgtaccgtaacggtaacgtaccggttaccgtacgggaacccgtaaccgggtaacccggttaccgtttaacggttaacggtttaccgttacgggttacggaacgggtaacgggtaaggttaaccgggttaacggttaaacgttttcggtttaccggttaacccgtttaccgggttacccccttttagggttaacccggttaccggtacgggtacccggggtaacccggtaaacccgggttaccccggttccggg

SEQ ID NO: 197096 - DNA, 657 bp, Homo sapiens
  misc_feature: GYAE6OF01AHR38.39.81.H04.1.454.CMB.1.raw
  modified_base (349)..(349): a, c, t, g, unknown or other
  misc_feature (349)..(349): n is a, c, g, or t
  modified_base (369)..(369): a, c, t, g, unknown or other
  misc_feature (369)..(369): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgagccgtgggcctgagtgaagtctcctgcaggcttcgtggtacacctttacaactatggtatcgaggttgggtagccgacgacgggtcccctagggacgaaggggtctttaggaggttgggagtggggatgggaatcgagcgtacttanagtcgacaacaactaaactntacgacacacgaaccgtcgaggcagactacacatacgaccacgacgactacactaccgacgagacgacccgactacgagtacggacccgaggacggacgactaggaacgtacgtacgacggaacccgtaaccggaccggtacgtttaacggtacttacgtagggacggacgaaggacggtaacgggtaagggttaacgtttaggtttacgtaaccggttcgttaaccccgttgtttaccggaccggtttacgggaccggggtacgtaaccggggtacccgttaccggg

SEQ ID NO: 197097 - DNA, 687 bp, Homo sapiens
  misc_feature: GYAE6OF01DZ7I0.39.81.H04.1.454.CMB.1.raw
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtcgcgacacggcccctggaacgaagggcttgaggtggagtggggatggatcgagcgtacttacaagttcggtaccaacaactaaaactgtacgaccaacgaacgtaaacccgtccgaaggggaccaaggaacgtaccaaacccgagttaccggaaacctacaagaaccaactacgtacccgaacgacgaccgtaaccggaccctaacgacgttacggaccgtagggaacggacgccgttacggaatacgtcgacggaaccggaaccgaccgggtccgttagttaacgttcgtaggtcgacggaggaacggtaggtaacggggttaaattgttttacggacggttaccggttaaccctttcgtttcggaaccgtttacgggtcggggtaacccgtaagggtaccccgttacggg

SEQ ID NO: 197098 - DNA, 714 bp, Homo sapiens
  misc_feature: GYAE6OF01AESQU.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtcctccgtgcgaaggtcctttcgtggttaacctacccttttaaccaactagtggtatcgtaggttgggtgcgacgcggccccgtggacgaagggtcttggagtggagtgggatggatcgagcgtacttacgagtcggtacaacaactaactatcgacacgaacgtaaccctcgacgggacacggtacgtaccaccgtagaccgaacccaacgacgaacctaccgacaccgaacggacgccgaaccggtacctacggacgttaccgggaccgtagggaacggtccgaccgtagggatacgtccgtaacgaacccggaccggtaccggtaccggttagtttacctaggttcggacgaacggtagggacgttaaaccgggttaacgggtaaagttttcggttacgtaacccggtttaccggttacccgtttacggttttacgaacccggttcggggtaaccggggacccgttaaccggggtacccgttcccggg

SEQ ID NO: 197099 - DNA, 732 bp, Homo sapiens
  misc_feature: GYAE6OF01B4JDQ.39.81.H04.1.454.CMB.1.raw
  modified_base (365)..(365): a, c, t, g, unknown or other
  misc_feature (365)..(365): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagcctggggcctcagtgaaggtctcctgcaaggcttcgtgttaccacctttaccaactatggtatcgtagttggtgcgacgacggcccctggacaagggtcttggagtggagtgggagtggatcgagcgtacttaacaagtcggtacaacaacaaaaccttanacgaccaacgaacggtaacccctaccggacgggaccacggtaaccgtaccaaccacgtacgaacccaacaacgaacccaacaccgtacccgacgtaacgaccgaacccggtaccctaacgacgttaccggaccgtaggaacggtacgtcccgtaaggacgtactacgtacgaaccgacgtacccgggtaccgtttaggttaacctttacgtacgggttacgacgggtaaaggaacggttaacggggttaacggggttaaaagttttacggttttacggaaccggtttccggtttaaccccgtttgtttaccggtaaaccgttcgggtaaccggggtcccgtaaccgggggttaacccgttacccggg

SEQ ID NO: 197100 - DNA, 674 bp, Homo sapiens
  misc_feature: GYAE6OF01CWZXC.39.81.H04.1.454.CMB.1.raw
  modified_base (261)..(261): a, c, t, g, unknown or other
  misc_feature (261)..(261): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgagcctggggcctcagtgaaggtctcctgcaaggcttcgtagttactaccttaccaacttntggtatcgtaggttggtgcgacgacggcccctaggaccgaagggcttggagtggagtggatggatcagcgtacttacgaagtggtacaacgaactaaactagtacgacaacgacgaacccgtcgaaggcacggacgtaccacctaagtaccgaccaacacgaccaacctaaccgtacccgaacgacgtacccgaaccggtacctaacgtacgtacggaccttagggaacggtacgacccgtagaacgtacgtacgtacgaaccgacgtaccgggtcgttagtacgtttacgtgacgacggtaaggacgtacgggttacgggtaaaattttcgttaggtaccggttccgttacccgtttacgttacgtaccgtaaccgggtcggggaaccgtaaccggggttacccgttccggg

SEQ ID NO: 197101 - DNA, 723 bp, Homo sapiens
  misc_feature: GYAE6OF01AC6RT.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtcgtcccactcccaggttcagctgtacagtctggagctgagatgacgagccgtggggcctcgagtagaaggtctccgtgcaaggtcttctcgtacctaccgttacaactatcggttatcctaggttgggtcgcgacgacggtcccgtaggacgaagggtccttaggagtggacgtggagtggatcgacggccgtacttaacgagttcggtacacaacgtaatatcggacctacaaacgacccgtaacgacggggaccgtaagacgttacccaaccgaacgttacgaaccctaaacgaacgaaccgaaccaacttaaccccgaacgaacggaccgacccgtaaccgttaactacgtacggaccgtacggaggaccgacgtacgaacgtagtaccgtacgaccgaaccgtaccggtaccgttacgttacgtttacacgggttcgacggaacggaggttaaccgaacggggttaaacgtttcgtttacggtacgtttccggttacccgtttagttaaccgttaccgttacggggacccgggtaaccggtacccggttacccggtaccccgg

SEQ ID NO: 197102 - DNA, 683 bp, Homo sapiens
  misc_feature: GYAE6OF01D8TR6.39.81.H04.1.454.CMB.1.raw
  modified_base (389)..(389): a, c, t, g, unknown or other
  misc_feature (389)..(389): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatcctttttcttgggtggcagcaacaacaggtgcccactcccaggttcagctggtacagtctggagctgagatgacgagccgtggggcctcgagtgaaggtctcctgcaaggtcttcgtggttacctacctttaccaactatggtatcgtagttgggtgcgacgacggcccctggacgaagggtcttggaggttggagtaggggataggatcgagcgtacttaagaagtgacaacaactaaactatgacaacgaacgaacccncgagggacaaggactaccaaccgtataccggaaccaacaacgacctaaccaacgtacccaaacggacgacccgaacccggtccctaacgacgtacggtaacctagggaacggacgtccgtaggacacgttcgacggaacgtacggaccggtacgttagttagttacgagttacggacgaaggtacggaggttaacggggtttaaatttaggttttacggaccggttttacgtaccctttaggttacgtaccggtaacgggtacccggggaccgtaccgggtaccccggttacgg

SEQ ID NO: 197103 - DNA, 733 bp, Homo sapiens
  misc_feature: GYAE6OF01CQ44Y.39.81.H04.1.454.CMB.1.raw
  modified_base (638)..(638): a, c, t, g, unknown or other
  misc_feature (638)..(638): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaaacaacaggtcgcccactcccaggttcagctggtacagtctggagctgagagtagaacgacgccgtcgggcctcgagtgaacggtctcgtgactaaggtcttacgtcgttactaccttaaccaagtagtcggtatacgtaggttggtcgacgacgaccggcccgtaggacgtaaggtctaggaggtggtagaggtacgtggactcgaggccgtactaacgagttacggtaccaactaaacaaacctgtaccgaaaccgaaccgaaaccggtaacccgtacccggaagggaccgaacggtaacgtaacccaaccgtaacgttaacccgaaccgaaaaccgaacgaaccgtaacctaaccgtacccgaacgaacgaacccggacccgtaaccgtaacgacggtacggacccgtaggaacgggtcctacgtaggaactacggtcgacggaaacccgacggaccggttaccgtagttaccgttcgagggtaccgngtaagggaggtaacgttaagggttaaacttgtacggaccgttcggtttacctaggtttcacccggttaggccggggaacctagggtaccctcggg

SEQ ID NO: 197104 - DNA, 736 bp, Homo sapiens
  misc_feature: GYAE6OF01DKGT9.39.81.H04.1.454.CMB.1.raw
  modified_base (623)..(623): a, c, t, g, unknown or other
  misc_feature (623)..(623): n is a, c, g, or t
tcagtcgcactagtcacgaccggtgctcgatttagtagtgtagattcgcggggtacccgaaaacacaccccgtccttgggagaactcccctagatcgacagctcctcaccgatggacttggacctggagtcacgttcctttttcgtgggtggaccagctaacaacgacggtcgcccacgtcccgaagggttccagccgttggtaactacgttcgtggactccgtagacgtagtacggaaccgacggtccgtggggcctaggagtaggaacgtcgtccgagacgtaaggttcttacgtagttacctaccttacaactagtggtatcgtaggttcggacgcgacgcggtcccaggacgtaggcgttaggagtggagtaggagtaggtactagcgtaccgtacttaacgagttacgaccaacaaactaacgtagacaacaaccggaacacccgtacgaagggtacctaagaccgtacgaaactcggtaacaaccgagtaacacactacgaccgacgacgactaccgacctagtacggacgaccgtagaacggtcgtagacgacgtacgtacgacggaccgtaaccgtccggtacgtttagtaccgttacggttacgcggaaccggnggtaacgggtacgtaaaggtaacgtttagttaccggtaacgttccggttacgtttaacgttaacggttaccggtacgggtacgggtaacccggtaccgggttaccgttaccgg

SEQ ID NO: 197105 - DNA, 771 bp, Homo sapiens
  misc_feature: GYAE6OF01CH4X6.39.81.H04.1.454.CMB.1.raw
  modified_base (258)..(258): a, c, t, g, unknown or other
  misc_feature (258)..(258): n is a, c, g, or t
  modified_base (280)..(280): a, c, t, g, unknown or other
  misc_feature (280)..(280): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgagccgtgggcctcagtgaaggtctcctgcaaggcttctggttacaccttaccaactntggtatcaggttgggtgcgacncggccctggacaagggcttggagtggagtgggatggatcgagcgtacttacaagtcggtacaacaactaaaactatcggactaacgaacgtaaacccgtccggaacgggacaacggacgtaccaaccaagtacggaaccctaacgaacgtaaccaactaactaccccgaacgacgacccgaacccggtaccctaaccgtaagtccgggaccctagggaacgggtaccgacccgttaggaagtaccgttaccggtacggaacccgaaccggaacccgggttaccggttacgttaacgtttaaccggttcgggtacggtacgggtaacgggtacgggtaacgggttaaacgggggttaaaattttacggttttaacgggaacccggttttaccgggttaaacccccgttttggtttaccgggtaaaccgtttaccgggggttacccggggggtaacccgttaaacccggggggtacccccgtttaacccgggg

SEQ ID NO: 197106 - DNA, 656 bp, Homo sapiens
  misc_feature: GYAE6OF01EOWEI.39.81.H04.1.454.CMB.1.raw
tcagtcgcactagtcacgaccggtgctcgatttagtagtgtagattcgcgggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggtcttctggttacacctttacaactatggtatcagttgggtgcgacaggcccctggacaagggcttgagtggagtgggatggatcgagcgctttacaatcggtacacacaaactatgacacagacctcagggcagactcacatcgaccacgacgacacactcccaacgacgacctacggaccctaacgacgttacggaacccgttagggaacggacgtccgtacggaagtacgttaccgagaccggaacgacccgggtaccggttagtttaacttaacccgtggtacggacggtagggtaacggtacgggttaaacggggtaaatttacggttttacgggtaaccttacgggttacccccttgtttaccgggaccgtttaaccggtcgggggtaccgtaaccgggggttaaccctaccgggg

SEQ ID NO: 197107 - DNA, 764 bp, Homo sapiens
  misc_feature: GYAE6OF01AM8C7.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtctctgcaggcttctggttactaccttaccaacttagtcggtatctaggttggtgccgacgacggtcccctaggacgagggtcttggacgtggagtggatggatcgagcgtacttaacagtggtaccaacgaactaactgcgaccaacgaacgaaccctaccggacgggacacggacgtacccaacgtacgtaccggaaccctaacgaacgtaccaacgtaccgtaccgaacggacgacccgtaaccggtacctaacgagtaccggaccgtagggacgtacgcccgtaggaacgtactacggtacggaacccggtaccggtaccggtaccggttagttaaccttcggtacggtaccggtacggaaggtaacgggttaaccgggtaacggggttaaaacgttttacgttttaccgggaaacccggttttcccgggtttaaacccccgtttccgggtttttaaaccggtaacccgggttaaccgggtttaccccgggggtaaacccggttaaccccgggggtaaccccgttttaccccgggg

SEQ ID NO: 197108 - DNA, 613 bp, Homo sapiens
  misc_feature: GYAE6OF01DYZTJ.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcaggttgggtgcgacacggcccctggacgaagggtcttggaggtggagtgggatggatcgagcgtcttacaatcggtacacaacaaactatgcacacgaacctcgagggcagacgtcaccatcgaccacagacacactccaacgacgccaccggacctaacgagtacggacctaggacggacgtcccgtaggacgtactccgtacgaaccggtaccgaccggtccgttagttacttacgtggtcgacgaagaggtacgtacggggtaaatttagtttacgacgtttcggtacccttacgtttaggtaccgttacggtccggggaccgtaacgggtaccccgttacggg

SEQ ID NO: 197109 - DNA, 689 bp, Homo sapiens
  misc_feature: GYAE6OF01EPBS0.39.81.H04.1.454.CMB.1.raw
  modified_base (318)..(318): a, c, t, g, unknown or other
  misc_feature (318)..(318): n is a, c, g, or t
  modified_base (336)..(336): a, c, t, g, unknown or other
  misc_feature (336)..(336): n is a, c, g, or t
  modified_base (355)..(355): a, c, t, g, unknown or other
  misc_feature (355)..(355): n is a, c, g, or t
tcagtcgcactagtcacgaccggtgctcgatttagtagtgtagattcgcgggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaacgtatggtatcgagttgggtgacgacacggcccctggacaagggtcttgaggtggatgggntggatcgagcgtcttaanagtgtacacaacaaactangacacagaacctcgagggcaagctcaccatcgaccaacacgacacactaccgaacgacgccgaacggaccctaacgacgttacggaccgttacggaacggtacgtccgtaggaactaacgtacgttacggaaccgtacccggaccgggaccggttacggtttacttaccggtggtacggtaacggaacgggaacggtaaacggttaaccggggtaaaatttacggttttaggttaaccggttccgggttacccgtttccgtttaccgggtaaccgtttaaccgggtacgggggttaacccgggtaaccggggttaaaccccggttttacccggg

SEQ ID NO: 197110 - DNA, 909 bp, Homo sapiens
  misc_feature: GYAE6OF01B2M9P.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcattcctttttcttggtggcagcaacaacaggtcgcccactcccaggttcagctggtacagtctggagctgagatgaacgacgccgtgggctcgaggtagaacggtcctcctgacgtaaggtctttcgtacggtttaacctacctttaaccaacttagtagtactcgtaggtttcgggtgacgacgaccggtcccgtaggaacgtaagggtcgttaggagggtaggtaggtagggtatacgggtaactacggacggtaccgttaccgtaacgttaacggtcggtaacccaaacgtaaacctaaacgtacgtacgaaccaaacgtaaacccgtaccgtaaccgggaggaaccgtaacggaaccgttaaccgaaaccgtacgtaaccggaaacccgaaaccgaacgaaccctaaccgtaaccgtaacccggaacgaacggtacccgtaaaccccggtacctaaccgttaacggaccgggtaaccggtacgggaacgggtaccgtacggaacgggtaacgtaccggtaaccgtaaccgggaaccggttaaccccgggtacgggtttaaccggttacgtttaaaccgtttaccgggtacgggttacggaacccgggaaaggtaacgggttaaaccggggtaaacgggtttaaacgttttcgggtttaaaccgggttaccccgggtttaaacggttttacccccgttagggtttttaaaccccgggaccggtttaacggggggttacccgggtaaacccgggttaacccgggtaaccccggtttaccggg

SEQ ID NO: 197111 - DNA, 837 bp, Homo sapiens
  misc_feature: GYAE6OF01EE7K3.39.81.H04.1.454.CMB.1.raw
  modified_base (487)..(487): a, c, t, g, unknown or other
  misc_feature (487)..(487): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacgaggtgcccactcccaggttcagctggtacagtctggagctgagatgacgaacgccgtggggcctcaggtgaaggtctccgtgacgagtcttcgtacggttacctacctttacaactagtggtatacgtaggttgggtcgcgaccgccggccccgtaggaacgaagggtcgttaggaggttagggtagtaggggtagttacgggatacggacggtccggttactttaaacggtaaggtttccggaaccgaacgtaaaacctaaccgtttagacggtaaccaaccgtaaccgaacccgttaccgaacgggtactaacggtacgtacctaaacccgngtaaccgaacccaaccgaacgaaccaaccgtacgtacccgaacgaccggtaacccgtaacccggtaacccgtaacgtaccggttaaccggacccggtaaaggggtaccggaaccgttcccggtaagaccggtttaacccgtacgggttaacggaacccgtaacccggggttaaccccggtacgggttttaccgttaaacggtttaacccggttggtaacgggaacgggtaacggtaaggggttaacggtaaccggggtttaaagtttcgttaaggtaccgtttaccggtaccgttttcgttaacggtaccgttaccgggtaccgggtacgtaacccgggtcgttacccgg

SEQ ID NO: 197112 - DNA, 691 bp, Homo sapiens
  misc_feature: GYAE6OF01D6ANM.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggtcttcgtgttaccaccttaccaactactggtatcaggttgggtgaccgtacgacggccccgtggaacgaagggcgttggaggtgggtacgtggggagtggagtcgagcgtcttaacgagtggtcaacaacaaactatcgacaacgacgaaacctccggaaggcaacggcgtaccaccgtagtccgaaccaacgacgtaaccactactcccgaacgacgtaccaccccgggtccttaacgactaccgggaccctagggacggtaacgtccgtaagacgtaactccgtacggaaccgaccgtaccgggtccgttagttaccgtttagtcggtacgcggtaaggaggtaccgggttaggttaaacgtttagttttccggaacgtttaccggttaccctttagtttacccggtaacgtttacccggcggggggtaaccctcgggtaccccggttaccggg

SEQ ID NO: 197113 - DNA, 697 bp, Homo sapiens
  misc_feature: GYAE6OF01DW1BY.39.81.H04.1.454.CMB.1.raw
  modified_base (289)..(289): a, c, t, g, unknown or other
  misc_feature (289)..(289): n is a, c, g, or t
  modified_base (327)..(327): a, c, t, g, unknown or other
  misc_feature (327)..(327): n is a, c, g, or t
  modified_base (579)..(579): a, c, t, g, unknown or other
  misc_feature (579)..(579): n is a, c, g, or t
tcagtcgcactagtcacgaccggtgctcgatttagtagtgtagattcgcgggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtgggcctcgagtgaggtctcgtgcagcttcgtgttactaccttaccactatggtatcgtagttggtgccgacgacggtcccnggacaagggtcttaggaggtggagtggggatggatcgnggcgtctaacgaagttcggtacaacgaacaaacgtatacgacaacgtaacgaaaccctcgaagggcaaggtacgaccacctagtaccgaaccacgaagaccaacgtactaccgaaccggacgcccggtaaacccggtacctaaccgtaggtacccggtaacctaggggtaacggaccgtcccggtaagtacggtaactccggacggtaccgaacgtaccggtcgttagttaacgttacgtgtcgtaaccggnggtacgacgggttaacgggtaaagtttcgtttacggtacgttccggttaacccttacggtttaccgaacgtttacggggtaccggggtcccgttaaacgggtacccggttacccgggg

SEQ ID NO: 197114 - DNA, 615 bp, Homo sapiens
  misc_feature: GYAE6OF01C43QJ.39.81.H04.1.454.CMB.1.raw
  modified_base (280)..(280): a, c, t, g, unknown or other
  misc_feature (280)..(280): n is a, c, g, or t
tcagtcgcactagtcacgaccggtgctcgatttagtagtgtagattcgcgggggacccaaaaaccacacccctccttgggagaatcccctagatcacagctcctcaccatggacctggacctggagcatccttttcttggtggcagcaacaacaggtgcccactcccaggttcagctggtacagtctggagctgagatgacgaagcctggggcctcagtgaaggtctcctgcaaggcttacgtggttactacctttaccaactatggtatcagttgggtncgatagccccgtaggacaaggctgagtggagtggatggactcgagcgtactacaatgggttcaactaacaaaactcgtagactaacgaacgtaaccctccgaggggacagagtcaaccagttacggaaccaacgagaaccactacgtaccaacgaacgctaaccggtcctaacgagtcggaactcggaagggacgacccgtgaagaagttccgagtaaccgaccgacggtaccgttagtattaacgtgtagaccgagacgtacgtacgggtaattacgttgacggtacgttaccctagttttcgaacgttacgagggacccagggtacccgtcgg

SEQ ID NO: 197115 - DNA, 646 bp, Homo sapiens
  misc_feature: GYAE6OF01AGRBZ.39.81.H04.1.454.CMB.1.raw
  modified_base (347)..(347): a, c, t, g, unknown or other
  misc_feature (347)..(347): n is a, c, g, or t
  modified_base (364)..(364): a, c, t, g, unknown or other
  misc_feature (364)..(364): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacacctttaccaactatggtatcagttgggtgcgacaggccctggacaagggcttgagtggagtgggatggatcgagcgcttaacatggtacactacaaactntcgacacgacgtaaccnccgagggacacggacgtacaacccgtatacgacccaacacggtaaccaccactacccgaacggaccgacctaaccgggacccttaacgaacgttacgggaacccttagggaacggacgtaccggttagaagtacttaccgacggaaccgtaccgacggtccgtacgttaattaccgtgtacggacggagaggtacggtacgggtaaattcggtttagacggttacgttaccctttgttaacgtaccgtaacggtggggaaccgtacgggtaacccgtacggg

SEQ ID NO: 197116 - DNA, 589 bp, Homo sapiens
  misc_feature: GYAE6OF01BNIH2.39.81.H04.1.454.CMB.1.raw
  modified_base (274)..(274): a, c, t, g, unknown or other
  misc_feature (274)..(274): n is a, c, g, or t
  modified_base (414)..(414): a, c, t, g, unknown or other
  misc_feature (414)..(414): n is a, c, g, or t
  modified_base (496)..(496): a, c, t, g, unknown or other
  misc_feature (496)..(496): n is a, c, g, or t
tcagtcgcactagtcacgaccggtgctcgatttagtagtgtagattcgcggggatccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtncgacaggccctggacaagggcttggagtggagtgggatggatcagcgtcttacagtggtacacacaaactatgacacaacgaaccctcgacgggacaagacgtaccacagtcgaaacccacacgacacactcccgaacgngacccgacgacctacagtcggactggagacgccgtgagactcgtcgaaccgacgacgggtacgttcggttaacttcgtacgnggacgaagacgtaggttacggggtaaattggtttacggacgttaccggttacccttgtttacgacttacggtcgggccgtaacgggtaccccg

SEQ ID NO: 197117 - DNA, 1054 bp, Homo sapiens
  misc_feature: GYAE6OF01AF02O.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttctggtggcagcaacaacaggtcgcccactcccaggttcagctggtacagtctggagctgagatgacgaacgccgtggggcctcgagtggaacggtctccgtgacgaaggtcctttcgtcggttaacctacccgtttaacaacttagtggttactcgtaggttcgggtcgccgacgacggtccccgtaggaccgtagggttcgttaggacggtgggtacggtacggggtaagtcggtaacgtaccggtacgggtaccgtaaccgttttaaacggtaacggttttaccgggaacctaaaccccgtaaaccgttaaaaccgttaggttaccggaaaccgtaaaccccggtaaaccggtaaaccccccggttacccggggaacgggggtaaccccgtaaacgggttacccgttaaaccccgtaaaccccggtaacgttaaacccccggtaaaccccgaaaccgggtaaacccggaaaccccctaaacggttaaccccgttaaccccccccgggaaaacggggttaaccccggaaccccccgggttaaaccccggggttaacccccttaaaaccggtccggggtttaaaccccggggaacccgtttacgggggaaaaccggtccccgtttaacggaccgggttaaacgtttaaccgtacccgggtaaccgggaaacccggtaccgggtttacccggggacccgttttaacgttaacgtttaccgggttcggacgggaaccgtaacggggttaacggttaaccggggtttaaacggtttaagttttttaccgggtttaccgggaaacggtttttcccccggtttaacccgttttaccgggttaaccgggttaaaccccggtttacggggggtaaccccggggtttaacccccgggtaaccggggtttccccggttttaaaccccggg

SEQ ID NO: 197118 - DNA, 684 bp, Homo sapiens
  misc_feature: GYAE6OF01DFRRY.39.81.H04.1.454.CMB.1.raw
tcagtcgcactagtcacgaccggtgctcgatttagtagtgtagattcgcggggacccaaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtggggcctcagtgaaggtctcctgcaaggtcttcgtggttacctacctttaccaactatggtatcgtaggttgggtgcgacgacggcccctaggacgaagggtcttaggaggtggagtagggagtggatcgagcgtactacgaagtggtacaacgaaactaaactatacgacaacgaacgtaaaccctcggaacggggacaaggacgtaccaccgtaagtacggaacccaacgaacgaaccaactaacctacccgaacggacgacccgaccggtacctaacgagtccggaccgtgggacggtagcccgtaggaacgtacgtacgtacggaaccgtaaccggaccgggtaccgttagttacttacgtggtacggcgtaaaggacgtacggttaacgggtaaatttacgtttaggaccgtttcggtaccctttgttacgtacctaacgggtccgggaaccgtacgggtccgttaccgg

SEQ ID NO: 197119 - DNA, 704 bp, Homo sapiens
  misc_feature: GYAE6OF01B0ZDZ.39.81.H04.1.454.CMB.1.raw
  modified_base (278)..(278): a, c, t, g, unknown or other
  misc_feature (278)..(278): n is a, c, g, or t
  modified_base (331)..(331): a, c, t, g, unknown or other
  misc_feature (331)..(331): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgaacgagccgtgggcctgagtgaaggtctctgcaggtcttcgtgttacctaccttacgaactatggtatcgtaggttgggngcgacgacggtccccgtaggacgaagggtcttaggaggtggagtgggatggancgagcgtatacagtgacacaacgtaaatgtcgaccacgaacgtacccacgagggacagtaacgctaaccgagtaccaaccacgacgaaccacaccgtaccgacggacgacccgacccggactaaccgtagtaccggtaccgtaggaacggcgacgtaggtacgaacttcggaacggtacgaaccggtaccgggtaccgtttagttacgtttacgtcggtacggaacgtaacgggaaggttaacccgggttaaaggggttaattttacgggttaacgttaacccgggtttacccgttacgttttacccgttacggttaaaccggtaccgggtttaaccccgggggccgttaaacccggggttcccggtaaccgg

SEQ ID NO: 197120 - DNA, 685 bp, Homo sapiens
  misc_feature: GYAE6OF01BQZVN.39.81.H04.1.454.CMB.1.raw
tcagtcgcactagtcacgaccggtgctcgatttagtagtgtagattcgcggggacccaaaaaaccacacccctccttgggagaatcccctagatcacagctcctcaccatggactggacctggagcattccttttcttggtggcagcaacaacaggtcgcccactcccaggttcagctggtacagtcgtggagctgagatgacgaagccgtggggcctcagtgaacggtctccgtgcacgtctttcgtacggttacctacctttaaccaactagttggtacttcgtaggttggtacgacgacgtaccggcccgtagggacgtaaggtcgttaggaggtggtaggtgggatggactcgacgtccgtactaacgagttcgaacaacgtaacaacgtatacgacaacgaacgaaccgtccgaacggacgaacgtacgtaccaacgaacgtccgaaacctacgaacgaactacctaccgaacccgagacccgtaaccgacgtacctagtaaccgcggtaacgagggacgacgtacgtagacgtacgaccgtacggaacgtacccggacggtacgttattacgtacgtgagacgaagtaggtacgtaaggttacgtttgtaccgttaacgttccgttacccttacgtacgtacccggttcggaaccgggtacccgtaccggttggtcccg

SEQ ID NO: 197121 - DNA, 929 bp, Homo sapiens
  misc_feature: GYAE6OF01CMKVI.39.81.H04.1.454.CMB.1.raw
tcagtcgcactagtcacgaccggtgctcgatttagtagtgtagattcgcggggcacccaaaaaccacacccctccttgggagaatcccctagatcacagctcctcaccatggactggacctggaggatcctcttcttggtggcagcagccacgaggacgcccactcccgaggtcgcagctgggtgcgacgggtccgggacgtggaggtaggaaagaacggccggtggggcctcgaggtggtaacggttctccgtaggacgtaaggtcttcgtacgggtaactaccgtacccctacgaacccgggtacgttacttaacgtacgtacggtccgtaacggttcgggttacggaccgacggaccggtccccggttaggaaccggtaagggtcgttagggacggtgggtacggtagggacgttacgggtaacgtaaccggtaaacgggtaacggtacgggttacggtacctaaaccgtaaagttaaaagttacgtaccggtaacgtaacggttaaaggtttaacggtacgggtaacggggtaacggtaacggggtaactacccggtaaaggtaccgggaaaccgggtaacgggtaacctaaccggtactaaacgtaaccgaaaccgttacggaaccgttaaccgtaaggtaacggtacgggtaaccgtacgggacgttacggaacggtacgtaaggtacgtacgtacggaaccggtaacggaccggtaccggggttactttaacgggttaactttacggggacggttaacggggtaactaaacgggtacgggtttacgtaaaccgggtttaccgtttaaccgtacgttttaaacgggttaccgggttttaagggggttccgggggtttaaagggttttaaccttaaaacggggtttccggttacccggggggttaacccgggtaaccccggggg

SEQ ID NO: 197122 - DNA, 725 bp, Homo sapiens
  misc_feature: GYAE6OF01A7FLA.39.81.H04.1.454.CMB.1.raw
  modified_base (274)..(274): a, c, t, g, unknown or other
  misc_feature (274)..(274): n is a, c, g, or t
tcagtcgcactagtcacgaccggtgctcgatttagtagtgtagattcgcgggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtncgacacggcccctggacaagggcttggagtggatggggatgggatcgagcgacttaacaagtcggtacaactaacgtaaaactatacggaccaacgaacgtaaacccgtccgaaggggccaaggacgtacccaacccgaacgttacggaaacccacgaacggaaccaaccgtacttacccgaaccggaacgacccgaacccgggtacccttaacgaacgtacggaacccgtagggaacggacgcccgttaaggagtacttaccgtacggaaccggaaccgaccgggttacccggttaggtttaacgtttaccggttgtaccggaccggtaaggaaggtaacggttaaccgggggtaaatttacggttttacgaacggttccgggttaaccccttacgtttacgtaccgttacggttaccggggacccgtaacggggtaccccgttaccggg

SEQ ID NO: 197123 - DNA, 754 bp, Homo sapiens
  misc_feature: GYAE6OF01DBLFP.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaacgccgtggggcctcgagtgaaggtctcctgcgaaggtcttctggttacctacctttaccaactatggtatcgtaggttggtgcgacgacggtccccgtaggacgaagggtcttaggaggtggagtgggattggatcgacgcgtacttaacgaagttcggtaccaactaactaaaactatacgactaacgaaccggaaccctacccgagggtaccaacggtaccgtacgaaccctagtaccgaaaccaacgaacgaaccaacctaaccgaccgaaccggacgaccgtaaacccgggtacctaacgaacggttacggaacccgttagggaacggtacgtaccgtacggaacgtacttacgaacgggaaccgaccggtacccgggtacccgttaaggttaaccgtttaccggtaggttacgaacggtaaggtaacggtaacgggttaaacggggttaaatttacggtttacggaccgttacggtttaccccgttgtttaaccgtaccggttacgggacggggttaaccctaaccgggggtacccgtttaccggg

SEQ ID NO: 197124 - DNA, 696 bp, Homo sapiens
  misc_feature: GYAE6OF01CLPR2.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaaacaacaggtcgcccactcccaggttcagctgtacagtctggagctgagatggacgagccgtggggcctacgagtgaaggtctcctgacaggtcttacgtggttactacctttacaactagtggtatcgtaggtggtgcgacgacggcccgtggaacgaggtcttggaggtggagtagggatggactcgaggtcgtcttaacgaagttcggtaaccaacgtaaagtaacctatacgacaacgtaacgaacccgtcggaaggccaagtactccgaactaacgtcggaacctacgaacgaccacgtaaccgaccgaaccgaggacctaccggaacctaagtacgtacggacctaagggacggtacgtaccgtaggaacgacgtacgtacggaaccgtaccggaccggtaccggttagttaccttagttacggacgtacgaaggagtaaaccgggtaggttaaacgtttcgtttcggtacgttaccgggttaccctttcgttaacgtaccgtacgggttaccgggtaaccggtacgggtaacccgttccggg

SEQ ID NO: 197125 - DNA, 721 bp, Homo sapiens
  misc_feature: GYAE6OF01CWUV4.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagcctggggcctcgagtgaaggtctcctgcaaggtcttcgtggttactacctttaccaaacttagtggtatcgtaggttggtgacgacgacggtccccgtggacgaaggcttggagtggagtggatggatcgagcgtctaacgaagttcggacaacgaactaaactgtacgactaacgaacgtaacccgtccgaaggacgtaaggacgtaccaacgaacgtacgaacccaacaacggaacctaacaacgtacccgaacggacgaccgaacccggtacctaacgacgtacggtacccgtaggaaccgggacgtaccaggtaacgtactacgtacggaacggtaaccgtacccgggtacttacggttaacttaggtcggtacgacgggaaagttacggaaagggttaacgggtaaacttacggttttaacggaccgttttaccggttaccctttaggtttacgtaacccggtttaccgggtaggggtaacccccggtaaccggggtacccgttaacccggg

SEQ ID NO: 197126 - DNA, 657 bp, Homo sapiens
  misc_feature: GYAE6OF01BWCWX.39.81.H04.1.454.CMB.1.raw
tcagtcgcactagtcacgaccggtgctcgatttagtagtgtagattcgcgggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctgttacacctttacactatgtatcgagttggtgcgtacgacggccctaggacgaagggtcttgagtggatgggatggatcgagcgtactacgatggtacacaacaaactgtacgacaacgacgaccctcgaggcagacgtccacatacgaccacgacgacacactaccgaagacgacgaacccggacctaacgacggttaccgaacccgttggaacgggaccgtacccgagacgtacgttccgtagggaacccgaaccggtcccggggtacgtttacggttaacttacggtggtacggacggaacggtaaggtacgggttaaacgggttaatttacggtttacggacggttaccggttacctttcgttacggtaaccttacgggtaccggggaccgtaaaccgggtcccgtaccggg

SEQ ID NO: 197127 - DNA, 778 bp, Homo sapiens
  misc_feature: GYAE6OF01DN6FR.39.81.H04.1.454.CMB.1.raw
tcagtcgcactagtcacgaccggtgctcgatttagtagtgtagattcgcgggggacccaaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtggggcctcgagtgaaggtctcctgcaaggtcttctggttacctacctttacaactagtggtatcgtagttgggtgcgacacggccctaggacagggtctgagtggagtgggatggatcgagtcgtcttacgaagttcggtaccaacgaactaaactagtcgaccaacgaacgtaaccctaccgagggacaggacgtacaccgtagtaccgaaaccacgaacgacaccgtaacgtacccgaacggacaccgaacccgggtaccctaagtaccgtaacgggtacccgtagggaaccggaaccggttccgtaaggtacgaaccgtttccggaacgggaccccgaaaccggtaacccgggttccggtttaacgttaaccggttttaccggtcgggttacgggaccgggtaaacggtaagggtaaaccgggtttaaacggggttaaaacttttacgggttttaccggtaaaccgttttcccggggttaaaccccttttggtttaaccgggtaacccggtttaccggggtacccgggggaacccgggttaacccgggtacccggttaccccggg

SEQ ID NO: 197128 - DNA, 665 bp, Homo sapiens
  misc_feature: GYAE6OF01CKU6J.39.81.H04.1.454.CMB.1.raw
  modified_base (370)..(370): a, c, t, g, unknown or other
  misc_feature (370)..(370): n is a, c, g, or t
tcagtcgcactagtcacgaccggtgctcgatttagtagtgtagattcgcgggggacccaaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtggggcctcgagtgaaggtctccgtgacaaggtcttcgtaggttactacctttaccaaactgtaggtatcgtaggttggcgcgacgacggccctaggaacgagggtcttggagtggagtgggatggatcgagtcgtacttacagtcgtacactaacaaatntagcaacgacgaccgtcgaggtcaagtcgtaccacgtatcgaaccacgaacgaacacgaacctaccgaacggagacccggaacggtaccctaagtacggtacggtaccgtagggaacgggtacgtacccgtaggaacgtacgtacgtaccgaaccgaaccggtaccggtacgttagttaacgttcggtggtacgacgaaggtacggtagttaaggggtaacttggttttacgacggttcgttacccttaggttaccgtacgttacgggaccgggtacgtacgggtaacccgtcgg

SEQ ID NO: 197129 - DNA, 747 bp, Homo sapiens
  misc_feature: GYAE6OF01BYQKU.39.81.H04.1.454.CMB.1.raw
tcagtcgcactagtcacgaccggtgctcgatttagtagtgtagattcgcgggggacccaaaaaccacacccctccttgggagaatcccctagatcacagctcctcaccatggactggacctggagcatcctttctggtggcagcaacaacaggtgcccactcccaggttcagctggtacagtctggagctgagatgacgaagcctggggcctcagtgaaggtctcctgcaaggcttctggttactacctttacaactatggtatcagttgggtgcgacgaggcccctggacaagggtctgagtgagtgggatggatcgagcgtcttaacaagttggtaccaacgaacaaaacttatcgacaaccgaacgaaccctccgaagggacaaggacgtccaacctatacgaacccaacgacgaaccaaccactacccgaacggacgaccgaaccgggtaccctaacgtaacggtacgggaacccgttaggaacgggtaccgcccgttaggaacgtacttaccgtacggaacccgtaacggaccgggtacccgttagttaacgtttaacgtgggtacggtacggaaggtaaggtaaccgggttaacgggggttaaaacttttacgggtttttacggaacccggttttccgggtttaacccccgttttacggttttaaccgggttaacccgtttacggggttaacccggggggaccccgttaaacccgggggtaaaccccggtttaccccgggg

SEQ ID NO: 197130 - DNA, 594 bp, Homo sapiens
  misc_feature: GYAE6OF01BDUOE.39.81.H04.1.454.CMB.1.raw
tcagtcgcactagtcacgaccggtgctcgatttagtagtgtagattcgcggggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacacctacttgaattggtttcagtcagaggccaggccaatctccaaggccgacctaatttagtaacggtttctaaccgggactcgtgggtaccccagacagtaattcagcggcaggtgggtacaggcacgtgaacttcacactagaaactcaagcgagggtggaggcgtaggaggtatgggtttagggtttatacgtgactagtcgacaaagggaaccaacgtacgtcggtcccttaccgtactacggtttacggaccgtacggggaaccacggtacgtagggaacgtaagtaaccggaaacggaacgttgggtacggacttacggaccctaccgagttccgttacg

SEQ ID NO: 197131 - DNA, 693 bp, Homo sapiens
  misc_feature: GYAE6OF01DRYCA.39.81.H04.1.454.CMB.1.raw
  modified_base (349)..(349): a, c, t, g, unknown or other
  misc_feature (349)..(349): n is a, c, g, or t
tcagtcgcactagtcacgaccggtgctcgatttagtagtgtagattcgcggggacccaaaaaccacacccctccttgggagaatcccctaagatcacagctcctcaccatggactggacctggagcatccttttcttggtggcagcaacaacaggtgcccactcccaggttcagctggtacagtctggagctgagatgacgaagcctggggcctcagtgaaggtctctgcaaggcttctggttacacctttaccaactatggtaatcgagttgggtgcgacacggcccctggacaagggtcttgagtggaagtgggatcggatcgagcgtcttaacaagtcggtacaanaaccgaaactagtacgacaacgaacgtaaaccctccgaaggggacaggtaacggttacaaccctaatacggaaccaacgaacgacaacaacgtaccaacgagaccgaaccgtcctaaccagtacgacctaggacgacgccgtagacgatccgtaggaccgaaccgtacggtacccgttagttaacgttaccgtaggtccgaacggtaaggtacggaacgtttaaccggggtaaaagtttaccgttttaaggacggttttcccgggttaacccccttttcgtttacggtaacccgtttaacgggtcccggggtaccggtaacccgggtaaccccggttacccggg

SEQ ID NO: 197132 - DNA, 798 bp, Homo sapiens
  misc_feature: GYAE6OF01BJDR6.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtcctctgcaaggtcttcgtcggttacacctttaccaactatggtatcgtaggttgggtgccgacgacggtcccctaggaacgaaggggtcttaggaggttgggagtggggaatgggtaactcgaaggtcgtaccgttaacaagttcgggtaccaaaccgaaactaaaacgttacgtcgacctaacgtaacggaaaccccgtccggaaggggaccaaggtacgtaccaaccatacgaacccacgaacgaccaactacgtacccgacgaacgtaccgaccggtacctaacgtacgtaccggtaacccgtagggacgggaccgtacgtacggaacgtaccttacggtacggaaacccggtaaccggtaaccccgggggtacccggtttaacggtttaacgttttaacccggtagggttacccggaccggggtaaaggtaacggggttaagggttaaaccgggggttaaattttacgggttttaaggtacccggttttacgggttaccccctttaggttacccgtaccgtttaccggggtacccggggtacccggtaaaccgggtccccggttaccggg

SEQ ID NO: 197133 - DNA, 818 bp, Homo sapiens
  misc_feature: GYAE6OF01CL8U1.39.81.H04.1.454.CMB.1.raw
  modified_base (124)..(124): a, c, t, g, unknown or other
  misc_feature (124)..(124): n is a, c, g, or t
tcagtcgcactagtcacgaccggtgctcgatttagtagtgtagattcgcggggacccaaaaaccacacccctccttgggagaatcccctagatcacagctcctcaccatggactggacctggancatcctttctggtggcagcaacacaggtcgcccactcccaggttcagctggtacagtctggagtctgagatgacgaagccgtgggcctcgagtgaacggtcctccgtgcgaacggtcctttcgtcggtttaacctaccgttttaaccaacgttagttaggtaactcgtaaggttcggggtacgcgaaccgtacggtacccccgtagggaacgtaacggggtctttaggacggtaggaggtagggtaactgggaactcgacggtcgtacgttaacgtaagttaccggtacaaaccgttaacctaaacgtacgttaccggacctaaaccgtaaaccggtaaaccccttaccggaacgggtaccgtaaacggtacccgtacgtaaacccaagttacccggaacccaacgtaacgaacccgaaccgtaacgtacccgaacgtaccgaaccgtacccggtaccctaacgacggtacggtaccgtacggtaacggaccgtaccgtagaccgtacgtaccgacggtaaccgaccggtaaccggttacccgtaaggtttaccgtacgttacggtaggaccggtaggtaacggtaagggttaacggtttaaacgttcggtttacggtaccggtttaccgttacccgttagtttaacccggtacgttacgggtaccgggaaccgtaccgggtccccgttacggg

SEQ ID NO: 197134 - DNA, 704 bp, Homo sapiens
  misc_feature: GYAE6OF01CH2CW.39.81.H04.1.454.CMB.1.raw
  modified_base (223)..(223): a, c, t, g, unknown or other
  misc_feature (223)..(223): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttctggtggcagcaacaacaggtgcccactcccaggttcagctggtacagtctggagctgagatgacgaagccgtgggcctcagtgaggtcncctgcaaggcttctggtactaccctttacactgtggtatcgagttggtcgcgacacggccctggacaagggtcttggacgtggagtggggatcggatccgaggtaccgtacttacaaagttcggtacaacgtaaccgtaaactagtaccgacacgtaacggtaacccgtcgacgggactaagacggtaacacccagtaccgaacctaacgacggaccctaacgactaaccccgaggaaccgtccgtaacccgaccgtaactacgggtacggtaacccgtgggaaacggtcccgtacggaacgtagtacgttaaccggtacgaacccgtaaccggacgggtaccgttacgttaacgttccgttaaggccggaacgtagggaactacgggggttaacgtaaagttttcggtttagacccggttttccgaacgtttcttaacgggccttacgggtcggggacccggttaacggacccgttacgg

SEQ ID NO: 197135 - DNA, 684 bp, Homo sapiens
  misc_feature: GYAE6OF01AX7YG.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacacggccctggacaagggcttgagtggatgggatggatcgagcgtcttacaagtggtacaacaacaaactatgacacaacgaaccctccgagggcagacgtacaccgatacgaccaacacgacacactaccaacgacgaccacggcctaacagtacggacctgggaacggacgtccctaggaacgtactaccgtacggaaccggtaaccggacccgggtaccggtttacgttaactttaacggtcggtacggacggaaggaaggtaacggttaacggggttaaaagtttacgtttttacggaaccggtttacccgggtttaacccctttaggtttttaccggaacccggtttaccgggttaccggggggtaacccgttaaacccgggggtaaccccgttaccgggg

SEQ ID NO: 197136 - DNA, 644 bp, Homo sapiens
  misc_feature: GYAE6OF01EI9ML.39.81.H04.1.454.CMB.1.raw
  modified_base (350)..(350): a, c, t, g, unknown or other
  misc_feature (350)..(350): n is a, c, g, or t
  modified_base (392)..(392): a, c, t, g, unknown or other
  misc_feature (392)..(392): n is a, c, g, or t
  modified_base (411)..(411): a, c, t, g, unknown or other
  misc_feature (411)..(411): n is a, c, g, or t
tcagtcgcactagtcacgaccggtgctcgatttagtagtgtagattcgcgggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctctgcaaggcttctggttacacctttaccaactatggtatcagttgggtgcgacgaggcccctggacaagggcttgagtggatggggatggatcgagcgcttacaagtgtcacaacaaactagngacacacgaacctccgagggcaagacgtcgaccatcgaccanacgacacactcccacgacnccgaacggcctaacgagtacggacccgtggaacggacgtccgtaggacgtaactccgtaaggaccggaaccgaccgggtacccgttaggttaactttacggtcggtaggaccgggagtaacgggtagtaaccgggggttaaatttaggttttacgtaaccggttcgggttaaccccttgtttaacggaccgtttacgggtccgggggaacctacgggggtaccccttacgggg

SEQ ID NO: 197137 - DNA, 731 bp, Homo sapiens
  misc_feature: GYAE6OF01EMPLB.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcattcctttttcttggtggcagcaacaacaggtgcccactcccaggttcagctggtacagtctggagctgagatgacgaagccgtgggcctcagtgaaggtctctgcaggtcttcgtcggttactaccttacaactatggtatcgtaggttgggtgcgacgacggccccgtaggacgaagggtcttggaggtggagtggggatagggatcgagcgtacttaacaagttgtacaacaaactaaacgtatcgacaccgaacgtaacccgtccggagggaccgaagtacgacctaaaccgataccgtaaacccaacgaacgtaaccacctacgtacccgaagtaccgaccggtaccccggaacctacgtagtacggtaacccgtaggaacggtacgtccgtagaacggttaactcgtaacggaacccgtaccggaccgggtccgttagttaacgtttacggtggtacggaccggtaagggaaacgggtaggttaaaccgggttaaagttttcgtttaccgggaaaccggtttcccggttaaccgtttacgtttaacggtaccggttaaccggggtacggtaacccggtacccgggttaaccccggttcgg

SEQ ID NO: 197138 - DNA, 742 bp, Homo sapiens
  misc_feature: GYAE6OF01EL7R3.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtgggcctcgagtgaaggtctcctgacaaggcttctggttaccacctttaccaattatggtactcgtaggttgggtcgcgaccgacggtccccgtggaacgtaaggggcctttaggaggtggtagtggggatgggatcgacgtaccgtcttaagaacgtggacctaacgaactaaactagtcgacaacacgacctacgaggcaagacaccgacacgtacgaacctacgaacgaccaacgactacccgaacggtagacccgacccgtacccgtaacgaacgtccggtaacccgtagggaaccgacggtacccgtagacgtacttaccgaccggaacgtaccgggtaacccggtcgttacggtttaacggttaacgttcgggacggttaacgggaaggtacgggtaacgggttaaaccgggttaaaggttttacgttttacgtacccggttcccgggtttaaacccttcgggtttaacccgtacgggtttaaccggtccggggggtaaccccgaaaggggttcccccgttaaaccgggg

SEQ ID NO: 197139 - DNA, 694 bp, Homo sapiens
  misc_feature: GYAE6OF01A48Z6.39.81.H04.1.454.CMB.1.raw
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttcgtggttacctacctttaccaactatggtatcaggttggtgcgacacggcccctggacaagggcttgagtggagtgggatggatcgagcgtacttacaagtggtacaacgaactaaactagtcgtacaacaacgtaaccctaccgagggccaagtacgtaccaaccgtaatacggtaacccacgaacgaaccacaactacccgaacgtacgaccgaaccggccctaacgacgttaccggaccgttaggaacgggacgccgtaggacggattacgtacggaaccgaacgccgggtaccgttcggttaacttcggtaggtcgacggtacgaagggtacgtaacggggttaaagtttacgttttagggtacgttccgggtttaccctttacggtttaacggtaccgtttacgggtacccgggggtaacccgtaaccgggggtaacccccgttaccgggg

SEQ ID NO: 197140 - DNA, 682 bp, Homo sapiens
  misc_feature: GYAE6OF01AQ6CO.39.81.H04.1.454.CMB.1.raw
  modified_base (518)..(518): a, c, t, g, unknown or other
  misc_feature (518)..(518): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcattcctttttcttggtggcagcaaacaacgaggtgcccactcccaggttcagctggtacagtctggagctgagatgacgaagcctgggcctcgagtgaaggtctcgtgacaaggtcttcgtacggttaacctacctttaaccaacttagttaggtactcgtaggttgggtacgacgacgaccggtcccgtaggaacgaggtcgttaggagtaggagtgggatggatcgagtcgacttacgaagtgtacaacaacgtaaactagacgtacaacgtaacgtacccgtacgacggtacaaggtactacacgagtacgaccaacgtacgaactaacgactacgaccggagtaccgaaccgttacaacgtagaccgtacgaggtacgagtcgtaagngtactcgaacgtacgaacgtcggtaccgttagtaccttgtaggtacaggaacgtacggtaggttaaacgggtttaatttacgttacggttaacgttcccgtttaacccgttagtttaacgaacggttaccgggtaaggggaccctaaacgggtacccgttacgg

SEQ ID NO: 197141 - DNA, 697 bp, Homo sapiens
  misc_feature: GYAE6OF01D3NPX.39.81.H04.1.454.CMB.1.raw
  modified_base (184)..(184): a, c, t, g, unknown or other
  misc_feature (184)..(184): n is a, c, g, or t
  modified_base (202)..(202): a, c, t, g, unknown or other
  misc_feature (202)..(202): n is a, c, g, or t
  modified_base (208)..(208): a, c, t, g, unknown or other
  misc_feature (208)..(208): n is a, c, g, or t
  modified_base (217)..(217): a, c, t, g, unknown or other
  misc_feature (217)..(217): n is a, c, g, or t
  modified_base (311)..(311): a, c, t, g, unknown or other
  misc_feature (311)..(311): n is a, c, g, or t
tcagtcgcactagtcacgaccggtgctcgatttagtagtgtagattcgcggggcccctagatcacagctcctcaccatggactggacctggagcatccttttcttggtggcagcaaacaacaggtgcccactcccaggttcagctggtacagtctggagctgagatgacgaagccgtgggcctnagtgagtctctgcagctntgtacncttacaatntgtatcgaggttggtgcgacacggcccgtaggacgaagggcttgagttggagtgggtatggatcgagcgtacttacaagtggtacacaacaatntacacacaacgaacctacgagggcaacggtagactaccaagtcggaaccactaacggaccaactacgtacccaacggacgaccaaccggtcctaacgacgtacggaacccgtggaaacgggcgcccggtagaacgtcgtacgtacgacccgggaagcccgggttccgtagttaacgttacgtggtacggacggtaaggacgggtaaacggttacggggttaaaatttcggttttaaggaccgtttcccggtttaacccttcggtttaaggtaccccgtttaacggggtcgggtaaccccggttaaaacggggtaccccttagggttaacccttaccccgggttaaccttacccgtcccgggtaaccgtcccccgttaaaccccggg

SEQ ID NO: 197142 - DNA, 721 bp, Homo sapiens
  misc_feature: GYAE6OF01B4JA7.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaacgccgtggggcctcaggtgaaggtctcctgcaaggtcttcgtggttacctacctttaccaattagtggtatctaggttgggcgacgacgacggccctaggacgaagggtcttggaggtggagtggagtggactacgaggtcgtacttaacgaagtcggtaccaacaacctaaactactacgactaaccgaacggtaaacccgtccggtaagggaccgaacggtaacgtacccaaccgaataccggaaccaacgaacgaaccaacctacgtacccgaacggaacgaccgtacccggtaccgtaacgacgtacgggaccgtaggaacggtcgtaccgtagagtacgtacgacggaaccgaccggaccggtcggttacgttaacttacgtcggtacgaggacggtacggaacgggtaacgggttaaacttttcggttacggtaccggtttccggtttaacccgttcgttacggtaaccgttacggggtaccgggaccggtaaccggggtaacccgttccggg

SEQ ID NO: 197143 - DNA, 771 bp, Homo sapiens
  misc_feature: GYAE6OF01EELCS.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcattcctttttcttggtggcagcaacaacgaggtgcccactcccaggttcagctggtacagtctggagctgagatgacgagccgtggggcctcgagtgaggtctcgtgacgaggtcttcgtcgttacctacctttacaacttgtggtatcgaggttggtcgcgacgacggcccgtaggaacgagggtctggaggtggagtgggagtggatcgaggtccgtacgttaacgaagttcgggtaaccaacgtaaaccgtaaacgttacgtacgaaccgaacgtaaaccgtaacccgtaccggaaggggtacctaaacgggaccttaaccgaaacccgtaaacgttaccggaaaccccaaaccggaacgtaacccaaccgtaaccgtacccggaacggaccggaacccgtaaccccggtaccgtaacgaacggtaccggaacgtacgggaacggacgtcccggtaagacgtaccgtcgtaacgaaccggtaccgacggttccggttaagttaccgttacgttggacggacgtaaggacggttaacggtaaacgggttaacttttcggttacggttacccgtttacgggtaccctttacggtacgttaacccgttacggggaccgggtaccggttaacgggcccgttaccggg

SEQ ID NO: 197144 - DNA, 624 bp, Homo sapiens
  misc_feature: GYAE6OF01C6HQK.39.81.H04.1.454.CMB.1.raw
  modified_base (228)..(228): a, c, t, g, unknown or other
  misc_feature (228)..(228): n is a, c, g, or t
  modified_base (331)..(331): a, c, t, g, unknown or other
  misc_feature (331)..(331): n is a, c, g, or t
  modified_base (437)..(437): a, c, t, g, unknown or other
  misc_feature (437)..(437): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacagtgcccactcccaggttcagctggtacagtctggagctgagatgacgaagccgtggggcctcagtgaaggtctccngcaaggtcttctggttaccactttaccaactatggtatcgagttgggtgcgacacggccctggacaggcttggagtggagtgggagtggatcgagcgacttanaagtggtacaaccacaaactatgacacgaacgaaccctcgaagggcaggtacacaccgatacgaccaacacgacacacgtacccacgacgaccgacgacctaacgngtaccggacctagggaacggacgtccgtaggagtactcgtacgacgacgaccggtcgttagttacgttacgtggtcgacggaagtacggtaggtaacgggttaaagttacgtttaggaaccgttccggttacccttacgtttaccgtacggttacgtaccggggcctaaccggggtcccttcccggg

SEQ ID NO: 197145 - DNA, 671 bp, Homo sapiens
  misc_feature: GYAE6OF01BH9LJ.39.81.H04.1.454.CMB.1.raw
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtctcctgcaaggtctttcgtggttacctaccttttaccaactagttggtatcgtaggttgggtgcgacgacggccccgtaggacgaagggtctggacggtggtagtgggagtggatcgagcgtacttaagactggtacaacgaactaactatacgaccacacgtaaccctccgacgggacaggactaccaaccgataccgacccaacgacgacactaccgtccaacgacgacccgaccggacctaacgacgtacggaacccgtaggacggtacgcccgttaggaacgtacgtaccgtcggaaccgtaccggacccgggtacgttagttaacgttacgtacggtaggcggtaagacggtaacggttagggtaaacgtttgtttagaccgttaccgttacccttacgtttacgtaccgtacgggtcgggaaccgtacgggtaacccgg

SEQ ID NO: 197146 - DNA, 730 bp, Homo sapiens
  misc_feature: GYAE6OF01BYU4H.39.81.H04.1.454.CMB.1.raw
  modified_base (633)..(633): a, c, t, g, unknown or other
  misc_feature (633)..(633): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtcgcccactcccaggttcagctggtacagtctggagctgagatgacgaagccgtggggcctcgagtggaacggtctccgtgacgtaaggtcttcgtacggttacctacccttttaacaaacttagtggtaatcgtaggttgggtcgcgacgacggtccccgtaggaaccgtaagggtctttggaggttgggaagttgggatgggtactacgaggtcgtactttaacgaagttcgggtaccaaccgtaactaaaaaccgtgtaccgaaccaaaccgtaacggaaacccttacggaacgggacgaacgtacgtacccaaaccgtagtaccggaacccaacgaacaaccgtacgacctaccgaacgaccgacgtaaccggtacctaacgacgtacggaacccgttagggaaccgggtaccgtacgtaggaacggttacgtccgtaacgggaccgaacggtccggtacgttagttacttacgnggtacggaccggtagtacgtaaaggtacgggttaaagttcgttaggacgttacgttcccgttagttcgacgtcggtacggacgtacggtaccgtcgg

SEQ ID NO: 197147 - DNA, 778 bp, Homo sapiens
  misc_feature: GYAE6OF01AREV7.39.81.H04.1.454.CMB.1.raw
  modified_base (322)..(322): a, c, t, g, unknown or other
  misc_feature (322)..(322): n is a, c, g, or t
  modified_base (568)..(568): a, c, t, g, unknown or other
  misc_feature (568)..(568): n is a, c, g, or t
tcagtcgcactagtcacgaccggtgctcgatttagtagtgtagattcgcggggacccaaaaccacacccctccttgggagaatcccctagatcacagctcctcaccatggactggacctggagcatccttttcttggtggcagcaacaacaggtgcccactcccaggttcagtctggtacagtctggagctgagatgacgagcgtgggcctgagtgaaggtctcctgacgaggtcttcgtaggttactacctttaacacttatggtatcgtaggtttgggcgcgacgacgggtcccctagggacgtaacgggtcctttaggnggttagggacgttagggggattcgggagttaccgaggtaccgttacgttaacgtaagtcggttaaccaacgtaaactaaaacgttctacgggacaacacggtaacccgtcggaacgggactaggaccgtacaaccgtactacggaacccacgtaacggaacctaacgtaccgaccggaacgtaccggaccaacccggtacctaacggtaacgttaccgggaacccttagggacggaccggttaccnggacgttaagtcccggacggtaacccgacgttaccccggtgtttacgtaccctttaaggtcggaccggtcggtaaacgaggttaacgggttaaccgggttaaagttttacggttaccgggtaccgtttcccggttaccgtttaaacggttacggttaaccccgtacggggttacccggggttaaccgacccgggttccgggtttaacccg

SEQ ID NO: 197148 - DNA, 645 bp, Homo sapiens
  misc_feature: GYAE6OF01CWPCO.39.81.H04.1.454.CMB.1.raw
  modified_base (258)..(258): a, c, t, g, unknown or other
  misc_feature (258)..(258): n is a, c, g, or t
  modified_base (347)..(347): a, c, t, g, unknown or other
  misc_feature (347)..(347): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatcctttcttggtggcagcaacaacaggtgcccactcccaggttcagctggtacagtctggagctgagatgacgaagcctggggcctcagtgaaggtctcctgcaaggcttctggttacacctttaccaactntggtatcagttgggtgcgacacggcccctggacaagggcttgaggtggagtgggatggatcagcgtctacaatggtacacactaaactntgacacacgaccctcgagggcagacgtcacatcgaccacgagacaacactccaacgacgaccgaacggccctaagacgtcggacccgtaggaacgggtacgcccgttaggacgtactaccgtcggaaccgaccgaccgggtaccgttaggttaacttacgtggtcggtacggaaggtaggtacgggttacgggtaaatttacggttttacgaccggtttaccgggttaccctttacgtttacggtaacccggttacggtccgggggaacccgtaaccggggtaacccgttacccgggg

SEQ ID NO: 197149 - DNA, 882 bp, Homo sapiens
  misc_feature: GYAE6OF01DG2LW.39.81.H04.1.454.CMB.1.raw
  modified_base (190)..(190): a, c, t, g, unknown or other
  misc_feature (190)..(190): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctgganctgagatgacgaagccgtgggcctcagtgaaggtctccgtgcgaaggtcttcgtcggttacctacccttttaaccaacgttattggtaattcgtaggtttcggggtcgacgtacgaccggtcccccgtagggaaccgaaggggtcctttagggacggttggggaggttggggagttagggacgtcgaaggccggtacttaacgtaagtcgggtacaaccaaactaaacttacgtacgacctaaacgaaccggtaaaccccgtaccggaaggggtaccctaaacgggtaccgttaacccaaccgtaacgttaaccggaaaccccaacgaaacggtaacccaaccgtaacgtccccgaaaccggtacggacccggaacccggttacccttaacgaacggttcccgggaacccgttggggaaaccgggtaccgtccgtaagggaaccgtacgtaccgtacggaacccggaccgtacccggggtaccgttaggttaacctttacggtcgggtacggtacgggtaaggtaaacggggtacgggttaaccgggtttaaaaagtttttacgggttttacgggtaacccggtttaacccgggtttacccccgtttagttttacccgggtaaaccgggtttacccggggttaccgggggaaacccgggttaacccggggttaaccccggtttaacccgggg

SEQ ID NO: 197150 - DNA, 775 bp, Homo sapiens
  misc_feature: GYAE6OF01ESDIJ.39.81.H04.1.454.CMB.1.raw
  modified_base (661)..(661): a, c, t, g, unknown or other
  misc_feature (661)..(661): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacgaggtgcccactcccgaggttcagctggtacagtctggagctgagatggacgaaggccgtcgggcctcgagtaggacgtcctcgtgacgaggtcttcgtacgttacctaccttacaacttagtagtactcgtaggttggtcgacggacgaccggacccgtaggacgaagggtcttaggaacggtggtagggtagggagtacgggtactacggacggtaccgtaccgttaacgtaagttcggtaaccaaaccgaaaccgttaaaactgtaccgaaccgtaacgaaaccgaaccccgtacggagtaccgaacggtaccgtaaccaccgtaagtaccgaacaaccgtaacgaacctaacgtacccgtaacccgaaccggacgaaccccgggacgtaaccctaacgaccggttaccgggaacgacgggaacggtaccgaccgtaaggtaagtaccccggagtaccgggaaaccggacccggtacccggttacgttaagttaccgtttaagggngttacgggaccgtaagggtaaccgtaggttaaacgggtttagtttaaccgtgtaccgttacgttcccttaggtacgtaaccggtacggaccgggtacacccgggtcgtacccgg

SEQ ID NO: 197151 - DNA, 924 bp, Homo sapiens
  misc_feature: GYAE6OF01D2NSJ.39.81.H04.1.454.CMB.1.raw
tcagtcgcactagtcacgaccggtgctcgatttagtagtgtagattcgcgggggtgatcaggactcctcagttcaccttctcacaatgaggctccctgctcagctcgtgggctgctatgctcgtgggtccaggactccgaggtggggattggttgtgagtgactcgacgttcctaccgacgttccctcccgtaccggtccccgtcctacccgttggaaccgcggcccggtcccttacctacttccgttccgtggaccgtacgggttctaaggtaaccgtaaaccgtcccttacgttaactacgtagttacggtaaacgtaaccggtaaaccctaccgtttaacgttagttaagtttcggttacacggacgacggaccggtaccgaacggtacctaacgtccgtaaccggaacggtacccgtttaaactttaacgttttaaacggttaaccggttttacccggtaaccggtacgttaccgggtacccggggtaaccaagtacgtagttacgtacggtaacggtccgggtagtacgggggttcgggtacctaaggggtaccttaacgtaccgttaaacttacccaaaccggttaacgtaaacggtaaacgtacgggacgggtaacgggtaaccgggggttagggaacgggtacgttaggggtaacgggtttagggtttttacggggttttagggttttaacttacggacgttaacgtaaggtaccgaaagggaaaccgttaccgtaaacgttccggtaacccgttacccgttaccggtttaacgtttccgggttacccggaacccggggttaaggaccgtaaacggtcggtaacggaaaccgttaaccggaaaacggttaaaccggtagggttacccggttacgggacccttacgtaaacccgtttcctaggttttcccgttaacg

SEQ ID NO: 197152 - DNA, 784 bp, Homo sapiens
  misc_feature: GYAE6OF01E2LSV.39.81.H04.1.454.CMB.1.raw
  modified_base (155)..(155): a, c, t, g, unknown or other
  misc_feature (155)..(155): n is a, c, g, or t
  modified_base (185)..(185): a, c, t, g, unknown or other
  misc_feature (185)..(185): n is a, c, g, or t
  modified_base (344)..(344): a, c, t, g, unknown or other
  misc_feature (344)..(344): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttctggtggcagcaacaacaggtnccactcccagttcagctggtacagtctggngctgagatgacgaagccgtggggcctcagtgaaggtctccgtgactaagggtcttcgtggttaacctacccttttaaccaaacgttatggttactcgaaggttgggtgccgtacgacggccccgtaggaacaagggtctagagtgggatgggatggacncgacgcgtactaagtacgtcgtaccaaccgaactaaaacgtatacggaaccaacgtaacgtaaccccgtaccgggaaggaaccgtaacggtaacggtaccaaacccgtaaggtacccgaaaccaacgaacgaaccactacgaacccacggaacgaacccgaccggtaaccctacggtacggtaaccggtcgtaacggaacggtaccacggtacggacgttaccgacggaacgtaaccgggaaccgtaccggggttaccgttacgttaaacgttcgttagggaccgggtacggaaacggtaacgggttaaaccgggtaaaccgggttaaagttttacgttaaccgggtacccgtttacccggtttaacccgttaccggttaccggtaaccggtaccgggacccggggttaacccgggtaacccggtacccggttaacccgg

SEQ ID NO: 197153 - DNA, 653 bp, Homo sapiens
  misc_feature: GYAE6OF01DZRF0.39.81.H04.1.454.CMB.1.raw
  modified_base (169)..(169): a, c, t, g, unknown or other
  misc_feature (169)..(169): n is a, c, g, or t
  modified_base (281)..(281): a, c, t, g, unknown or other
  misc_feature (281)..(281): n is a, c, g, or t
  modified_base (328)..(328): a, c, t, g, unknown or other
  misc_feature (328)..(328): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattcctttttcttggtggcagcaacaacaggtcgcccactcccngttcagctgtacagtctggagcgtgagatgacgaacgtccgtgggcctcgagtagaggtctcgtgcgagtcttcgtcgttacctaccttacaactgtgtatcgtaggttggngacgacacggccgaggaacgaggtctaggagtggagtgggagtggtntacgagacgtacttaacgagttacggtacaacaaacgtaactagtacgacaacaacgtaaccgacgagggacaacgacgtaccaccgtacacgaccaacacgacacacgtacgacgacgtacccgacgtactaactggacccggtaccgtgggaaccggcgacggtagaacgtacgttccgaccggaacggaccgtcggtaccgttagtaacgtttcgagtacggaacgtaggaggtacgttaaggtaactttcgttaggtaccgttcgtaccgtttacgtacgtaccggtacggtaccgggtaccggtaaccggtccgtaccgg

SEQ ID NO: 197154 - DNA, 702 bp, Homo sapiens
  misc_feature: GYAE6OF01CIUR1.39.81.H04.1.454.CMB.1.raw
tcagtcgcactagtcacgaccggtgctcgatttagtagtgtagattcgcggggacccaaaaaacccacacccctccttgggagaatcccctagatcacagctcctcaccatggactggacctggagcattccttttcttggtggcagcaacaacaggtgcccactcccaggttcagctggtacagtctggagctgagatgacgaagcctggggcctcgagtgaaggtcctcctgcaaggcttctggttacctacctttaccaactatggtatctaggttgggtgcgacgacggcccctaggacgaagggcttggagtgggagtgggagtggagtcgagtccgtattacgaagtcggtaccaactaactaaaactagtacgaccaaccgaacgtaacccctacggacgggacaggtacgtaccaaccagtacgaaccacgacgaccacacgtcccgaacgacgaccgaaccggtcctaacacgtcggaccctaggaacggtacgcccgtaggagacttccgagtacccgaccgtaccgggtacccgttagtacgtttaccgtgggacgaccggtaggacggtaaacggttaccgggggtaaaattttcggtttaaggtacccgtttccggttaaaccccgttcgttttaacggacccgttaccgggtacgggggacccgtaaccgggtaccccggttaccggg

SEQ ID NO: 197155 - DNA, 673 bp, Homo sapiens
  misc_feature: GYAE6OF01BVKJW.39.81.H04.1.454.CMB.1.raw
  modified_base (446)..(446): a, c, t, g, unknown or other
  misc_feature (446)..(446): n is a, c, g, or t
tcagtcgcactagtcacgaccggtgctcgatttagtagtgtagattcgcgggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggccctggacaagggcttgagtggatgggatggatcgagcgcttacaatggtacaacacaaactatgcacgaacgaaccctcgaagggcaagagtacaccatgaccaacagaacacactaccaacgagaccgaacggcctaacagtacgggacctaggaaggacncctagagtaacgtctcggaaccgacgaaccgggtccgtaggttaacgtttaccgttaggtacgtacgaaggaacggaaggttacccggggggtaaaaatttacggttttttaggaaaccgttttccgggggttaaacccctttacgggtttttaacggtaaacccggttaaacgggttacccgggggtaacccgggaaacccgggggttaaacccccgttaccgggg

SEQ ID NO: 197156 - DNA, 628 bp, Homo sapiens
  misc_feature: GYAE6OF01BZ3OC.39.81.H04.1.454.CMB.1.raw
  modified_base (476)..(476): a, c, t, g, unknown or other
  misc_feature (476)..(476): n is a, c, g, or t
  modified_base (507)..(507): a, c, t, g, unknown or other
  misc_feature (507)..(507): n is a, c, g, or t
  modified_base (537)..(537): a, c, t, g, unknown or other
  misc_feature (537)..(537): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtcgtggagctgagatgacgaagccgtggggcctcgagtgaacggtctccgtgacgaacggtctttcgtaggttacctacctttaaccaacttagtaggtatcgtaggttcggagcgacgacggcccgtaggacgaggtctaggagtggagtggatggactgacgtcgtacttaacgagtcggacctaacgaactaaaactgtacgacaacgaacgaacccgtcggaggtacagactcccaacgagtaccgaactacgaacgaccacactaccacgacgccgaccgacacgtanacggaccaggagacgcgtagacgtgtaccgngaccgacgaccggtacgttagtacgtacgngtaccgaggtaagaggtaggtaacggtattcgttgaacggttcgtaccttggttacgtacggtacggtcgggaccgtacgggttccgtcgg

SEQ ID NO: 197157 - DNA, 731 bp, Homo sapiens
  misc_feature: GYAE6OF01CJJA9.39.81.H04.1.454.CMB.1.raw
  modified_base (189)..(189): a, c, t, g, unknown or other
  misc_feature (189)..(189): n is a, c, g, or t
  modified_base (421)..(421): a, c, t, g, unknown or other
  misc_feature (421)..(421): n is a, c, g, or t
tcagtcgcactagtcacgaccggtgctcgatttagtagtgtagattcgcgggacccaaaaaccacacccctccttgggagaatcccctagatcacagctcctcaccatggactggacctggagcattccttttcttggtggcagcaacaacaggtgcccactcccaggttcagctggtacattctgganctgagatgacgaagccgtgggcctcgaggtgaagggttcctccgtgacgaaacggtcctttaccgttaggtttaacctaaccctttttaaccaaacgttagttggttaacttcgtaggtttggggtcgaccgaccgtacggccccgttgggaaccgtaagggtccttaggaggtggaaggtgggagtgggatcgagtcgtacttacaagtggtacaacgaactaaatgtacncaacgataacccgtcgagggacaggtacgtacaccagtacgaccctaacgaacgacacctaacgtacccgtaacgacgtacccggaacccgtaccaacgtaagtaccggtaaccgtaggaacgggactcccggttaggaacgtacgtccggtaacggtacccggaacggtacccggtacgggtttagttaaccgttacgttggtacggaccgtaaggacgttacggtaacggggtaaattttcggttacgtacggtacgtttccttagtacggtactaccgggacgggtaccaaccggggtccttaccgg

SEQ ID NO: 197158 - DNA, 822 bp, Homo sapiens
  misc_feature: GYAE6OF01AIQV7.39.81.H04.1.454.CMB.1.raw
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtctcctgcaaggtcttcgtggttaccacctttaccaacttagtggtatcgtaggttggtcgcgacgacggcccctggacgaggtcttggagtgggagtgggatggactcgagcgtcttacagttcggacaacgaactaactatcgacaacaacgaaccctccggagggaccaggactaccacctagtacgaacccacgacgaacacctacgtacccgaacgacgacccgaaacccggcctaacgacgtaccggaccgtagggaacggacgtccgaggtaacgtacgttacgacggaaccggtaacccgtaccgggtaccggtttaacgttaaacggttttacccggttacgggtacgggtaaaccgggtaacgggtaaggggtttaaaaccggggtttaaaccggggtttaaaaacggtttttacggtttttaacccggggtaaacccggtttttaccccggggtttaaacccccgtttttttaccgggttttaacccgggttaaaacccggggtttaacccggggttttaaccccgggggggaacccccgggttttaaaaacccggggggtaacccccggtttttacccccggggg

SEQ ID NO: 197159 - DNA, 750 bp, Homo sapiens
  misc_feature: GYAE6OF01CYL2A.39.81.H04.1.454.CMB.1.raw
  modified_base (139)..(139): a, c, t, g, unknown or other
  misc_feature (139)..(139): n is a, c, g, or t
  modified_base (591)..(591): a, c, t, g, unknown or other
  misc_feature (591)..(591): n is a, c, g, or t
tcagtcgcactagtcacgaccggtgctcgatttagtagtgtagattcgcgggacccaaaaccacaccctcttgggagaatccctagatcacagctcctcaccatggactggacctggagctacttccttttcgttgggngcagcaacaacaggtccgacccactacccgtaggttaccagtcgtaggtacaggttcgaggagtctaggaagataggaaccggaagccggtgggcctagaggtaggaacggtctaccgtagacgtaaggtcctttacgttacggttaccttaaccgtttacaattaggttaggttaactcggtagggtttagggacgaccgaacggtaccggtacccgagggaacggtaagggtcttaggggaggttaggtaacggttaggagtacggtatacgacggtacttaacgtaactagtaccggactaaaaccgaaactaaacgttcaccgaacgtaaccgaacggtttaaacccgcggaacggaagtaacgaacgtaaccccaagtaccaaggaaaccaacgactaacgccaacgtaacgacgacgtacgacgttacaagtaacgtcgggaaccngggaacgacttaccggagaacgtctaacggcgacgaaacggtccggttactagttaatcggtggtacgaggaagtacgtaaggttaaacggatttacgtagcttttaacggaccttagtaccgtaggtacccgggtgggaacctaacgggtccctacgg

SEQ ID NO: 197160 - DNA, 725 bp, Homo sapiens
  misc_feature: GYAE6OF01ATBIZ.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtcctcctgcaaggtcttcgtggttacctaccctttaacaactagtaggtatcaggttagggtgacgacgacgggtccccgtaggaacgtaagggtcttggacggtgggagtgggatggactacgagccgtacttaacgtaagtcggtaacaaccaactaaactgtcgaccaacaaccgaaccctcgacgggacaacgtagtaccaactacgtacgaaccacgaacgaaccactaccaccgaacgacgaccgtaccggacctaacgtacggtacgggacccgtaggaccgggtacgaccgtaggtaacgacgtaccgtacgtaccggaaccgtacccgggtacgttagtttaacgttccgtagggtacgaacggaggtaacggtaacggttacgggttaaagttttcggttttaacgtaacccggtttcggtttacccgtttaggtttacccgaccggttaccgggtacgggtaaccccgtaacggggtaccccgttaccggg

SEQ ID NO: 197161 - DNA, 754 bp, Homo sapiens
  misc_feature: GYAE6OF01D9YZN.39.81.H04.1.454.CMB.1.raw
  modified_base (282)..(282): a, c, t, g, unknown or other
  misc_feature (282)..(282): n is a, c, g, or t
  modified_base (286)..(286): a, c, t, g, unknown or other
  misc_feature (286)..(286): n is a, c, g, or t
  modified_base (308)..(308): a, c, t, g, unknown or other
  misc_feature (308)..(308): n is a, c, g, or t
  modified_base (357)..(357): a, c, t, g, unknown or other
  misc_feature (357)..(357): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttctggtggcagcaacaacaggtgcccactcccaggttcagctggtacagtctggagctgagatgacgaagccgtggggcctcagtgaaggtcctctgcaaggctttcgtaggttaccacctttaaccaacttatgtatctaggttgggtncganacggccctggacagggtctggngtggagtgggatggatcgagcgcttacaagtggtacaacaacaaacgtntcgacaacgacgtaaccctaccggagggacaggtacgtacacctaatacgaaccacgaataaccacactaccgaacgagaccaaccggtacctaaccgtagtacggaacccgtggaacggtacgtaccgtaggaacgtacgtaccggtacggaaaccgtaaccgtaaccgggtacccgttaagggtttacttaccgttacggtacgggaaacgggttaaaccgaaggggttaaacgggttaaacccggggggttaaaattttaacgggttttttaacggaacccggttttaaaccggggttaaccccctttttagtttaaacccggggtaccgttttaaacccggggaccggggggttaaccccgttaaaccggggggaccccttttaacccggggg

SEQ ID NO: 197162 - DNA, 710 bp, Homo sapiens
  misc_feature: GYAE6OF01D818N.39.81.H04.1.454.CMB.1.raw
  modified_base (276)..(276): a, c, t, g, unknown or other
  misc_feature (276)..(276): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcattcctttttcttggtggcagcaacaacaggtcgcccactcccaggttcagctggtacagtctggagctgagatgacgaagccgtgggcctgagtgagtctctgcagtcttctgttacctaccttacaactagtgtatcgtaggttgggngcgacgaccggccctaggaacgagggtcttaggaggtaggaggtgggagtggactcgagtcgtacttaacgagttcgtacaactaaacaactagcgacaacgaacgtaacccgcggaacgggcaacggtacgaccaaccgtagtaaccgaacccaagaacgaacccaacctaccgtaacccgaaccggacgaacccggtaaccggacctaacggtacggtaccggaccgtaggaacggtccgtacgtaggacgtactacggcggaaccggaccgtaccggtttacgtagtttaacgtagtcggtagggagtaagggtacggtaacggttaacggtttaagtttacgttacggttacggtttaccggttaccctttggttaccgaccgggttaacgggtcccggggaaccgttaacccgggtcccggttaaccgg

SEQ ID NO: 197163 - DNA, 734 bp, Homo sapiens
  misc_feature: GYAE6OF01A98PA.39.81.H04.1.454.CMB.1.raw
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtgggcctcgagtgaaggtctccgtgcgaaggtctttcgttacggttacctacccttttaaccaacttagtaggttactcgtaggttcggggtgaccgaacgacggtccccgtaggacgaagggtcgttaggaggtggagtgggagtggactcgacgtcgtacttaacgaagttcggtacaacaacgtaaaactacgtacgaccaacgaaccgaacccgtccggaaggccgaacggacgtaccaaacctacgtacgaaccgaacgaacgaaccaaccacgtacccgaacggaccgaccaacggtaccctaacgacggtaccggaccgtagggacggaccgtccgtaggaacgtcgtaccggacggaaccggtaccggtacccgggtaccggttattaacgtttcggtagtacgacggaaggtaagggtaaacggtaacgggttaaagtttacgtttacggtaccgttaccggttcccttaggttaccggtacgtcgggtaccggaccggtacccgggtacccgtcggg

SEQ ID NO: 197164 - DNA, 713 bp, Homo sapiens
  misc_feature: GYAE6OF01E5NYC.39.81.H04.1.454.CMB.1.raw
  modified_base (190)..(190): a, c, t, g, unknown or other
  misc_feature (190)..(190): n is a, c, g, or t
  modified_base (531)..(531): a, c, t, g, unknown or other
  misc_feature (531)..(531): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctgganctgagatgacgaacgccgtggggcctcgagtaggaacggtcctccgtgcgaacggttcttcgtacggtttacctacccttttaccaaacttagtggttatcgtaggttggtcgaccgacgaccggcccgtaggacgtaagggtcttggagtgggagtgggataggatcgagtcgtactaacgagttcgacaacaactaactagtcgaccaacgaaccgaacccgtcggaacgggacaagtaccgtaaccaaccgtagtaccgaaccaacgaacgaacctacaaccgtaccgacgtacgacccggtaccgacctaacgacggtacggaccgtggacggtacnccgtaagacgtacgtccgaacggaccgtaacgtcggtaccttagttaacgtgtaggacggaaggtaggtacgtaacggtaaagtttaactttcggtttaacgaccggtttcccggtttacccttagtttaccgggaacgtttcccggggaacgggtacccggtaacgtccccggtttaccgg

SEQ ID NO: 197165 - DNA, 656 bp, Homo sapiens
  misc_feature: GYAE6OF01EUO94.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttggtgcgacagccctggacaagggcttgagtggagtgggatgggatcgagcgcttaacaagtcggtacaacaacaaactagtcgacaacgaacgaaccctaccgagggcaaggactcaacatacgaccacacgaacacgtaactccgaacgacgtaccaacggaccctaacgagtccgggaacctagggaacggacgtaccgtaggaacgtacgtaccgtacggaaccgtaccgaaccgggtccttaacggttaactttaccggtagtacggacggtaaggtacggtaacgggttaacggggtaaaatttacggttttacggacgttccggtacccttgttaacggtacgtacggtacggggaccctaaacggggtcccgttacggg

SEQ ID NO: 197166 - DNA, 653 bp, Homo sapiens
  misc_feature: GYAE6OF01CS4ZA.39.81.H04.1.454.CMB.1.raw
  modified_base (388)..(388): a, c, t, g, unknown or other
  misc_feature (388)..(388): n is a, c, g, or t
  modified_base (486)..(486): a, c, t, g, unknown or other
  misc_feature (486)..(486): n is a, c, g, or t
tcagtcgcactagtcacgaccggtgctcgatttagtagtgtagattcgcgggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtggggcctcgagtggaacggtctcctgacaaggcctttcgtggttaacctacccttttaaccaacttagttggtattccgtaggttgggtacgcgacgacggtccccgtaggacgaagggtcttagacgtggagtggagtggatcgagcgtacttaacagttcgacacaacgaaactgtacncacaacgacccgtacgaggacagactacacagtcgaccacacgacacactaccgagacgacgaccgcctaacagtcgacgtaggacgacgtcgtaganactcgacggaccgaaccggtacggtaccgtagttacgttacgtaggtcgacggtaggtacgtaacgggttacgggtaaatttggtttaccggaacggtttcggttacccctttagtttccgaacggttaccgggtaccgggacccgtaaccgggtaccccgttacgg

SEQ ID NO: 197167 - DNA, 801 bp, Homo sapiens
  misc_feature: GYAE6OF01CH75P.39.81.H04.1.454.CMB.1.raw
tcagtcgcactagtcacgaccggtgctcgatttagtagtgtagattcgcgggggacccaaaaaccacacccctccttgggagaatcccctagatcacagctcctcaccatggactggacctggagcattccttttctggtcggcagacaacacgaggtcgcccactcccgaggttcacgtctaggtacagttcgtggagctagagtatagaaccggaacggtccggtcggggtaccctacgagggttacggaacgggttccctaccgtacggtacgtaacgggtccttttcggttaccggtttacccttaaccccttttaaccgaaacttagttacggttacttacggtaggtttcgggacggaccggtaaccgaccgggtccccgtagggaacccgtaagggtcgttagggtagggtacggtaggtcgggtagtgggtactacgacgtaccgttacgttaacgtaagttccggaacctaactaaacgtaacgtctaccggacgaaccaaccgggtaccctacggagggtaccacgacgtacccaacgtacgtaccgaaccgacaacgaccacgtaccgaccgacgacgaccgaccgtacctaacggtcgtaccgaccgtagggtaacgaccgtacgtaggtactacgtcgaacgaccggtaccggacggtccgttatacggtcgtaggagtacggaggtacgtaccgggttaagttacgtttacgtacggttacggttccttaccgttacgtacgtaaccggttcgggtaaccggacccgggttaacgttcccggtaccg

SEQ ID NO: 197168 - DNA, 714 bp, Homo sapiens
  misc_feature: GYAE6OF01B390X.39.81.H04.1.454.CMB.1.raw
  modified_base (346)..(346): a, c, t, g, unknown or other
  misc_feature (346)..(346): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtgggcctcgagtgaaggtctccgtgcgaaggcttcgtcggttacctacctttacactatggtactgtaggttggtgcgtacgacggtcccgtgacgaagggtcttagaggtggagtgggagtggactcgagcgtacttanaacgtgtacaacaacaatatcgacaccgaacgtaccctacgacggtacagacgtccacgagtacgaccaacacgacacactaccacgagaccgaccggtcctaacggacgtaccggacgtacgggaacgggacgtaccgtaggaacgtactaccggaaggacccggaaccggtaccgggtcttaaccggtttagttacgtcggggtacgaaccggggtacgtaaacgggtacgggtaacgggtttaaaagttttacccggtttaggtaacccggtttcccgggttaccttttaaccggtttcgggaaaccccgtttagggggtcccggggtaacccggtaaacccgggggttccccgttaacccgggg

SEQ ID NO: 197169 - DNA, 616 bp, Homo sapiens
  misc_feature: GYAE6OF01EU13O.39.81.H04.1.454.CMB.1.raw
  modified_base (427)..(427): a, c, t, g, unknown or other
  misc_feature (427)..(427): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggccctggacaagggcttgagtgatgggatggatcgagcgacttacatggtcaacacaaactatgacaacgacgaaccctccgagggtacagacgtcaaccatcgaccacagaaccacactaccacgacgaccgacgtccgtaacnctacgggaacctggaacggacgacccgtaggaacgtactccgtacggaaccgaccgtaccgggtccgttacgttacttaccgttggtacgacgtaggaggacgttacggggaaatttgtttagacgttccggttacccttcgtttacgtacgtacggtaccggggaccgtacggggtaaccccgtacgg

SEQ ID NO: 197170 - DNA, 683 bp, Homo sapiens
  misc_feature: GYAE6OF01AHNGK.39.81.H04.1.454.CMB.1.raw
  modified_base (366)..(366): a, c, t, g, unknown or other
  misc_feature (366)..(366): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtctcctgcaggtcttcgtggttaactaccctttaccaacttagtggtatcgtaggttgggtgcgacgacggcccctggacgaagggtcttggagtggagtgggatggatcgagcgtcttacaagtggtacacaactaaactntgacaacacgaaccctcgagggcaacggataccaccagtaccgaccaacacgaaccacactaccgaacgacgaccgaccggtacctacgacgtacggaccgtaggacggacgtcccgtagacgtacgtccgacggaaccgaccgaccgggtccgttagttactttacggtaggtacggacggtaggacggtaacgggtaacggggtttaaacgtttagttttacggtaacggtttccgggtttaacccctttacgttttacggtaaccggttacgggttccgggggacccggtaaccggggtaccccgttacccggg

SEQ ID NO: 197171 - DNA, 647 bp, Homo sapiens
  misc_feature: GYAE6OF01D2BU5.39.81.H04.1.454.CMB.1.raw
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacctacctttaccaactatggtatcgtagttgggtgcgacgacggccctggacgaagggtcttaggaggtggagtgggagtggatcgagtcgacttaacaagttggtacaactaacaaactatcgacacgaacgaaccctccgacgggacaagtacgtaccaccgaatacgaaccacaacgacaacgactacccgaacgtacgaccgacccgtcctaacacgtcggaccgttaggaacggacgtccgtaggacgtagtaccgtacgaaccgaccggaccggtaccggttagttacgttcgaggtcgacggagacggtagtacgggtaaatttggtttacgacgtttccggttaacccttgttacgtaccgttacggtgggacccgtacgggtacccgtacgg

SEQ ID NO: 197172 - DNA, 720 bp, Homo sapiens
  misc_feature: GYAE6OF01CPN4H.39.81.H04.1.454.CMB.1.raw
  modified_base (490)..(490): a, c, t, g, unknown or other
  misc_feature (490)..(490): n is a, c, g, or t
  modified_base (517)..(517): a, c, t, g, unknown or other
  misc_feature (517)..(517): n is a, c, g, or t
  modified_base (536)..(536): a, c, t, g, unknown or other
  misc_feature (536)..(536): n is a, c, g, or t
  modified_base (553)..(553): a, c, t, g, unknown or other
  misc_feature (553)..(553): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcacttccttttcttgggtggcagcaaacaacaggtcgcccactcccaggttcagtctggtacagtcgtggagctgagatgacgaagccgtggggcctcgagtggaaggtctccgtgacgtaggtcttcgttacggttacctaacccttttaaccaacgttagttaggtacttacggtagggttacgggtcggaccgaaccggtaccggtccccgtaggggaacggtaaaccggggtcgtttaggaagggttgggtaagggtagggtagtcgggtagttacggagtccggttaactacgtaagttcggtaacacctaactaaacgtatcgacaacgtacaacccgtacgagacaaggctacacgtanacgacaagacgtacacacgtacacganccgtacgctagcgtagacnggacggactcgagtaanctagacgaaccgcggtaccgtacgttagtacgttgacgggtcgaggtaacggtaggtagggttaaccggtaagtttaacggttcgtaaccggttaccgtttaccggttactttacgggaccctttacggggacgggtacccggtaaaggggttcccccttaccgggg

SEQ ID NO: 197173 - DNA, 637 bp, Homo sapiens
  misc_feature: GYAE6OF01A8D8Y.39.81.H04.1.454.CMB.1.raw
  modified_base (379)..(379): a, c, t, g, unknown or other
  misc_feature (379)..(379): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcgagcgcttacaatggtacacaacaaactatgacacaacgaacctccagggcagacgtcacangaccacagacacatcccaagacgccacggacctacagtacggacctggacggacgccgtagacgactcgtagaacccggacgtaccgggccgttagttaactttaccgtggttacggaccggtaaggaacggtacggttaaccgggggtaaatttacggttttaggaaccggtttccggttaacccctttagttttaccggtaacccgttaccgggttaccgggggacccgtaaaccgggggtaaccccgttaccggg

SEQ ID NO: 197174 - DNA, 708 bp, Homo sapiens
  misc_feature: GYAE6OF01ATPC5.39.81.H04.1.454.CMB.1.raw
  modified_base (231)..(231): a, c, t, g, unknown or other
  misc_feature (231)..(231): n is a, c, g, or t
  modified_base (282)..(282): a, c, t, g, unknown or other
  misc_feature (282)..(282): n is a, c, g, or t
  modified_base (333)..(333): a, c, t, g, unknown or other
  misc_feature (333)..(333): n is a, c, g, or t
tcagtcgcactagtcacgaccggtgctcgatttagtagtgtagattcgcggggacccaaaaacccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctctgngaagcttctcggttactaccttaccaactatgtatctaggttggtgcgacncggccctggacgagggtcttgagtggagtgggatggatcgagcgtcgtaanagtcggtacacaacgtaaactgtacgacaacgacgtaacctccgagggtcaaggacgtacaccgtaagtaccgaacctacgaacgaaccgacgtaacctaccgaacgtacgaccgtacccggacctaacgtacgtaccgaccgtggtaacggacgaccggttagacggtacctacggtacggaacccggtaacgtaaccgggttcccgttaacggttaacgtttaccgtacgggtacgaaccggaaggtaacgggtacggttaacgggttaaaggtttcgtttacgggttaccggttaacggttaccctttaacggttccggtaaaccgttaccgggtacggggtacccggttaaccggggttaacccgtacggg

SEQ ID NO: 197175 - DNA, 657 bp, Homo sapiens
  misc_feature: GYAE6OF01EJJYT.39.81.H04.1.454.CMB.1.raw
  modified_base (357)..(357): a, c, t, g, unknown or other
  misc_feature (357)..(357): n is a, c, g, or t
tcagtcgcactagtcacgaccggtgctcgatttagtagtgtagattcgcggggacccaaaaaccacacccctccttgggagaactcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttaccacctttaccaactatggtatcagttgggtgcgacacggcccctggacaagggcttggagttggatggggatgggatcgagcgtactttacaatggtacacgaacaaactngacacacgaacctcgaaggcaagacgtcaccatcgaaccacaacgacacactacccgaagagacccgaccggtcctaacgacgtcggaacccgtggaacggtcgacccttaggaacgtaactccgtacggaaccgaaccgtaccgggtaccgttacggttactttaaccgtggtacggaccggtaagaggttacggtaacgggggttaaatttacggtttttaggaccggtttcggttacccctttgttaacggtaccgttacgggtaccgggggcccgtaacggggttaccctaccggg

SEQ ID NO: 197176 - DNA, 662 bp, Homo sapiens
  misc_feature: GYAE6OF01DPPIA.39.81.H04.1.454.CMB.1.raw
  modified_base (287)..(287): a, c, t, g, unknown or other
  misc_feature (287)..(287): n is a, c, g, or t
  modified_base (380)..(380): a, c, t, g, unknown or other
  misc_feature (380)..(380): n is a, c, g, or t
  modified_base (397)..(397): a, c, t, g, unknown or other
  misc_feature (397)..(397): n is a, c, g, or t
  modified_base (419)..(419): a, c, t, g, unknown or other
  misc_feature (419)..(419): n is a, c, g, or t
  modified_base (505)..(505): a, c, t, g, unknown or other
  misc_feature (505)..(505): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaaacaacaggtcgcccactcccaggttcagctggtacagtctggagctgagatgacgaagccgtgggcctcagtgaaggtcctcctgactaggtcttcgtggttacctacctttaccaactagtggtatcgtaggttgggngcgacacggccccgtaggacgaagggtcttggagtggagtgggatggatcgagcgtatacagtcgacacaactaactgcacacaacgtaaccncgaggctaggacaccancgaccacacgaactcactaccncgagccgtaccgactacgtacgcggtaccgacgaggacgtccgtagagtacgtccgtaaggacgaaaccgcgggtaacccggtttnttaacgttagtacggtcggtacggagaaacggttacgggtaaacggggttaaagttacttttaccgggacgttaccggtttacccgttacgttttacggtaaccgttaccggggtaccggggaccggtttaaacccgggccggttacggtaccccgg

SEQ ID NO: 197177 - DNA, 648 bp, Homo sapiens
  misc_feature: GYAE6OF01CUJS8.39.81.H04.1.454.CMB.1.raw
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactccccaggttcagctggtacagtctggagctgagatgacgaagcctggggcctcagtgaaggtctcctgcaggcttctggttacacctttaccaactatggtatcgtaggttgggtgcgacgacggcccctggacgaagggcttggagtggagtgggatggatcgacgcgtacttaacaagtggtacaacaacaaactatcgcaacacgaaccctccgagggcagacgtaccaccatacgaccacgacgacacactacccgacggacgccgaccggacctaacgacgtacggacctagggacggacgaccgtaggaacgtcttacgtacggaaccgaccggaccggtcgttagttacttacgttggtacggacgaggtacggacggttaagggtaaactttacggtttacaccgggttacgttaccccgttctttacggtaaccgttccgggtacgggtacccggtaacgggtccccgttaccggg

SEQ ID NO: 197178 - DNA, 664 bp, Homo sapiens
  misc_feature: GYAE6OF01BKRJH.39.81.H04.1.454.CMB.1.raw
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaaacaacaggtgcccactcccaggttcagctggtacagtctggagctgagatgacgaagccgtggggcctcgagtgaaggtctctgacagtcttcgtggttacacctttacaactatgtatcgtaggttggtgcgacgcggccctggaacgagggtcttggagtggagtggggatggatcgagtcgcttaacgagtgaccactaacaaactatgacaacgaacgaacctcggaggacaaggtactaccgaacacgtacaaccacacgaaccacactaccaacgacgaccaaccggtaccacgagtacgacgtaggacggacgtccgtagacgtagtaccgtaggaaccgtaccggaccggtacgttacgttacgttacggtcggtacggacggaggtaaggtaccggtaaacgggttaatttaacggtttacgtacggtttccggttaacccgtttcggttaacgtaacgggttacccggaagggggtaacccggtaccggggtacccgttacccggg

SEQ ID NO: 197179 - DNA, 749 bp, Homo sapiens
  misc_feature: GYAE6OF01BNN19.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgccccactcccaggttcagctggtacagtctggagctgagatgacgagccgtggggcctcgagtgaacggtctcctgacgaaggtcttcgtacgttacctacctttaccaacttagtgtatcgtaggttgggtgcgacacgggccctaggaacgaagggtcttaggacggtgggtagtaggggatagggacgttcgacggtccgtacttaaccgagttacggtacaactaactaaaacgtacgtggacctaaacgaacccgtaacccgtaccggaagggtaccgacgtacgtaccgaaccgactacgaaccgacgaacgaacaccgaacgtcccgaacgactaccggaaccgtaccctaagacgggttaccgaaccgtcgggaacgaccggtacccgtggaacgtacgtacgtaccggtaaccgaccgggtaacccggtccgttacggtttacgttacggtacggttcggaaccggttaacggaaggtacggtaaacgggttaaagtttacgtttacggtacggttacccggtttaccttaggttaccgtaccggtcggtaccgggacggtaacccgggttacccgttaccggg

SEQ ID NO: 197180 - DNA, 755 bp, Homo sapiens
  misc_feature: GYAE6OF01CKLER.39.81.H04.1.454.CMB.1.raw
  modified_base (613)..(613): a, c, t, g, unknown or other
  misc_feature (613)..(613): n is a, c, g, or t
tcagtcgcactagtcacgaccggtgctcgatttagtagtgtagattcgcgggggacccaaaaaaccacacccctccttgggagaatcccctagatcacagctcctcaccatggactggacctggagcattccttttcttggtggcagcaaacaacaggtgcccactcccaggttcagctggtacagtctggagctgagatgaacgaagccgtggggcctgagtgaaggtcctcctgacaaggtcttcgttcggttaacctaacccttttaaccaaacttagttggtatacgtagggttgggtcgaccgacgaccggtccccgtaggaacgaagggtctttaggaggtaggtaggtgggtagtggactacgagtcgtacttaacgaagtcggtacaacgtaaactaaacctgtacgactaaccgaaccgtaacccgtaccggaagggtacaaggtacccgtacgacccgtaagtacccgaaccaacgacgtaaccactaaccgtacccgaagaccggaaccgacccgtacctaacgaacggtccgtaccgtaggaccggtacgccggtaagacgtacgtcggaacgaccggtacccggtacggttaacggtttnttacgttacgtcggacgtacggtaaaggtacggtaaaggttaacggttaagtttcgtttaccggttaccgttaccgtttaccgttacggttaacgttccggtaacgggttccggggaaaccgttaccgggtcccgtacccgg

SEQ ID NO: 197181 - DNA, 687 bp, Homo sapiens
  misc_feature: GYAE6OF01BL6S9.39.81.H04.1.454.CMB.1.raw
  modified_base (158)..(158): a, c, t, g, unknown or other
  misc_feature (158)..(158): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattcctttttcttggtggcagcaacaacaggtncccactcccaggttcagctggtacagtctggagctgagatgacgacgccgtgggcctacgagtgaagtctcgtgacgaagtcttactcggttacctacctttaaccaacttagtacggttactcgtaggttcgggtcgaccgacgaccggccccgtagggacgaagggtcttaggacggtggagtgggagtaggactacgaggtaccgtacttaacgagttacgtaccaaccaacgtaactacgacgaccaacgacgaaccctacggacggcgaagtcgtaccacgacgtacgaaccacgaacgaccaacgacaacccgaacggaccgaccgaccggtaacctaacgacggttaccggacccgtaggacgggaccgtaccgaggtactacgtaaccgcgaaccggaccggtacggtaccgttattacgttacgcgtacgacggtagaagtaggtaacgggtaattcgtttacgcggttcttacccgttgttacgtacggtccggtaagggacctcgggtacccgtccgg

SEQ ID NO: 197182 - DNA, 680 bp, Homo sapiens
  misc_feature: GYAE6OF01CH85G.39.81.H04.1.454.CMB.1.raw
  modified_base (213)..(213): a, c, t, g, unknown or other
  misc_feature (213)..(213): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttctggtggcagcaacaacaggtgcccactcccaggttcagctggtacagtctggagctgagatgacgaagccgtgggcctnagtgaaggtctcctgcaaggtcttctggttacctacctttaccaactgtggtatcgtaggttggtgcgacgacggcccctaggacgaaggtcttaggagtaggagtgggatggactcgagcgtacttacagtcggtacacaacaactgtacgacaacgaacgtaacccgtacgacgggcaaggtactacccgacctaacgtacgaacccaacgtacgaaccaacgtactacccgaacgtacgaccgaccgtacctacgacgtacggtacccgtaggacggacgtcgtaggtacgtactcgtacgaaccggaaccgtaccggtaccgttagttacttacgttaggtacgacggtaaggacgttacgggtaacgggttaaatttcggtttaggaccgtttaccggttacccttgtttaacggtacccgtacgggttaccgggacccgtaacgggttccccgttaccggg

SEQ ID NO: 197183 - DNA, 613 bp, Homo sapiens
  misc_feature: GYAE6OF01D8KIW.39.81.H04.1.454.CMB.1.raw
  modified_base (232)..(232): a, c, t, g, unknown or other
  misc_feature (232)..(232): n is a, c, g, or t
  modified_base (346)..(346): a, c, t, g, unknown or other
  misc_feature (346)..(346): n is a, c, g, or t
  modified_base (424)..(424): a, c, t, g, unknown or other
  misc_feature (424)..(424): n is a, c, g, or t
tcagtcgcactagtcacgaccggtgctcgatttagtagtgtagattcgcggggacccgaaaaaccacacccctccttgggagaatcccctagatcacagctcctcaccatggactggacctggagcatccttttcttggtggcagcaacaacaggtcgcccactcccaggttcagctggtacagtctggagctgagatgacgaagcctggggcctcagtgaaggtctccttnaaggcttctggttacacctttacaactatggtatcagttggtgcgacaggcccctggacaaggcttgagtgatggatggatcagcgacttacaactggtcaacgactaaacgtntgacacgaacgtaaccctcgaggacagaacgtccaccatacgaccacacgacacactaccacgagcgaacggccctanagtacggacctggacggtagcccgtagacgtagtacctaggaacgacgtaccgggtcgttagttacgttacgtcggtagaccggagtagtacgtacggggtaaatttacgtttcgacgttacggttacccttcgtttacggaccgttacgtacggggtaccctaaccggggtaacccctgggtaccccg

SEQ ID NO: 197184 - DNA, 667 bp, Homo sapiens
  misc_feature: GYAE6OF01E3GEC.39.81.H04.1.454.CMB.1.raw
  modified_base (265)..(265): a, c, t, g, unknown or other
  misc_feature (265)..(265): n is a, c, g, or t
  modified_base (362)..(362): a, c, t, g, unknown or other
  misc_feature (362)..(362): n is a, c, g, or t
  modified_base (439)..(439): a, c, t, g, unknown or other
  misc_feature (439)..(439): n is a, c, g, or t
tcagtcgcactagtcacgaccggtgctcgattttagtagtgtagattcgcggggacccaaaaaccacacccctccttgggagaatcccctagactcacagctcctcaccatggactggacctggagcatcctttttcttggtggcagcaacaacaggttgcccacttcccaggtttcagctggtacagtctggagctgagatgacgaagccgtggggcctcagtgaaggtctcctgcaaggcttctggttacacctttacaactntggtatcagtttggtgacgacgtacggccctggacaagggcttggagttggagtgggattggatcgagcgtacttacaagtcgtacaacacaaactntagacacacgaacccgtcgagggacagacgtcaaccataccgaccacaacgaacctaccaaccgtacccacggaacncccgaaccggtacctaacgacgtccggaacctggacggacgtccgagacgtaacgtccgtaaggaacccggtaccaaccggtaccggttagttaacgttaccgtgggtacgtacggaggttaggtaacggttaccggggtaaaattttggtttacgaccggttccggttacccttcggtttaccgtaccgttaccggtaccggggaccaacggggttaaccccgtcgg

SEQ ID NO: 197185 - DNA, 884 bp, Homo sapiens
  misc_feature: GYAE6OF01DAGSR.39.81.H04.1.454.CMB.1.raw
tcagtcgcactagtcacgaccggtgctcgatttagtagtgtagattcgcgggggtgatcaggactcctcagttcaccttctcacaatgaggctccctgctcagcctccgtgggctgctaatgctcgtcgggtccaggactcgaggtggggtattggttgtgatacgtacctcacgtcctccgtacgtccctccctccgtcccgtccgtacccgttcggaccgccggccccggtccctacctacttccgtccgtaggtaccgtacggttactaacggtaacctaaaccggtcctttaagtacttaacgtagtttacgaaaccgtaaaccggtaaaccttaccgttaacgttaggttaacgtttcggttaacgacgtacggaacggaccggaccgtaccgttaaccctaacgttaaccggaaccggttacctaaaccgttttaaagttttaaccggttacggttttaacccggaaacccgggtttactaccgggttacccgggaccgtaaaacggtaccgtaacgttacgttccggaacggtacgggtaaccggtcgggtacgggtaccggaacccggtactaacggtttaacaaccgtttactaaacctaaacggttaaagaaaccgtacggtaacggacggggttaagggacgggtacgtaggttaacggtaaggggttaggttttcggggtttaacggtttataccggtgtaacgtagtacgaacgaaaccgtactacccggtacgtaccgttacccgtttacgtaccgtttaaccggcggggtaccgtaaacgggaccctaggaccggtaagaacccgttagtaaacccgtaacggtcggtccgtacgacgttaccgacttaactcggttcttcccgttacg

SEQ ID NO: 197186 - DNA, 631 bp, Homo sapiens
  misc_feature: GYAE6OF01EPPAP.39.81.H04.1.454.CMB.1.raw
  modified_base (357)..(357): a, c, t, g, unknown or other
  misc_feature (357)..(357): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttcgtggttaccacctttaccaactatggtatcaggttggtgcgacaggccctggacaagggcttggagtggagtggggatggatcgagcgtacttacgaagtggtacaacaacaaacgtancgacacgaagacccgtaccgagggaccaaggtacgtaccaaccgtatcggaaacccaacgaacgaaccacacttacccgaacggacgacccgaaccggaccctaacgagtaccggaccgtaggacgggacgcccgtagacgactgtacgaaccgacgaccggtccgtagttacttacgtgcgacgagacggtaggtacggggttaaattggtttacgaacgttcggtacccttcgtttacggacttacggacgggaccgacgggtcccgtacgg

SEQ ID NO: 197187 - DNA, 645 bp, Homo sapiens
  misc_feature: GYAE6OF01AZAHX.39.81.H04.1.454.CMB.1.raw
  modified_base (329)..(329): a, c, t, g, unknown or other
  misc_feature (329)..(329): n is a, c, g, or t
  modified_base (433)..(433): a, c, t, g, unknown or other
  misc_feature (433)..(433): n is a, c, g, or t
  modified_base (587)..(587): a, c, t, g, unknown or other
  misc_feature (587)..(587): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttactaccttaccaactatggtatcagttggtgcgacacggccctggacaagggcttgagtggagtgggatggatcgagcgcttaanatcggtacacaacaaactatcgacacacgaacctccgagggcagtactacacagtacgaccacacgaacacgactacccgacgacgaccgaccggtaccctaanacgttacgggaccctagggacgggacgtccgtagaacgtctcgtacggaccgaacgaccggtacggtagttaacttacgtggtacgacggtaagacggtaacggtaaccggggtaaattttacgtttacggaccgtttaccggttacccgtttntttacgggtaaccgttacgggacccggggtaccgtaaccggggttaaccccgtacggg

SEQ ID NO: 197188 - DNA, 695 bp, Homo sapiens
  misc_feature: GYAE6OF01CP67L.39.81.H04.1.454.CMB.1.raw
  modified_base (526)..(526): a, c, t, g, unknown or other
  misc_feature (526)..(526): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgagccgtgggcctcagtgaaggtctccgtgacaaggtcttcgtcggttacctacctttaaccgaactagtggtatcgtaggttggtcgacgacgacggtccccgtaggaccgaagggtcttaggaggtaggaggtagggagtggacgtcgaggccgtagttaacgagttggtacacgtaaacaactagtacgaccgaacgaacgtaacccgtcggaacgggtacaaggacgtaccaaccgtagtaccgaacctaacgaacgacaaccgtactaacccacggtacgaccgaccggaccttacggagtaccggacgtagacgggaacncgtagacgcgtacgacgtacgaccggtacgtcggttacttagttaacgtcgggtacgacgggtaagtacggaacgggttacggttaaagttacgtttacggacgtttaccgttaccgttacgttacgtacggtaccggtcgggaacccgtacgggtcccgttacccggg

SEQ ID NO: 197189 - DNA, 761 bp, Homo sapiens
  misc_feature: GYAE6OF01DIZUR.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtggggcctcgagtgaaggtcctccgtgacgaaggtcttcgtggtttaacctaacccttttaaccaaacgttagttaggtaacgttacgtaggtttcgggtacgacgtaaccgacggtcccccgttaggaaccgaacggggtcttaggaggtggaggtgggagtggatcgagcgtacgttaacaagtggtaccaacgaaactaaactagtacgaccaacgaacgaacccgtcggaacggacgaagacgtaccgactacgacgtaaccacgaacgaacaccacgtaaccacgaacgaccgacccggtacctaacgaacggtcggaccgtaggaacggtacgcttaaggaacgttactcgtaacggaaccgaaccggtaccgggtaccgtttagttaacgtttacgtagggtaccgaacggtaacggtaggtaaccggttaaacgggggttaaacttttcgggttttaacgtaccggttttaccggtttaaccccttggtttaaccgtacgttaccgggaccggggtaccccggtaacgggtaccccgtttacgggg

SEQ ID NO: 197190 - DNA, 718 bp, Homo sapiens
  misc_feature: GYAE6OF01AJHUP.39.81.H04.1.454.CMB.1.raw
  modified_base (564)..(564): a, c, t, g, unknown or other
  misc_feature (564)..(564): n is a, c, g, or t
tcagtcgcactagtcacgaccggtgctcgatttagtagtgtagattcgcggggacccaaaaaccacaacccctccttgggagaatcccctagatcacagctccgtccaccatggactggacctggagcatccttttctggtggcagcaacaacgaggtgcccactcccaggttcagctggtacagtcctggagctgagatgacggaagccgtgggacctcgagtggacgtctctgcaaggtcttcgtcgttactaccttaccaactatggtactcgtaggttgggtgcgacgacggaccccgtaggaccaacgggtcttggagtacggtagtcggggtatcgggatcgacggtcgaccgtttacgaagtcggtaccaaactaaccgtaaactacgtaggaccaacctaacgggtaacccctccggaaggggaaccctaggaccgttaaccgacctacgttaccgacctaaccgacgaacctaccactacccgaacgacgaccgtaccggtacctacacgtaggtaccctggaacggactccgtaggacgtacgactacggaccncggtaaccggccgttagtacgtttacggcgtacggaccggaagtagggtacgtaaccgggtaaagtttcggttagtacggttacccgttaacccgtttcgttacgttaaccggtacggttaccggggaccgttaaaccgggtcccgttacccgg

SEQ ID NO: 197191 - DNA, 710 bp, Homo sapiens
  misc_feature: GYAE6OF01EPIHL.39.81.H04.1.454.CMB.1.raw
  modified_base (278)..(278): a, c, t, g, unknown or other
  misc_feature (278)..(278): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaagtctctgcaggcttcgtggttaccacctttacaacttatggtatcgaggttgggngcgaccgcggtccctaggaacgagggtcttggaggttgggagtggggatgggatcgacggccgtacgtttaacaagttacgggtaccaacgtaaactaaacgtagtacgacaaaccgaacgtaaccctccggaagggacaacggtaacgtcccaaacgtaacgtaccgaaaccacgaacgtaaccaacaactacccgacgaacgacccgaaccggtaccctaacgtagtaccgggtacgtacggacggtacgtcccgtaggaacgttactaccgaacggaaccggtaccggaccgggtccgttaacgttacgttaacggtggtacggcggtaaaggtacggtagggtaacggggttaaatttcggtttaacgtacgttacggtccctttaggtacgttacgacgggttcggaccgggtacggtcccggtacg

SEQ ID NO: 197192 - DNA, 674 bp, Homo sapiens
  misc_feature: GYAE6OF01CGBK6.39.81.H04.1.454.CMB.1.raw
  modified_base (383)..(383): a, c, t, g, unknown or other
  misc_feature (383)..(383): n is a, c, g, or t
  modified_base (517)..(517): a, c, t, g, unknown or other
  misc_feature (517)..(517): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtgggcctcgagtgaaggtctccgtgacgaagtcttctggttacctacctttaccaatagtgtatcgtaggttgggtgcgacgacggcccctaggaacgaacgggtcttggtaggtgggtagtggggtacgtggtagtacgacgcgtacgttaacagtcgtacaccaactaaactanacgacaacgaccgtaaccgtaccgacgggacgaaggacgtaccacacgtaccgaacccacgaacgaacaacctcgtacccaacgggacacccgacgtaacctacaacgcgtacgtagagtcgacgtagtaacgntcggtacgacgaccggccggacgttttagactttcggaggtaccgaggaaggaagttacgggaaaggttaacgtttaggtttagtacccggtaccggtttccttacgtttaggaccttaccgggggacgggtaccgtacccggggtcgttacccggg

SEQ ID NO: 197193 - DNA, 701 bp, Homo sapiens
  misc_feature: GYAE6OF01E3P3E.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcaggttggtgcgacaggcccctggacaaggcttgagtggatgggatggatcggcgcttacatggtcacacaatatgacacacgaacctcgaggcagacgtaccacctactcgaaccacgaacgaccactactacccgaacgacggaccacccgggcccttaacacgttacgggaacccgttagggaacggacggacccgtaggaacgtacgtccgtacgggaaccgtacccggaaccgggtaccccggttaggttaacttttaaccgtggttcggacggtaggaacggtaacgggttaaccgggggtaaaattttacggttttacggaaccgtttaccggggtttaaccccctttgttttaacggtaaccccgttacgggttaccggggggtaccccggtaaacgggggttaacccccgttcgggggtaacccccg

SEQ ID NO: 197194 - DNA, 705 bp, Homo sapiens
  misc_feature: GYAE6OF01DRPN0.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaacggtctcctgcaaggcttctggttactaccttaccaactatggtatcgaggttggtgcgacgacggcccgtggaacgaagggtcttaggagtgggagtgggatggatcgagccgtacttacaagtcggtacaacaaacctaaactagtagacaacgaacgtaacccaccggaaggggacacggtaacgtaccgaacctaagtaccgaaacccaacaacggaaccaacgtaacctacccgaaacgcgaccgaaccggacctaacgacgtacggacctaggacgacgacccgtagacgtacgtcgtacggaaccgacgaccgggtcgtagttaacgttacgttcggaggtacgaaaggtacgggtaacggtaacggggttaaatttacggttttacggtaccgttttccgggttaacccctttaggtttaaccgtaccggttaacggtccgggggaaaccccgtaccggggtaacccgttccggg

SEQ ID NO: 197195 - DNA, 650 bp, Homo sapiens
  misc_feature: GYAE6OF01BB0XZ.39.81.H04.1.454.CMB.1.raw
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttaccacctttaccaactatggtatcaggttgggtgcgacgacggcccctggacgaagggcttggagtggagtgggactggatcgagcgtacttaacgaagtggtacaacaacaaactatcgacacaacgaaccctcgagggacagacgtacaccagtacgaaccacgacgaccaacactaccaacgacgaccgacggaccctacgacgtcggaccgtgacggacgcgtagaagtacgtcgtacggaaccgacggtacccggaccgttagtacttacgtcggtagacggtaggtaacggtacggtaacggggtaaatttacggtttaggtaccgtttaccggttacccgtttacgttacgtaccgtaacgggtccggggaacccggtaaccgggacccggttaccggg

SEQ ID NO: 197196 - DNA, 790 bp, Homo sapiens
  misc_feature: GYAE6OF01CFF8T.39.81.H04.1.454.CMB.1.raw
  modified_base (192)..(192): a, c, t, g, unknown or other
  misc_feature (192)..(192): n is a, c, g, or t
  modified_base (280)..(280): a, c, t, g, unknown or other
  misc_feature (280)..(280): n is a, c, g, or t
tcagtcgcactagtcacgaccggtgctcgattttagtagtgtagattcgcgggggacccaaaaaccacacccctccttgggagaatcccctagatcacagctcctcaccatggactggacctggagcatccttttcttggtggcagcaacaacgaggtgcccactcccaggttcagctggtacagtctgganctgagatgaacgagccgtgggcctacgagtgagtcctctgacagtcttgtacgttactacctttacaactgtgtactcgtaggttggnaccgacgacggcccgtaggaacgagggtcttaggaggtgggtacgtgggaagttggtatcgacggtcgtacttaacgtagttcggaccaaacctaacgaaacgttagacgaccaacgaccgtaacccgcgacgggtacgacgtacgtccaaccgctaccgacccgaacctacgaccgaactccgtaccggaaccgtaacgcccggtaaccgtacccgacgtaaacggtcccgggaaaccgtacggaacggtcccgtccgtaacggtaagttcccgtacggttaaccgaacccgggtaccggaacccgggtttccgttaaggtttaccggttaacggttacggtcgggtaaccggtaacgggtaaagggttaccgggttaaaccggggttaaagttttccggtttaacgggtacccgtttaaaccgggttttcccctttaaggtttacccggtaaccgggttacccgggttaggggacccccggttaaaccgggttaacccgtaccccggg

SEQ ID NO: 197197 - DNA, 632 bp, Homo sapiens
  misc_feature: GYAE6OF01DILS7.39.81.H04.1.454.CMB.1.raw
  modified_base (188)..(188): a, c, t, g, unknown or other
  misc_feature (188)..(188): n is a, c, g, or t
  modified_base (428)..(428): a, c, t, g, unknown or other
  misc_feature (428)..(428): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttctggtggcagcaacaacaggtgcccactcccaggttcagctggtacagtctgganctgagatgacgaagcctgggcctcgagtgaaggtctccgtgcaaggtcttctcggttacaccttacaactatggtaatcgtaggttggtcacgtacgcggtccctaggacaagggtcttaggagtaggacgtgggattggatcgacggtcgtacttaacgaagtcggtaccaactaacgtaaagtcgtacgactaaccgacgtaacccgtccgaagggactaaggtacgtccaaacgtanacggaacccaagaacgaactacctaacgtacccgaagacgccgaaccggtacctacgagtacgggacctagggacgacgtacgtagagtacctgacggaaccgcgtacggtcgttatactagtgacgtagagtacgacgtaggtaattgttagtacgttcgttacctgtacgtacggttacgacgggccttacggcgttaacgg

SEQ ID NO: 197198 - DNA, 726 bp, Homo sapiens
  misc_feature: GYAE6OF01BEP50.39.81.H04.1.454.CMB.1.raw
tcagtcgcactagtcacgaccggtgctcgatttagtagtgtagattcgcggggcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttactacctttaccaactatggtatctaggttgggtgccgacgacggcccctaggacgaagggtcttgaggtggagtgggatggatcgaggcgtacttaacgagttcggtaccaacaacgtaaactagtacgacaacgaacgtaacccgtccggaacgggacacggtaacgtccaaccagtaccgaaccaacgaacgaccacgaaccgtacccgaacggaacgcccgtaaccggccttaacgacgtacggaccgtacgggaacggaccgtccgtaggaacgtcgtaccgtacggaaccgtaccggaccgggttccgttagttaacttacgtggtacgacggtaaggagggtacgttaacgggtaaattttacggttacggaacgtttaccgttacccgttaccgtttacggaaccggttaccgggaccggggtaccccggtaacggggttaccccgttccggtacccgttacccgttacccgttacccggtaccctaccggtccccgtaaccccgg

SEQ ID NO: 197199 - DNA, 552 bp, Homo sapiens
  misc_feature: GYAE6OF01BBXLV.39.81.H04.1.454.CMB.1.raw
  modified_base (442)..(442): a, c, t, g, unknown or other
  misc_feature (442)..(442): n is a, c, g, or t
  modified_base (530)..(530): a, c, t, g, unknown or other
  misc_feature (530)..(530): n is a, c, g, or t
tcagtcgcactagtcacgaccggtgctcgatttagtagtgtagattcgcggggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttggtgcgacaggcccctggacaagggcttgagtggatgggatggatcagcgcttacaatggtcacacaaactatgcacagaacctccagggcagagtcaccatcgaccacagacacatccacgagcacggcctacatcggacctggaggagcctagagatcgtgacgacgacggccgtgtattaacgtgtgcgagagagtacgggaaattatttgacttcgggtacccttntttacgactacgtcggggaccacgggaccctcggtacacccgtctccgtcacgtcctccaccgacggcccagtcccggtccttccccnggccctaccccgtcgtaacccg

SEQ ID NO: 197200 - DNA, 659 bp, Homo sapiens
  misc_feature: GYAE6OF01BSFZ4.39.81.H04.1.454.CMB.1.raw
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacgaggcccctggacaaggcttggagtggagtgggatggatcgagcgtcttacagtcggtacacaacaaactatcgacacgacgacctcgaggacagacgtcaccatacgaccacagaccacactacccgacgacgaccgaccggacctacgagtacgggaccctaggacggtacgtccgtagacgtagtccgtaggaccgtaccgaccgggtccgttaggttacttacgtggtacggccgaaggtacggtacgggttaacggggttaaacttttcggtttacggtaaccggtttccgggtttaccccttcggttttaaccggtacgtttaacccggggtacgggggtaccccggttaacggggtaccccgttacccgggg

SEQ ID NO: 197201 - DNA, 603 bp, Homo sapiens
  misc_feature: GYAE6OF01CJMN5.39.81.H04.1.454.CMB.1.raw
  modified_base (257)..(257): a, c, t, g, unknown or other
  misc_feature (257)..(257): n is a, c, g, or t
  modified_base (358)..(358): a, c, t, g, unknown or other
  misc_feature (358)..(358): n is a, c, g, or t
  modified_base (390)..(390): a, c, t, g, unknown or other
  misc_feature (390)..(390): n is a, c, g, or t
  modified_base (416)..(416): a, c, t, g, unknown or other
  misc_feature (416)..(416): n is a, c, g, or t
  modified_base (450)..(450): a, c, t, g, unknown or other
  misc_feature (450)..(450): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtcgcccactcccaggttcagctggtacagtctggagctgagatgacgaagcctggggcctcgagtgagtctcctgcagcttctggttacacctttacaactntggtatcaggttgggtcgcgacgacggccccgtaggacgaagggtcttggagtggagtgggattggatcgagcgtacttacgaatcggtacaacaaaactntgaccacaacgacctcgaaggcagacgtcacntacgacacagacacactaccacgacncgacgcctagacgtcgaccgtggacggactacgngaagtactagacgaacgacgaccggtaccgtgttacgttacgtagtcggagtagaggtacggtacggtaaatttcgttcgtacgtttaccggtaccgttacgttacgtacgttacggtacgggaccggtaacggttacccgtggttaccccgg

SEQ ID NO: 197202 - DNA, 731 bp, Homo sapiens
  misc_feature: GYAE6OF01APEVG.39.81.H04.1.454.CMB.1.raw
  modified_base (149)..(149): a, c, t, g, unknown or other
  misc_feature (149)..(149): n is a, c, g, or t
  modified_base (153)..(153): a, c, t, g, unknown or other
  misc_feature (153)..(153): n is a, c, g, or t
  modified_base (191)..(191): a, c, t, g, unknown or other
  misc_feature (191)..(191): n is a, c, g, or t
  modified_base (618)..(618): a, c, t, g, unknown or other
  misc_feature (618)..(618): n is a, c, g, or t
tcagtcgcactagtcacgaccggtgctcgatttagtagtgtagattcgcggggacccaaaaaccacacccctccttgggagaatcccctagatcacagctcctcacaatggactggacctggagcattccttttcttggtggcagcaanaacnggtcgccactcccaggttcagcgtggtacagtctgganctgagactgacgacgtccgtgggcctgagtggagtcctcctgacgaacgtcttcgtggttaccaaccctttacgacttagtaggttactccgtagggttcggtacgaccggtaacctaccggtcccgtaggacgtaacggttccttgggaacggtggtacggtaggacgttcggaacgttccggaagtcccgtacgttaacaaggtttcgaaccaaacgtactaaacgtgtccaaccgtaactaccgtaaccggttaccggcggggtaacacggttaacgccgtaacgaccggttaccgaaccttaaggaccgtacaacctacgtaccgaccgtacgaacgtccgtaaccgtacgtcggttaccgaccggtacggtcgaccgtcttacgagtcacgtagaccgtaacgcgtaccgtagtacttacgngtacggacgtaaggtaccgtaggtaacgggttaagttccgtttagaccggttacgttaccgtaccgttaggttaccgaacgggttcccggagttacccggggttatacccggg

SEQ ID NO: 197203 - DNA, 762 bp, Homo sapiens
  misc_feature: GYAE6OF01D4NAA.39.81.H04.1.454.CMB.1.raw
  modified_base (161)..(161): a, c, t, g, unknown or other
  misc_feature (161)..(161): n is a, c, g, or t
  modified_base (345)..(345): a, c, t, g, unknown or other
  misc_feature (345)..(345): n is a, c, g, or t
  modified_base (537)..(537): a, c, t, g, unknown or other
  misc_feature (537)..(537): n is a, c, g, or t
  modified_base (682)..(682): a, c, t, g, unknown or other
  misc_feature (682)..(682): n is a, c, g, or t
  modified_base (705)..(705): a, c, t, g, unknown or other
  misc_feature (705)..(705): n is a, c, g, or t
  modified_base (723)..(723): a, c, t, g, unknown or other
  misc_feature (723)..(723): n is a, c, g, or t
tcagtcgcactagtcacgaccggtgctcgatttagtagtgtagattcgcggggacccaaaaaccacacccctccttgggagaatcccctagatcacagctcctcaccatggactggacctggagctacttccttttcttggtggcagcaacaacgaggtcncccactcctaggttcagccgtggtacagtcgtggagtcgtggagatggaacggaacggccgtcggggcctcggagtaggaacggtctccgtgacgtagtcttcgtacgttaacctacctttaacaacttgtggtactcgtaggttcggtacacggtacgacggtcccgtaggacgtaacgggtnttaggacggttggagtcgggtagtacggactcggtacgtaccgtacggttaactacggtacggtaacccaaacgtaaccgtaaaggttacgaccgtaaccgaacgttaaaccggacccgtaccgggtaagggtaccgaacggtaccgttaaccgaaaccgttacgaaccgaaccgactaacggaacccctanaacccgtaccggaacgaccggtacccgaacccgtaccgtaacgacggttcggaaccgaggtaccggaactccggtagacgtacgttcgaaccggttaggacccgtaggtccgttaagttacgtggtacggtacggagttaacggngtaaaggtaccggttatttcggngtaccgttcgtaccgttntaccgtacggtacggtaggccggttaacggtaccgtcgg

SEQ ID NO: 197204 - DNA, 724 bp, Homo sapiens
  misc_feature: GYAE6OF01BKU0R.39.81.H04.1.454.CMB.1.raw
  modified_base (189)..(189): a, c, t, g, unknown or other
  misc_feature (189)..(189): n is a, c, g, or t
  modified_base (613)..(613): a, c, t, g, unknown or other
  misc_feature (613)..(613): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttctggtggcagcaacaacaggtcgcccactcccaggttcagctggtacagtctgganctgagatgacgagccgtgggcctcagtgaaggtctctgcaaggtcttacgtcggttacctacctttaccaatagtggtatacgtaggttgggtgaccgacgtaccggtccctaggaacgtaagggtccttaggaggtggtacgtggggattagggacttcgagtccgtacgttacgaagtcggtaccaacgtaactaaacgtcgtacgacctaacgaaccgtaaccgtccggaaggtaccaacggtacgacccaacgtactacgaaacccgacgacgtaacctacgtactaacccgaaggtccgactaaccccgggttaccaacggtacgttaaccgggaacccgttagggaccgtaacggtcgttaacgacgtacgttccgaacgaaccggtaccgaacggtccgttaattacgttacgcggngtaacgaggtacgtagggttaaacggtatttacgggttacgacgtttccgggtacctttaggccggtaacgttacgggtaccggaccggttaaacccgggccgttacccgg

SEQ ID NO: 197205 - DNA, 798 bp, Homo sapiens
  misc_feature: GYAE6OF01BF9M5.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactgtacctggagcattccttttcttggtggcagcaacaacaggtcgcccactcccaggttcagctggtacagtctggagctgagatgacgaagccgtcggggcctcgaggtgaaggttctaccgtgacgaggtcttcgtacggttacctaacctttacaacttgtaggtactcgtaggttgggacgacgtacgacggcccgtagggacgaagggtcttaggaggtggagtgggagtggtatacgacggtcgtacgttaacagttcgtacaacgaactaaaacgtcgacgtaaccaacgaaccgtaacccgtcgggaacgggacaacgggtaacacccgaaaccgtacgtaaccgaaacccaacggtaacaaccaacgtaaccgtacccgaacgggtaaccgacccgtaaccggtacctaacgtaacggttacggaccgtagggacggacgtaccgtagacgtacgtaccgtacggaacctaacggtacccggtacttaggttaacgttcggacgggtaccaagggtaacggtaaggttaaccgggttaacgggtttaaaagttttaccgtttaaccgggtaaacccggttttacccggttaccccgttttaacggttacgggttaaacccggttacgggttaaccccggggtaaccggttaaacccggggttcccggttacccggg

SEQ ID NO: 197206 - DNA, 740 bp, Homo sapiens
  misc_feature: GYAE6OF01A038V.39.81.H04.1.454.CMB.1.raw
  modified_base (293)..(293): a, c, t, g, unknown or other
  misc_feature (293)..(293): n is a, c, g, or t
  modified_base (300)..(300): a, c, t, g, unknown or other
  misc_feature (300)..(300): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagcctggtacagtctggagctgagatgacgaagccgtcgggcctcagtggaaggtctcctgcaaggtcttcgtcggttaaccaccctttaccaacttatggtatcgtaggttggtgcgacncggcccnggacaggtctgagtgagtgggatggatcgagcgtacttacgagtcgtacaaccgtaacaaactagtacgaacaacgaacgtaaaccctcggaacggacgaacggtacgtaccaacccgacgtaccggaaaccacccgaagacctaaccgaaccgttacccgaaacgacggtaacccgaacccggtaccctacgtaacgtaccggtaccgtaagggacggaccctaccgtaggaacgttacttacgacgtaacggttaacggacccggaccggtttaccggttaagttaccgtttagaccggtaggaccggttaaggtaacggaaacggtttaccggggtttaaaatttcggtttacgttaaccgttcccggtttaaccccgtttagttaccggttaaccgttacggggtacccggggtaaacccgtacgggtaacccccg

SEQ ID NO: 197207 - DNA, 956 bp, Homo sapiens
  misc_feature: GYAE6OF01CLNMJ.39.81.H04.1.454.CMB.1.raw
tcagtcgcactagtcacgaccggtgctcgatttagtagtgtagattcgcggggcacccaaaaaaccacacccctccttgggagaatcccctagatcacagctcctcaccatggactggacctggagcatccttttcttggtggcagcaacaacaggtgcccactcccaggttcagctggtacagtccgtaggactcgtagagtactaggaacgaacgccggtacgggcctacgtagtaggtacggtcctccgtgacgtaaggtccttgtacggttacctaccttaacaacttgtagtactcgtaggttgggtacgaccgaacgtacccggtacccgtaggaaccgaacgggttcgtggtaacggtacgggtaaggtacggggttatagggtacctacggacggtaccgttaacgtttaaacgtaacggttcggtacccaaaacggtaaaccttaaaaacgttagtaacggtaaccctaaacggtaaacccgaaaaccccggttccggaaacgggtactaaacgggtacgtaaaccccgtaaacgttaaccgtaacccgtaaaccccgtaaacgtaaccgaaaccctaaaccgtaacccggttaacccgtaaacccgggaacgtaccccggtaaccccgggtaaaccttaaaccgtaaccgggttaccgggtacccgtaagggtaaccggaaccggtcccggttaagacgttaacgtcggtaaccggaaaccggacccggtaacccggggcggtttttaacttaaaccggttacgttaccgggaacgggtaaccggtaacgggaaaggtttaacggggtaaacgggggttttaaaactttttacggttaacggtaaacccggggtttacccttaacccgttttacccggtttaaacgaacccgggttaaccggggtaccccggggtaacccgggtaaacccgggtttaaccccccgg

SEQ ID NO: 197208 - DNA, 709 bp, Homo sapiens
  misc_feature: GYAE6OF01A1HXF.39.81.H04.1.454.CMB.1.raw
tcagtcgcactagtcacgaccggtgctcgatttagtagtgtagattcgcggggcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttcgtggttacacctttaccaactattggtatcagttgggtgcgtacaggcccctggacaagggcttggagtggagtgggatggatcgagcgacttaacaatgtacacactaaactatgacacacgaacctcgagggcagacgtacaccgatcgaccacgagacacactaccgaacgacgccgacggacctacgtagtccggaccgtaggacgggacgtaccgtaggaacgtactccgtaccggtaaccggaccgtaccgggtaccggtttcgttaactttaccggttaggtaccgggtacggaaggaacgggttaacggttaaccgggggttaaaatttcgttttacggaaccgtttccgggttacccctttacggttttacgaacccgtttacgggtacccggggggtaacctaaaccgggggtaacccccgtttacggggtaccccgttaaccccggtttccttaccccgttaccgtaaccggtcccccgttaaaccccggg

SEQ ID NO: 197209 - DNA, 703 bp, Homo sapiens
  misc_feature: GYAE6OF01CHR81.39.81.H04.1.454.CMB.1.raw
  modified_base (125)..(125): a, c, t, g, unknown or other
  misc_feature (125)..(125): n is a, c, g, or t
  modified_base (217)..(217): a, c, t, g, unknown or other
  misc_feature (217)..(217): n is a, c, g, or t
  modified_base (361)..(361): a, c, t, g, unknown or other
  misc_feature (361)..(361): n is a, c, g, or t
tcagtcgcactagtcacgaccggtgctcgatttagtagtgtagattcgcgggggacccaaaaaccacacccctccttgggagaatcccctagatcacagctcctcaccatggactggacctggancattccttttcttggtggcagcaacaacaggtgcccactcccaggttcagctggtacagtctggagctgagatgacgaagccgtggggcctnagtgaaggtctctgcaggcttctggttactacctttacactatgtatcgtaggttggtgacgacgacggcccgtaggacgaaggtcttggagtggagtgggatgggatcgaggcgtacttacgagtcgtacaacaactaaactntacgaccaagtaacgaacccgtcggaggacgaagtacgtacgaacctagtaccgaccaacgacgaccaacgtactaccgaacgacgaccgaaccggtacctaacgacggtaccggacctagggaacggacgacgtagacgtaccgtacgtacggacccgtaacgtaccgggttacccgttagttaaccgtttacgtcggtacggtaacggtaacggtaggtaaccgggttaaacggggttaaaattttacgggtttaccgaacggtttccggtaacctttcggttaaccgtaaccggtttaccgggtacgggtaccccgttaacggggtaaccccgttccgg

SEQ ID NO: 197210 - DNA, 715 bp, Homo sapiens
  misc_feature: GYAE6OF01DOZSE.39.81.H04.1.454.CMB.1.raw
  modified_base (124)..(124): a, c, t, g, unknown or other
  misc_feature (124)..(124): n is a, c, g, or t
  modified_base (184)..(184): a, c, t, g, unknown or other
  misc_feature (184)..(184): n is a, c, g, or t
  modified_base (192)..(192): a, c, t, g, unknown or other
  misc_feature (192)..(192): n is a, c, g, or t
tcagtcgcactagtcacgaccggtgctcgatttagtagtgtagattcgcggggacccaaaaaccacacccctccttgggagaatcccctagatcacagctcctcaccatggactggacctggancattccttttcttggtggcagcaaacaacaggtcgcccactcccaggttcagctggtacngtctgganctgagatgacgaagccgtgggcctcgaggtgaaggtctccgtgaccgaaggtctttcgtacggttacctaccttttaaccaacgttagtcggtatcgtaggttgggtgacgacgacggtccccgtaggacgaagggtctaggaggtggagtgggatggactcgacgcgtacttacgaagttggtaccaacaactaactgtacgacaacaacgtaaccctcggaacggtacagacgtcaccgactacgaaccgacgaagaccaacgtaccgtaccgaacgtacgaccgtaacccggacctaacgtacgtccgggaaccgtaggaacgggacctccgacgacgtcgttaccgacggaaccgtaccggaccggttacgttcgttaaccgttgtggtacgacgggtaacgacggtaacgggttagggtaaaacgttttcgttaggtaccgttaccgggttacccctttggttacccggtaacgttacccgggtacgggtaacccggtaacgggtcccggttaccggg

SEQ ID NO: 197211 - DNA, 771 bp, Homo sapiens
  misc_feature: GYAE6OF01EHK1X.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtgggcctcgagtgaaggtctcctgcgagtcttctggttactaccttacaacttagtggtactcgagttgggtgtccggacgacggtccccgtgggaacgtaagggtcttaggaggtggagtggggtagtaggatcgaggccgtacttaacgagtggtaccaacgaacctaaactagtacgaccgaacaacgtaacccgtaccggacgggcaaggacgtaccaccgacgtacgaacccacgaacgaaccacctaacgtacccgaacgtaacgacccgtaccggtaaccctacggtaacgtaccggtaaccgtagggaacgggtacgtcccgtaggaacgtactacgtaacggaaccgtacggtacccggtacggtttacgttacgtttacggtacggtacggtacgggtaaaggtacgggtaagggttaaaccggggttaaactttttaacgggttttacggaaaccccgttttccgggttaacccttttccggtttacggtaaccgggttacccgggttacccggggtacccgggttaaacccggggttccccggttaccccggg

SEQ ID NO: 197212 - DNA, 668 bp, Homo sapiens
  misc_feature: GYAE6OF01CINWI.39.81.H04.1.454.CMB.1.raw
tcagtcgcactagtcacgaccggtgctcgatttagtagtgtagattcgcggggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcaggttggtgcgacacggcccctggacgaaggtcttgagtggagtgggatggatcagcgcttacaagtggtacaacacaaactatgaccacaacgaacctcgacgggcagacgtaccacatacgaaccacgagaaccacactaccacgacgaccaccggacctacagtacggaccgtagacgggacgtccgtagagtacgtcgtacgaccggaaccgaccggtccggtagttacgttacgtgtaggacgaggagtacggtaagggtaatttagtttacgacgttccgttaccgttcgtttacgacgttaccgggtcggggaccgtaccgggtaacccgttcggtacccgtaccgttccgtaccgtccgaccggtccctacccggaacccgtaaccgggtaccctaccggttcccggtttcccccttaccccggtccgaccccttccccgtcccgtaacccgg

SEQ ID NO: 197213 - DNA, 798 bp, Homo sapiens
  misc_feature: GYAE6OF01BODXA.39.81.H04.1.454.CMB.1.raw
  modified_base (359)..(359): a, c, t, g, unknown or other
  misc_feature (359)..(359): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtcgcccactcccaggttcagctggtacagtctggagctgagatgacgaagccgtggggcctcgagtgaacggtctcctgacaaggtcttcgtacggttacctaacctttaccaaacgttactggttatcgtaggttgggtgccgacacgggtcccgtaggaacgaagggtcttaggaggtacggagtgggacgtggtacgtacgngtacgtacttacgaagttcggtaccaacgtaaacctaaaacgttcgaacgtaccaaacgtaaaccgaaaccccgttcggaacgggacctaacggtactacccgaaccaaccgttaacaaaccccgaaacgtacgaaccaaccgaacccgtaaccgaaccggacgtaacccggtaacccgaccgtaacgtaacggttccggtaaccgtacggtaacggaccgttccggtagaacgtaccgttaccgaacgtaccggaaccgtccggtaccggtttagttaaccgttacggttgaccggtaacggagggtaaccgggtaggttaaaccgggtttaaagttttcggtttaacggtacgtttaccccggttacctttacggtttaccgaacccggtttacggggttacccggggaaccggttacccggtacggtttaccccgg

SEQ ID NO: 197214 - DNA, 638 bp, Homo sapiens
  misc_feature: GYAE6OF01E0BI8.39.81.H04.1.454.CMB.1.raw
  modified_base (282)..(282): a, c, t, g, unknown or other
  misc_feature (282)..(282): n is a, c, g, or t
  modified_base (362)..(362): a, c, t, g, unknown or other
  misc_feature (362)..(362): n is a, c, g, or t
tcagtcgcactagtcacgaccggtgctcgatttagtagtgtagattcgcgggggacccaaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtggggcctcagtgaaggtctcctgcaaggcttcgtggttacacctttacactatggtatcagttggtgcgacncggccctggacaagggcttgagtggatggggatgggatcgacggcgtacttaacgaatcggtacaactaacaaacgttangacacgaacgaacctccggaagggcagacgtacaccagtacgaaccacagaacacaactacccgacgagaccaccggacctacgacgtacggacccgtaggacggtacgccgtagacgtacgtcgacgaaccggacgaccgggccgttagttaacttacgtgacgtacggaggacggtacggtaacgggtaaattgtttaggaccgttcggtaccctttgtttaccggtaacggttacgggtaccggggacccgtaacggggtaaccccgttcggg

SEQ ID NO: 197215 - DNA, 759 bp, Homo sapiens
  misc_feature: GYAE6OF01CRXQ1.39.81.H04.1.454.CMB.1.raw
  modified_base (160)..(160): a, c, t, g, unknown or other
  misc_feature (160)..(160): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcttgggtggcagcaacaacagggtcncccactcccaggttcagcgtggtacagtcgtggagctgagagtagacgaacgccggtggggcctgaggtgaacggtctccgtggacgaacgtcttcgttacggtacctacccttaaccaactagtgtactcgtaggttgggtcgacgacggaccggtcccgtaggtaaccgagggtcgtaggtagggtggtaggtagggagtcgggtatcgacgtcgttactaacgtagtacggtacacgtaaacaacgtatacgaactaaccaacggaacccgtaccgaggtaacggacgtacgtacgaactacgaccgaacagaacacactacgaccgtacgacgaccgacggactaacggacgtcggtaggtacggaggtaccgacggtagacgttaggtacccgacggaaccggtaccgtcccgggttaagttaaccggttaggttacggttacggtaccgggtaagaaacgggttacgggtacgggttaaacggttaacggtttaggttaacccgttaaccggtttacggtttacccgttaggttacggttacgggttccggttaaaccgggccgggttaaaccccgggttcggttaaccccgg

SEQ ID NO: 197216 - DNA, 707 bp, Homo sapiens
  misc_feature: GYAE6OF01DYS1K.39.81.H04.1.454.CMB.1.raw
  modified_base (372)..(372): a, c, t, g, unknown or other
  misc_feature (372)..(372): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccatcccaggttcagctggtacagtctggagctgagatgacgaagccgtggggcctcgagtgaaggtctcctgacaaggcttctggttaccacctttaccaacttatggtatcaggttgggtgcgacgaggcccctggacaagggcttggaggtcggagtggggattgggattcgaagtcgtacttacgaagttcggtacaacgaactaaactntacgcgacctaagaaccctccgaagggcaggacgtcaccagtacgaccactaacgacacactaccgaacggagccgaccgacctacgagtacggacctaggaacggactccgtagaacgatccgtacggaaccgaaccggtaccgggtacgttagtttaaccgttagtcggtaggtacggaacggtagggtaacggttaacgggggttaaactttaacggttttacggtaaaccgggttccggtttaaaccccgtttcgttttaacggtaacccggtttaaccgggttccggggggtaaccccgtaaccggggggttaacccccgttacccgggg

SEQ ID NO: 197217 - DNA, 746 bp, Homo sapiens
  misc_feature: GYAE6OF01CGA0R.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtctcctgcaaggcttcgtggttacctacctttaccaactgtaggtatcaggttgggtgcgacacggccctaggacaagggcttgagtggtagtgggatggactgagtcgtacttaacaagttcggtacaacgaaactaaactagtacgactaaccgaacgtaaacccgtaccggaagggacctaaaggtacgtaccaacccgtaagtaccgaaacccgtaacgaacgtaaccgtaacctaaccgtacccgaaccgggaacgtacccggaaccccggtacccgtaaaccgtacggtaccggtaacccgtagggaacgggaccgtaccgtaggaacgtaacgtcgtacggaaccgtaaccggacccgggtaccgttacgttaacgttacgtacgggtacggtacggtaaggaacggtaacggttaaacgggggtaaattttacggttttacgaaccggtttcgggttaaccccttgtttacgtacgttacggtacggggtacccgtaaacgggccccgttacgg

SEQ ID NO: 197218 - DNA, 719 bp, Homo sapiens
  misc_feature: GYAE6OF01CU1SS.39.81.H04.1.454.CMB.1.raw
  modified_base (280)..(280): a, c, t, g, unknown or other
  misc_feature (280)..(280): n is a, c, g, or t
  modified_base (285)..(285): a, c, t, g, unknown or other
  misc_feature (285)..(285): n is a, c, g, or t
  modified_base (309)..(309): a, c, t, g, unknown or other
  misc_feature (309)..(309): n is a, c, g, or t
  modified_base (332)..(332): a, c, t, g, unknown or other
  misc_feature (332)..(332): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcattccttttcttggtggcagcaacaacaggtcgcccactcccaggttcagctggtacagtctggagctgagatgacgaagccgtggggcctcagtgaaggtctcctgacaaggcttctggttacctacctttacactatggtatctagtgggtncgacncgccctgacgaggctgagtggagnggagtggatacgagcgtcgttanaagtggtacaacaactaaactactgacctaacgaacgtaacccgtaccgaagggccaaggtacgtaccgacctacgtacgaccaacgacgaaccaacctactacccgaaccgtacggacccacccgggtacctaacgacgtacggtaccgtaggacggacgtcgtagacgtacttaccgacggaaccggtaccggtaacccgggtccggttagttaaccgtttaccggttaggtacggacggtaaggtaacgggtacgggtttaacggggttaaatttttacggttttaacggaccggtttcccgggttaacccctttcggtttaaccggtacgttaaccgggtccggggtaacccggtaaacccgggggttaccccgttaccgggg

SEQ ID NO: 197219 - DNA, 656 bp, Homo sapiens
  misc_feature: GYAE6OF01A7C3U.39.81.H04.1.454.CMB.1.raw
  modified_base (278)..(278): a, c, t, g, unknown or other
  misc_feature (278)..(278): n is a, c, g, or t
  modified_base (333)..(333): a, c, t, g, unknown or other
  misc_feature (333)..(333): n is a, c, g, or t
  modified_base (348)..(348): a, c, t, g, unknown or other
  misc_feature (348)..(348): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggccctcagtgaaggtctcctgcaaggcttctggttactacctttaccaactatggtatcagttgggtncgacacggcccctggacaagggcttggagtggagtgggatggatcgagcgcttanatggcagaacaactngacacgtagacctcgaggcagacgtacaccatacgaaccacgaagacaccacgtacccgagacgccgaaccggcctaacgacgtcggaccctaggaacgggtacgcccgtagacgtcgtccgtacgggaaccgtacccgaccgggtaccgttggttaacgttaccgtaggtacggtacggaagggtagtacggttacggggtaaaatttcggtttacggtaacccggtttcggttaaccccttcggttttaacggtaaccgttacgggtaccggggtaacccggaccgggttaaccccggttaccggg

SEQ ID NO: 197220 - DNA, 720 bp, Homo sapiens
  misc_feature: GYAE6OF01BPU92.39.81.H04.1.454.CMB.1.raw
  modified_base (278)..(278): a, c, t, g, unknown or other
  misc_feature (278)..(278): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcgagtgaaggtctcctgcaaggcttcgtggttacacctttaccaactatggtatcagttcgggtncgacacggccctggacaagggcttgaggtcggagtggggatgggactcgagcgtacttacgaaatgggtaccaataccgaaaactatagaccaacaacgtaaaccctccgtaagggcaaaggtacggtacaaccgaatacgaaccaacgaacaacgacaactaccgaacgaacgtacccaaccgggtaccctaacgtacgtacggacctacggaacgggacgtacgttacggaacgtaacgtccggtacgaaccggtaaccggtaacccgggaccggtttacggtaacgttttacgaggttacggaaccgtaggaacggtaacggtaacggggttaaaacgttacggtttttaacggacggtttcggtaaccccgtttagtttaccggtaaccgttacgggtacgggggtaacccgtaccgggggtaacccgttacccgggg

SEQ ID NO: 197221 - DNA, 700 bp, Homo sapiens
  misc_feature: GYAE6OF01CV98K.39.81.H04.1.454.CMB.1.raw
  modified_base (125)..(125): a, c, t, g, unknown or other
  misc_feature (125)..(125): n is a, c, g, or t
  modified_base (277)..(277): a, c, t, g, unknown or other
  misc_feature (277)..(277): n is a, c, g, or t
  modified_base (393)..(393): a, c, t, g, unknown or other
  misc_feature (393)..(393): n is a, c, g, or t
tcagtcgcactagtcacgaccggtgctcgatttagtagtgtagattcgcggggacccaaaaaaccacacccctccttgggagaatcccctagatcacagctcctcaccatggactggacctggancattccttttcttggtggcagcaaacaacaggtcgcccactcccaggttcagctggtacagtcgtggagctgagatgaacgaagccgtggggcctcgaggtgaaggtctccgtgacgaacgtcttcgtacggttacctacctttaacaactntggtatcgtaggttgggtgcgaacgccggtcccgtaggaacgaagggtcgttgaggtggagtgggtatggactcgagtcgtacttactaagtcggtacaacaaactaaactgtacncaacgaaccgaaccgtacggaacggctaagacgtacccacgtagtaacgaacctacaacgacctaactacgtacccgaacgtacgaacgaacccggtacctaacgtaacgtcggaaccgtaggaacggtacgtcgaagtcgtacgtaacgacggaaccgaacggtccggacgttagttaacgttcgtagtacggaggaaggtacgggtaacgttagggttaacgtttacggtttagaccgggttttaccgtacccgtttaggttacgtacggtaccgggtggaaccccggtagggtacccgtaccgg

SEQ ID NO: 197222 - DNA, 644 bp, Homo sapiens
  misc_feature: GYAE6OF01DP7IN.39.81.H04.1.454.CMB.1.raw
  modified_base (334)..(334): a, c, t, g, unknown or other
  misc_feature (334)..(334): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagcctggggcctcagtgaaggtctcctgcaaggcttctggttacacctttacaactatggtatcgagttgggtgcgacacggcccctggaacgaacggggtcttggaggtggagtgggaatggatcgagcgnttacaatggtacacaacaaactatgacaacgaacgaaccctcgacgggcagacgtacaccatcgaaccacgagaacacaactccaacggtacgacacggacctaacagtacggacccgtaggacggacgcgtagacgtatcgtacgacgaccgacggtccggttagttagttaccgtgtcggacggtacggtaaggacgtaacgggggtaaatttacggttttacggtaacggttccggtttaaaccccttcgttttacgaaccggttacggttcgggggtacccgaacggggttacccgttaacccggg

SEQ ID NO: 197223 - DNA, 1012 bp, Homo sapiens
  misc_feature: GYAE6OF01BZ1GY.39.81.H04.1.454.CMB.1.raw
  modified_base (219)..(219): a, c, t, g, unknown or other
  misc_feature (219)..(219): n is a, c, g, or t
tcagtcgcactagtcacgaccggtgctcgatttagtagtgtagattcgcggggacccaaaaaccacacccctccttgggagaactcccctagatcacagctcctcaccatggactggacctggagcattccttttcttggtggcagcaacaacaggtcgcccactcccaggttcagctggtacagtctggagctgagatgaacgaacgccgtgggcctnagtgaaggtctactcgacgtaacggtcttcgtacggttaacctacccttttaaccaaacttagtaggtacttacgtagggtttcgggtcgaccggaaccgaccgggtaccccgttagggaacgtaacgggtccgtttagggacggttgggtagtcggggagttggaacgtccgaggccgttacgttaagaacggtttacgggtaacctaaccgaaactaaaaccgtacgtaccgccgtaaaccgaaacgtaaccccgtacggaacgggacgtaacggtaacgccctaaacccgaacggttaaccgaacccgtaaacgaaccggtaaaccctaacccgtaaccgttaacccggtaacggacccgggtaaaccccgttaacccgggtaacccgttaaacggttaacccggtaaccggggtttaaacccgacgggggtaaacccgggtaaccggttacccccggtaaagggtaaccgttacggttaccgggtaaccgggaaaccccgggtaaaccgggttacccccgggggttaacggtttaaacgggtttaacgttttaacccgggtacgggttacccggggaacgggtttaaaccggggtaaccgggttaaaacgggggtttaacccgggggtttaaaaaagtttttccggttttaaaccgggttaaccccggttttaacccgggtttaccccgtttttaccggttaaacggtttaaccccgggttaccgggttaaccccgggggtaacccggggtttaaaccccggggttaacccgggttttaaccccggggg

SEQ ID NO: 197224 - DNA, 751 bp, Homo sapiens
  misc_feature: GYAE6OF01A0AKQ.39.81.H04.1.454.CMB.1.raw
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaacgccgtggggcctcgagtgaaggtctcctgacgaaggtcttcgtggttacctacctttaccaactatggtatcgtaggttgggtgcgacgacggtcccgtggacgaaggtcgttggaggtggaggtgggagtggatcgaggtccgtactaactagtcggtacaactaacaaacttacgtacgaccacgaaccggtaaacccctaccggacgggaacgtaggtaaccgtaacccgaaccgtacgtaccggaacccaaacgaacggaaccaaccgaacctaacccgacgaccggaccgacccggaccctaacgacggtaaccggaccgtagggacgggacgccggtagtaacgtacgtacgtaccggaccgaacgtacccgggtacgttacggttacgttacggtacggcggtacggtaacgggaacggttacggttaaacggggttaacttttacgggtttacggacggttttacccggtaccctttacggttacggttaaccgttacggggtaccgggtaacccgggtacccgggtacgttacccggg

SEQ ID NO: 197225 - DNA, 747 bp, Homo sapiens
  misc_feature: GYAE6OF01BZLHF.39.81.H04.1.454.CMB.1.raw
  modified_base (627)..(627): a, c, t, g, unknown or other
  misc_feature (627)..(627): n is a, c, g, or t
  modified_base (678)..(678): a, c, t, g, unknown or other
  misc_feature (678)..(678): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatcctttcttggtggcagcaacaacaggtgcccactcccaggttcagctggtacagtctggagctgagatgacgaagccgtggggcctcaggtgaacggtctccgtgactaaggtcttcgtggttaccacctttaccaatgtggtatcgaggttgggtgacgacgacggcccgtggacgagggtctcggaggtggagtggggtaagtggtaactcgacggtacgtaccttaacgtagttcggaccaactaaacgtaaacctagtacgacccgaaacgtaccgaaaccccgttaccggaacgggtacgaacgtaacgtaccgaacctacgtacccggaaaccaacaacggaccaacctacgacccgaacgacgaaccgaacccggaccgtaacgtacggttacccggaacgtaggtaacggtacctaaccggtacgtaacggtaactacggtaacgtaccgggaccccgttaaacggggtccccgttaattaagtttacccgngggtaacgacggtacgggtaaagtccgggtaaacgggtttattacggttanaccggtttaccgttaccgtcgtttacgtaccttacgggaccgggtacctaaaccggggcccttaacggg

SEQ ID NO: 197226 - DNA, 817 bp, Homo sapiens
  misc_feature: GYAE6OF01CID1A.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcattcctttttcttggtggcagcaacaacaggtcgcccactcccgaggttcagctggtacagtcgtggagctgagatgacgagcgtgggcctgagtggaagtcctcctgacgtaacggtcctttcgtacggtttaacctaacccgttttaaccaaacttgttacgggttattacggtagggtttgggtcgccgaaccgtaccgggtccccgtaggggaaccgtaaggggtcctttagggaggttacgggaggttggggtagtaggtacgtacgacggtaccggttacttaaacgtaaggttcggtaccaaaccgtaaacctaaaacgtgtaccgaaccgaaccgaacccggtaacccccgtcgggagggtaccgtaaacggtacgtacccgaaacctacggtaaccgaacccgaaccgtaacgtaacccgtaaccaacccgtacccgaacggaccgaacccgaccgtaaccctaacgtacgtaccggtaccgaggacggtacgaccgtagacgtcgtacgtacggaccgaccggtaccggtacgttacggttacttacgtacggacgtacggaggtacggtacggtacgggtttaatttccggtttagtaccggtttaacccggttcctttaacggttacgtaccggttaacgggtaccgggtaacccggttaccggtaaccggttacccggg

SEQ ID NO: 197227 - DNA, 675 bp, Homo sapiens
  misc_feature: GYAE6OF01AVCMH.39.81.H04.1.454.CMB.1.raw
  modified_base (513)..(513): a, c, t, g, unknown or other
  misc_feature (513)..(513): n is a, c, g, or t
tcagtcgcactagtcacgaccggtgctcgatttagtagtgtagattcgcggggacccaaaaaccacacccctccttgggagaatcccctagatcacagctcctcaccatggactgggacctggagcatccttttctggtggcagcaacaacaggtgcccactcccaggttcagctggtacagtctggagctgagatgacgaagccgtggggcctcagtgaaggtctcgtgcaaggtcttcgtcggttacctacctttaaccaacttagtggttatcgtaggttggtgccgacgacggccccgtggacgaggtcgttggacgtgggagttgggatggactcgagacgtcttaacgagtcggtacaacaccaaagtactgacctaacgaacgaccctccgaacgggccaggtaactaccacctagtacgacctacgaacgaaccacacctaccgaacgaccgaccgaaccgtaccgtaactacgtaccggaccgtggacggaccgcctagacgtntccgacgaccgaccgaccgggtcgttacgttacttcgtacggtacgagtacggaggtacggttaacgggtaaattccgtttaggtacgttacccgggttacccgtttacgttacggttacgtaccgggtacgggaccggtaaacccgggtcccgttaccggg

SEQ ID NO: 197228 - DNA, 742 bp, Homo sapiens
  misc_feature: GYAE6OF01B4KCB.39.81.H04.1.454.CMB.1.raw
  modified_base (157)..(157): a, c, t, g, unknown or other
  misc_feature (157)..(157): n is a, c, g, or t
  modified_base (190)..(190): a, c, t, g, unknown or other
  misc_feature (190)..(190): n is a, c, g, or t
  modified_base (316)..(316): a, c, t, g, unknown or other
  misc_feature (316)..(316): n is a, c, g, or t
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtncccactcccaggttcagctggtacagtctgganctgagatgacgagccgtgggcctcagtgaggtctctgacaggtcttcgtgttaccacctttacactatggtatcgtaggttggtcgacgtacgaccggcccgtaggaaccgtaagggtccttaggnggttacggaggtcggggtagtcggacgtacggacgtccgtacttaatacgtcgggtaccaacgaacctaaacgtatacgaccaacgtaacgaaccctaccggacgggtccaacggtacgtaccacctaacgtaccgaacccgtaacaaccggtaaccctaaccgtacctaacccgaccggtacgtacccggaacccggtacctaacgcgtaaccggaccgttaggaaccggtcgaccgtagacgtacgtcgaccggtaacgaccggtacccgggtacgttagttacgttacgtacggtcggtaccggtaagtcggtaacgggttaaacgggtacgttttagtaccggttacgttaccccggtttaccgtttacgttcggttaccgttaccggggtcgggtaacccgggtaacccggtacccccggg

SEQ ID NO: 197229 - DNA, 889 bp, Homo sapiens
  misc_feature: GYAE6OF01CPPHE.39.81.H04.1.454.CMB.1.raw
  modified_base (194)..(194): a, c, t, g, unknown or other
  misc_feature (194)..(194): n is a, c, g, or t
  modified_base (765)..(765): a, c, t, g, unknown or other
  misc_feature (765)..(765): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcattccttttcttggtcggcagcaaacaacaggtcgcccactcccaggttcagctggtacagtctgganctggacgtatcgacgaacgtccggtgggtcctcgtaggttgaacggttctccgtagacgtaacggtctttaccgttggttaacctaacccttttaaccgaaacttagttacgggttacttacgttaggggttttcgggtacgaccggtaccgacccgggttccccgttaagggaaccggtaacgggttccttaggtaagggtaccgggtaacgggtttggggtaacgtgggtacctacggtaccggtacggtttaaccttttaacggaacgtttccggaacctaaccgtaaaccttaaaaacccgtttgaccggaacccgtaaccggtaaaacccggttaaccccggaacccggtagggaaccccgttaacggaaccggttaacccaaacgttaagtaaccggttaactaaccgaaacgtaccgaacccttaaccaaccgttacccggaaccgtacggtaaccccgtaccgtaaccacgtacgtaaccggtacggtacggtaacggtaccgtacgtacggtaacgtactaccgtacgaaccggtacgtaccggtagttaccgtacgttcgngtacgacggaaggtacggtaacggtaagggtttaaacttcggtttaacgtcccggtttaccgttaccgtttacggttaccgtacggttaccggtaccgggtaacccgttaaccggggttacccg

SEQ ID NO: 197230 - DNA, 680 bp, Homo sapiens
  misc_feature: GYAE6OF01E3DAR.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcgagtgaaggtctcctgcaaggtcttctggttacctacctttaccaactatggtatcgaggttgggtgcgacgacggccccgtggacgaggcttgagtggagtgggatggatcgagcgtcttacgagtcggtacacaacaactatcgacaacgaacgaaccctcgaagggctaaggacgtaccaaccgatacggaacccacgaacgaacctaacaccgtacccacggaacgacccgtaaccggaccctacgaacgtaccggaccgtaggacggactcccgtaagcgtactcgtacggaccgaacggtaccggtaccggttattaacgtttccgtaggtaccggaggtaacggtaacggttaacgggttaaggggttaaattttcgtttacggacgtttcccggttaccttacgtttaccggtacggtaccgggtacggggacccgtaaccgggtacccgttaccggg

SEQ ID NO: 197231 - DNA, 761 bp, Homo sapiens
  misc_feature: GYAE6OF01C62LG.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatcgacggaacgccgtggggcctacgaggtgaaggtctccgtgacaaggtcttcgtggttacctaccctttaccaaactagttcgggtatacgtaggtttacggggtcgacgacgtaccgggtccccctaggggaaccgtaaacgggcgtttaggacggttagggaagtggggaagttgggtaactcgacggtcggtactttacgaagttcgggtacaacgaactaaactactacgacctaacgaacgtaaccctaccggacggacgacggacgtaccaacctacgacggaacccaaacgacgaacctaacgtacctacccgaaccggacgaccgtaccgtacccgtaacgacgtacggaacccgtggaacggcgtaccgtagacgtacgtaccgtaggaacccgtacggtacccggtaccggttagttaaacgtttcgtaacgggttggaaccggaagtaacgggtaacggtaccgggttaaagttcgtttacgtaccggttcggttacccttacgttacggtacccgttacgggaccgggtaaccgaaccggttccggttaccgg

SEQ ID NO: 197232 - DNA, 653 bp, Homo sapiens
  misc_feature: GYAE6OF01EFLDQ.39.81.H04.1.454.CMB.1.raw
  modified_base (376)..(376): a, c, t, g, unknown or other
  misc_feature (376)..(376): n is a, c, g, or t
tcagtcgcactagtcacgaccggtgctcgatttagtagtgtagattcgcggggcacccaaaaaccacacccctccttgggagaatcccctagatcacagctcctcaccatggactggacctggagcatccttttctggtggcagcaacaacaggtgcccactcccaggttcagctggtacagtctggagctgagatgacgaagccgtggggcctcaggtgaacggtctcctgacaaggtcttcgtggttactacctttaccaatgtggtatcgaggttcgggtgacgacgacggcccgtaggacgagggtcttggagtggagtgggagtggatcgagtcgtacttacgagtcggtacaactaacgtaaactgtacncgaacacgaaccgtcgacgggacagacgtaccactatacgaccacgacgactacactaccgaacgacgaccgacgacctaacgtacgtacggacgtcggacggtacgcgtaggacacgtacgacgaaccgacggaccggtcgttcgttaactacggtttcgacgtaccgagggtaacgtaagggttaggggttaaactttacgtttacggtaccgttacgttacccgtttacgttacgtaacggttacggtccggggtaaccgacgggttaaccccg

SEQ ID NO: 197233 - DNA, 551 bp, Homo sapiens
  misc_feature: GYAE6OF01AU9FR.39.81.H04.1.454.CMB.1.raw
  modified_base (188)..(188): a, c, t, g, unknown or other
  misc_feature (188)..(188): n is a, c, g, or t
  modified_base (238)..(238): a, c, t, g, unknown or other
  misc_feature (238)..(238): n is a, c, g, or t
  modified_base (395)..(395): a, c, t, g, unknown or other
  misc_feature (395)..(395): n is a, c, g, or t
tcagtcgcactagtcacgaccggtgctcgatttagtagtgtagattcgcgggacccaaaaaccacacccctccttgggagaatcccctagatcacagctcctcaccatggactggacctggagcatcctttcttggtggcagcaacaacaggtgcccactcccaggttccagctggtacattctgganctgagatgacgaagcctggggcctcagtgaaggtctcctgcaaggcttcnggttacaccttttaccaactatggtatcagttggtgcgtacaggcccctggacaagggcttgatggatgggatggatcgagcgcttacaatggtacacacaaactatgcacagaacctccgaggcagagtcacatgacactagacacataccacgancacggctacatggacctgagtagccgtagagatcgtgacgacgacggaccgtacgtattactgtagtcgagacgagtacggggtaaatacgttttagacgttcggtaccctacgttttcgacttacgtacggggtcccaacgggtacccgttcggg

SEQ ID NO: 197234 - DNA, 645 bp, Homo sapiens
  misc_feature: GYAE6OF01CJA0I.39.81.H04.1.454.CMB.1.raw
  modified_base (568)..(568): a, c, t, g, unknown or other
  misc_feature (568)..(568): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctgagtgaacggttctccgtgcgaaggtccttcgtacggttaacctacctttaccaactattggtactcgtaggttggtgcgacgaccggtcccgtaggacgtagggcttggagtggagtgggagtggtaagtcgacggcgtacttacgaagtcggtacaacaactaaaactgtagacacaacgtacccgtacggacgggtcagtacgtccacctagtacgaccaacgacgaacaccactacccgaacggacgccgaaccgtcccgttaacacggtacggtaacctgggacggacgacccggtagacgacgttcgacggaaccgaacgtacccgggcttaggttactcgtggagnggagaaggaggtacgggttaattcgtttagaccgttgttacccttgttacgcgtacggtgggaccgacggtccgtcg

SEQ ID NO: 197235 - DNA, 752 bp, Homo sapiens
  misc_feature: GYAE6OF01DY1KR.39.81.H04.1.454.CMB.1.raw
  modified_base (123)..(123): a, c, t, g, unknown or other
  misc_feature (123)..(123): n is a, c, g, or t
  modified_base (192)..(193): a, c, t, g, unknown or other
  misc_feature (192)..(193): n is a, c, g, or t
  modified_base (476)..(476): a, c, t, g, unknown or other
  misc_feature (476)..(476): n is a, c, g, or t
  modified_base (557)..(557): a, c, t, g, unknown or other
  misc_feature (557)..(557): n is a, c, g, or t
tcagtcgcactagtcacgaccggtgctcgatttagtagtgtagattcgcggggacccaaaaccacacccctccttgggagaatcccctagatcacagctcctcaccatggactggacctggancattccttttcgtggtggcagcaacaacgaggtcacccactcccgaggttcagctagtactgtcgtggnntagagagtcggaacgacgccggttgggcctagaggtagtaacgtcctacgtcggacgtacgtccgttcgtacgttacctaacctttaaccacgttagttcggtacttaccggtagggtttggccgaacggtaccggaccggtcccgtaaggaccggtaggttacgtggaagggttggtaggtacgggagtacggtacgacgtacgtccgttaacaacgttagtaccgaccgaactaaactaccgttaagaccgaaccgtacgaaccgtacccgacggaacggngtaacgtacccgactaccgacgtaaccgaccctaaagacgtaaccacgtaccccgtacgaaccgacgcccgtaactccganacgggtacacggtagacgaccgtcggatacgagttaccgacgacggaacctacggtaccgttagttacgcgttgacggtaacggtacgggtaaggtacggtaagtttaaggtttccttaggtaaccggtttcccgtacgtttaccggtcggtaccggttaccggaacgggtaccggtaccgtcggttaaccccgg

SEQ ID NO: 197236 - DNA, 661 bp, Homo sapiens
  misc_feature: GYAE6OF01APQXM.39.81.H04.1.454.CMB.1.raw
  modified_base (420)..(420): a, c, t, g, unknown or other
  misc_feature (420)..(420): n is a, c, g, or t
  modified_base (619)..(619): a, c, t, g, unknown or other
  misc_feature (619)..(619): n is a, c, g, or t
tcagtcgcactagtcacgaccggtgctcgatttagtagtgtagattcgcggggacccaaaaccacacccctccttgggagaatccctagatcacagctcctcaccatggactggacctggagcatcctttcttggtggcagcaacaacaggtgcccactcccaggttcagctggtacagtctggagctgagatgacggaagccgtggggcctacgagtgaacgtctctgcaaggtcttcgtggttacacctttacaatactggtatctaggttggtcgtcgacacggtcccctaggactacgggtcttgaggttcggatggggatggactcgacgtcggcttacagtcggtacacgtacaactgtacgcacgaacgtaacctcggaggctaaggtacgtacaccgatcggaactacgganacctacgactacccgagacgcgaacccggtacctaccgtaacgttaccgggaaccgtggtaacccgggaacgtccccgtaaggacgtaagtcccgtaacgaccgttaccggaccggtccgttacggttacgttaacgtccttggaaccggagtacggtaggtaccgggtaaattcggttgaacccgtgttaaccccgtnttaacggtaccgtacgtacgggacctaccgggtcttacccgg

SEQ ID NO: 197237 - DNA, 698 bp, Homo sapiens
  misc_feature: GYAE6OF01BBW03.39.81.H04.1.454.CMB.1.raw
  modified_base (309)..(309): a, c, t, g, unknown or other
  misc_feature (309)..(309): n is a, c, g, or t
tcagtcgcactagtcacgaccggtgctcgatttagtagtgtagattcgcgggcccctagatcacagctcctcaccatggactggacctggagcatccttttcttggtggcagcaacaacaggtgcccactcccaggttcagctggtacagtctggagctgagatgacgaagccgtggggcctcgagtgaaggtcctcctgacaaggtcttctggttaacctacctttaccaattatgtatctagttgggtgcgacgacggccctaggacgaagggtcttgagtggagtgggatggatcagcgtacttanaagtggtaccaacgtaacaaaactgtacgaccaacaacgaacctccgaagggccaggactaccaacactacgaaccacaacgacaacacgtaccaacgacgaccgaccgacctacgaagtcggaccgtaggaacgggacgtaccgtaggaacgtacgtacgtacggaaccgtaaccggaccgggttaccgtagtttaacgttaacgtacggttcggaaccggaaggtacggtaaaggttaaccggggttaaattttacggtttacggacgtttaccggtacccgtttacgttaacggtaccgttaccgggtacggggtacccggtaccggggttaacccgtacggtcccgtacccggttctacccgtcgtacccgtcccgtaaccccgg

SEQ ID NO: 197238 - DNA, 770 bp, Homo sapiens
  misc_feature: GYAE6OF01EH0UT.39.81.H04.1.454.CMB.1.raw
tcagtcgcactagtcacgaccggtgctcgatttagtagtgtagattcgcggggcacccaaaaaccacacccctccttgggagaatcccctagatcacagctcctcaccatggactgggacctggagcattccctttttcttgggtggcagcaacaacaggtcgcccactccaggttcagctggtactagtctggagctgagatcggaacgaacggccgtggggcctcgagtgaacggtctccgtgacgaagtcttcgtcgttactacctttacaactagtgtatcgaggttggtcgacgacgcggccctaggaacgaggtcttaggaggtggaggtagggatggacttcgaggtcgtactttaacgagttacggtacaaacgtaactaaacgtgtacggaacctaacgtaacccggtaacccgtaccggggaacggtaccgaaacggttaccgtaccgaaaccgtagaacccgtaaaccgtaacgaaaccgaacctaaccgaacccttaacggaaccggaacgggtacccgtaaacccggtaaccttaacggtaacggttcgggaaccgtacgggtaaccggctacccggtaggtaacgtacctacggtacggaacccgtaccgggtaaccggttacgttacgttaacgttacgtacgggtacgacgtaaagggtacggttaaacgggtaacggttaagtttaccgttggtaaccggttccttacgttacgttacggtacggaccgggtacggtcccggtaacgtaccgg

SEQ ID NO: 197239 - DNA, 692 bp, Homo sapiens
  misc_feature: GYAE6OF01BNH8J.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttactaccttaccaactagtggtatcaggttgggtgcgacgacggcccctggacgaagggcttaggagtggagtggggatggatcgagccgtacttacagttggtacaacaactaaactagtacgacacaacgaaccctccgagggacaaggacgtacaccatacgaaccacagaccacactacccacggacgaccgaacccggacctaacgacgtacggacccgtagggacgggacgaccgttaggacgtacgtcgtacggaaccggacggacccgggtacgttacggttacttacggtcgttacggaacggtagggtaaacggtagggttaaacggggttaaatttacggttttaggtaccgtttaccgggtttaaccctttcggtttacggtaaccgttacccgggtacgggggtaacccgtaaaccggggtaccccgttacccgggg

SEQ ID NO: 197240 - DNA, 935 bp, Homo sapiens
  misc_feature: GYAE6OF01A1QUI.39.81.H04.1.454.CMB.1.raw
tcagtcgcactagtcacgaccggtgctcgatttagtagtgtagattcgcggggacccaaaaaccacacccctccttgggagaatcccctagatcacagctcctacaccatggactggacctggagcatccttttctggtggcagcaacaacaggtgcccactcccaggttcagctggtacaggtctaggagctgagatgacgaagcctggggcctcgagtgaacggtcctccgtgacgaaggtacctttcgtacggttacctacctttaccaacttagtcggtattccgaggttcgggtcgtcgtacgacggtccccttagggaaccgaaggggtccgttaggacggtacgggagtcggggtagttcggatcgacgaccgtacttaacgaagtcggtaccaacgtaactaaaactacgtcgaacctaaccgtaacgtaaccccgttaccggaacgggtacgtaacggtaaccgtaccgaccgacgttaaccggaacccaacgtaaccgaaccgtaaccgaaccgttacccgaaccggtaaccggtaccgtaaaccccgggtacccttaaaccggaacggttaccgggtaaccccgttaaggggaaccgggtaccgtaccgggttaacggaacggttaaccgttcccgtaacgggaaccccgtaaaccgggtacccggggttacccgtttaaggttttaaaccgtttaaccgggttacggggtaacccgggtaacgggtaaaccggggttaaggtttaaaacccggggttaaacgggggtttaaaaactttttcgggttttaacccgggtaaacccggttttaccccgggtttaaaccccgttttacggttttaaccgggtaaaccccgtttaacgggggttaccccgggggtaccccggttaaaaccgggggtttaaccccctttaacccggggg

SEQ ID NO: 197241 - DNA, 816 bp, Homo sapiens
  misc_feature: GYAE6OF01CLFM6.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtcgcccactcccgagttcagctggtacagtctggagctagagagtgaacgaacgccgtacggggcctcgaggtaggaacggtcctccgtgacgaaggtcttcgtcggttacctaacctttaccaacttagtaggttactcgtaggttcggtcgacgacgtaccggccctagggaacgaagggtctaggaggtaggaggtaggatggatacgaggtaccgtacttaacgagtcgtaacaacctaaagtaaactagtaccgaacaaccgtaaaccgtaacccgtacggaacgggacaacggtaacgtacccaaaccgagtaacccgaacacgaacgtacaacctaaccgaccgaccgaacgtacccgaacccggtaccctaacgtaccgtacggaacccgtagggaaccggtaccgtacgttacgggaacgtttacgaccggtaaccgaaaccggacccggtaaccgggttccgttacggttaaacttttccggaaggtacggtacggtaaaggggtaggttaaacccgggttaagggttaaacgttttacggttttaccggtaaaccccggttcccgtttaaaccccggttagttttaccccggtaacggtttcgggtaacccggggacccggtttaacccgggacccggtttaaccccggg

SEQ ID NO: 197242 - DNA, 625 bp, Homo sapiens
  misc_feature: GYAE6OF01E12PO.39.81.H04.1.454.CMB.1.raw
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcaggttgggtgcgacaggcccctggacaaggggcttggagtgggatggggatggatcgagcgtcttaacagtggtacacaacaaactatgaccacacgaaccctccgagggcagacgtacacctagtacgaccacacgacacactacccacgacgcacgtcctaacatacggacctggacggacgtccgtagacgtactcgtacgaccgaaccgacggccgttagttacgttacgtggtacgacggagacggtacggtaacggggtaaattacgttttaggtaccggttccggtttacccgtcgtttttacgaaccgtttaccggtacggggaccccgtacggggtaaccccgttcggg

SEQ ID NO: 197243 - DNA, 706 bp, Homo sapiens
  misc_feature: GYAE6OF01B0YX0.39.81.H04.1.454.CMB.1.raw
  modified_base (560)..(560): a, c, t, g, unknown or other
  misc_feature (560)..(560): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcttgggtggcagcaacaacaggtgcccactccaggttcagctggtacagtctggagctgagatgacgaagccgtggggcctcgagtagaacggtctcgtgcgaaggtcttcgtggttacctacctttaccaacttagtggtaacttcgtaggttttcggggcgtacggaacgaccggtccccgtagggaaccgtaaggggtcgtttaggacgggttaggacggttgggagttaggatacgagcgtcttaacgagtcggtacaacgaactaaagtcacgactaacgaacgtaaccgtaccggaagggccaagacgtaccaacgtactacgaccaacacgtaaccacgtaactaccgaaggtacgccgaaccggtacctaacgacggtacggtaccgtaggaaccgggacgtaccgtaggaaacggtntaacccgtacgaccggaacgtcccgggtaccgttagtttaactggtacgagtacggaagtacggtaggtaacggttaaattttcgtagaccgtttgttacccgttagttacgtcgtacggtacgggaccttccggggtaactccgg

SEQ ID NO: 197244 - DNA, 932 bp, Homo sapiens
  misc_feature: GYAE6OF01AI82M.39.81.H04.1.454.CMB.1.raw
  modified_base (832)..(832): a, c, t, g, unknown or other
  misc_feature (832)..(832): n is a, c, g, or t
  modified_base (838)..(838): a, c, t, g, unknown or other
  misc_feature (838)..(838): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccgtttttcttgggtggcgagaccaaacgaacgtggtcgcccctaacgtcccgagggtttccaggtccgttgggtaacctggtccgttgggaacgtcgtaggacggattacgggaaccggaacggtccggtcgggggacccttagaacggggttaggtaacgggttccctacggttacggacgtaaacgggttccttttacggtacccgggtttaaacccttacccttttaaccgaaacgtttggtttacggtacgttaccggtagggtttaggggtccgtaccgtaaccggtaccggggtaccccgttaggggaacgtaaacggggtttccgttacgggtaagggttacggggtaacgggttacgggggaaggtttaacggggtccgttagggtaaccggtacccgggtttaaactttaacgggtaaacggttttccgaacgtaaaaccggtaaaccttaaaacggttacgttaccgaaacccgtaaccggaaccgtaaacccgttaccggggaacgggtaccgttaaaccggaacgtaccgtacgtaaacgtcggaaccccgagtaaaccgaaccgtaccacgtaaccgaccgggtacgacccggtacggaaccttaacggagtacggtaaccggagcggtaacctccgaaggtactcgggtaacaccggcgttaacccggagttcccggtaatttaccggngtaccnggtacccgtaggaggtaacgttacgtagttacgtgtaacctggttaccttaggtacgtacggtacgggtaccggtacggaaccggtcgtacggg

SEQ ID NO: 197245 - DNA, 838 bp, Homo sapiens
  misc_feature: GYAE6OF01DYQUR.39.81.H04.1.454.CMB.1.raw
tcagtcgcactagtcacgaccggtgctcgatttagtagtgtagattcgcggggactggacctggagcatccttttctggtggcagcaacaacaggtgcccactcccaggttcagctggtacagtctggagctgagatgacgaagccgtggggcctcgaggtgaaggtctcctgacaaggtcttcgtggttacctacctttaccaactatggtatcgaggttgggtgcgacgacggcccctggaacgaagggtcttggaggtggagtggggataggatcgaggtccgtacttacaagtcggtaccaacaactaaactgtacgaccaacaacgtaaccctcgacgggtaccaggtacgtaccaaccgactacgaaccctaacgacgaacctacacgtaccgacggacgacccgacggtaccctaacgacgtaccgggacctagggacggtaccgtacgtacgtaacgaacgttacgtacggaaacccgtaccggtacccgggtcgttaacgttaacgttacggtacggtaaggacggtaaacggaagggtaaccggttaaacggggtttaaacttttaacggttttacggtaacccggttttaccggttaaccccgtttacggtttaaccggtaaccggtttaaccgggtaccgggggtaacccggtaacccgggttaaccccggttcggtaacccccgtacccgttaccctacccgtaccggtaccccgtaccccgtaacccggaacccggtaaccccgggaccccgtttaccggttccccggtttaccccgttaccccccggacggtaaccccctaccccgttacccgtaaaccccgg

SEQ ID NO: 197246 - DNA, 677 bp, Homo sapiens
  misc_feature: GYAE6OF01E32O5.39.81.H04.1.454.CMB.1.raw
  modified_base (277)..(277): a, c, t, g, unknown or other
  misc_feature (277)..(277): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttctggtggcagcaacaacaggtgcccactcccaggttcagctggtacagtctggagctgagatgacgaagccgtggggcctcagtgaagtctcctgcaggcttctgttacaccttaccactagtgtatcgagttggtcgcgacncggccctggacgaaggtctgagtcggagtgggatggataccgagtccggactttaaccgaagtcgggtaccaacaaacctaaactagtacgacgacaccgaaaccctccgagggacaagtacgtacaccctacgacgaacccacgacgaactaccacgtaccaacggaacaccggacccggtaacctaaccgaggtaccggaccgtaggacggtaacgccgttaggaagtaccagtacgaaccggtacgaacccgggtcgtacgttaatcgttacggacgcggagtacggtacggtaaccgggttaaagtttctttagggtaaccgttccggttaccctttcggttaacgtacccgtacgggttaccggggtaacccgtaaccgggtaacccgttaccgg

SEQ ID NO: 197247 - DNA, 657 bp, Homo sapiens
  misc_feature: GYAE6OF01AP8WT.39.81.H04.1.454.CMB.1.raw
  modified_base (266)..(266): a, c, t, g, unknown or other
  misc_feature (266)..(266): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaacggtctcctgacaggcttcgtggttacctacctttaccaacttnttggtatcgtaggttgggtcgcgacacggcccctggacgaagggtcttgagtggagtgggatggatcgagtcgtacttacagtcggtaccaactaactaactactgaccaacgaacgtaacccgtccgaacgggacaggtacgtacccgaacctagtaccggaaacccaacgaacgtaaccacctactacccgaacgacgacccgaaccggacctaacgacgtacggaccgtaggaggtacacgagagtacgtacgacggaaccgaccgaccggtcgtagttactacgtggtacgcggtaaggaggtacggtaaggttaaagttcgtttacgacgtttccgtaccttcgttacgtaccgttacgggacgggaccgtcggtcccggttacgg

SEQ ID NO: 197248 - DNA, 798 bp, Homo sapiens
  misc_feature: GYAE6OF01E4Q5M.39.81.H04.1.454.CMB.1.raw
tcagtcgcactagtcacgaccggtgctcgatttagtagtgtagattcgcggggacccaaaaaaccacacccctccttgggagaatcccctagatcacagcctcctcaccatggactggacctggagcattccttttcttggtggcagcaacaacaggtcgcccactcccaggttcagctggtacagtctggagctggagatgacgagccgtgggcctcagtgaggtctctgcgaggtcttctggttacctacctttaccaactatggtatcgtagttgggtcgcgacgacggtccccgtggacgaagggtcttggagtgggagtaggggataggactcgacgccgtacgttaacgtagtcggtactaaccaacgtaactagccgacaacgaacgaaccctcggaacggactaaggctaacccgactacgtacgaaccacgaacgacctaacgaaccgtaccgaacggaccgaccgaacccggtacctaacgtacgggtaccgaaccgggtaggaacgggtaaccgtccggtaaggtaacgtacgttaccgggtaacggtaacccgggaaccggttacccgggtaacccgttttacggttaacgttacggttcggggtaaccgacgggtaaacgggacgggtttaacgggttaaaccgggtttaaaacgtttttaccggtttaaccgggtaaccccggttttaaccgttccccgttttaacggttttaccggaaacccggttttaccgggggacccggggttaaccccgggaaacccggggtttacccgttacccgggg

SEQ ID NO: 197249 - DNA, 697 bp, Homo sapiens
  misc_feature: GYAE6OF01AMY5J.39.81.H04.1.454.CMB.1.raw
  modified_base (159)..(159): a, c, t, g, unknown or other
  misc_feature (159)..(159): n is a, c, g, or t
  modified_base (383)..(383): a, c, t, g, unknown or other
  misc_feature (383)..(383): n is a, c, g, or t
  modified_base (431)..(431): a, c, t, g, unknown or other
  misc_feature (431)..(431): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacgaggtcncccactcccaggttcagctggtacagtcgtggagctgagatgaacgaagccgtgggcctcgagtagaggtcctcgtgacgaggtcttcgtacgttactacctttaccaacttagtaggtatcgtaggttgggtacgacgacgaccggtcccgtaggacgaacgggtcttaggagtgggagtgggatggatacgagtctacttacgagtcgtacaacaactaatnacgacaacaacgtaccacggaggacagacgtaccaactgtacgaaccncgaacgaactaccacgtaccgaacgacgaccgtacccggaacctacgacgtaccggtaccgtaggacggtacgcgtaggactacgtacacggtaccgaccgtacggtacgttagttacgttacgaggtacgacggtaaggacgtaacgggttaaacgggttaaacttttagggtttacccgtacggtttacccggttacctttaccggttacgttaacggtaccgggttaccgggaacccggttaccgggtaacccggttcccggg

SEQ ID NO: 197250 - DNA, 804 bp, Homo sapiens
  misc_feature: GYAE6OF01CU64E.39.81.H04.1.454.CMB.1.raw
  modified_base (584)..(584): a, c, t, g, unknown or other
  misc_feature (584)..(584): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcattccttttcttgggtcggcagcaaacaacaggtcgcccactcccaggttcagctggtacagtcgtggagctgagatacggacgaacgccgtcgggcctcgaggtggtaacggtcctccgtgacgtaaggtcctttcgtacggttaccttaacctttaaccaattcgtaggtactcggtaggttgggtcgacgaccgcggtaccccgtaggacggtaacgggtcgttagggtaggtagggtaggtagggtagtcgggtaacttcgtaacgttcgtaacttaacgaaagtttcggaaccaacgaaactaaactgtaccgaacaacgtaaaccgtaccgtaaccggacgggaactacgggtacctaacccgaaccgtaacgtaaccggaaacctaaccgaacgaacctaaccgaaccgtaccgaacggacgaccgaccgtaacctagaacgtcggaacgnggtaacgcgtacgtgaacgttacgcggtacgaccggtaaccgtacgggttactacggttaacgtcggtacggtacggagtaaacgggtaaggtaaccgggttaaacgggttaacttttacggttaccgtaccggtttacccgttacccgtttacggtttaccgtaaccgggttaaggggtaccccgggtaaccgggtaacccgggtcccgtttacccggg

SEQ ID NO: 197251 - DNA, 787 bp, Homo sapiens
  misc_feature: GYAE6OF01CLPH7.39.81.H04.1.454.CMB.1.raw
  modified_base (157)..(157): a, c, t, g, unknown or other
  misc_feature (157)..(157): n is a, c, g, or t
  modified_base (185)..(185): a, c, t, g, unknown or other
  misc_feature (185)..(185): n is a, c, g, or t
  modified_base (189)..(189): a, c, t, g, unknown or other
  misc_feature (189)..(189): n is a, c, g, or t
tcagtcgcactagtcacgaccggtgctcgatttagtagtgtagattcgcggggacccaaaaccacacccctccttgggagaatcccctagatcacagctcctcaccatggactggacctggagcattccttttcttgggtggcagcaacaacaggtncccactcccaggtcagctggtacagtcngganctgagatgacgaagctggggacctgagtggaacggtctccgtgactaaggtctttcgtacggttaacctaacctttaccaaattagtggttactcgtaaggtttgggcgaccgaacctacggccccgtaggacgaagggtcttagaaggttggagtgggtaactggaatcgaagccgtacttaagagtcggtaccaacaaaccgtaagttactcggaaccaagaaccgttaaccgaccggacggggactaaacgggacgttaaccaacgtaactacggaaacccagaaacgcaaccactaccgaacgtacgacaccggtaacacgtacgaccggaccgaaggtagaccgacgttagggaactcgttacacggaacttaaccggaccgggttaccgttagttaacggtttacgtcggtaacgggtcgaaacgggtaacggttaaacggttaacggggtttaaaactttttacggtttaaacccgggtaccgggttttaacccggtttaacccgtttaccgggttttaacggtaacccggttacccggggttacccggggttaaacggaaccccggggggtttaccctttaaccccgggg

SEQ ID NO: 197252 - DNA, 769 bp, Homo sapiens
  misc_feature: GYAE6OF01B1ES0.39.81.H04.1.454.CMB.1.raw
  modified_base (555)..(555): a, c, t, g, unknown or other
  misc_feature (555)..(555): n is a, c, g, or t
  modified_base (568)..(568): a, c, t, g, unknown or other
  misc_feature (568)..(568): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactccaggttcagctggtacagtctggagctgagatgacgaagccgtggggacctcgaggtaggaaagggtctccgtggaccgtaaggtccgtttcgtacgggtttaacctaacccttttaaccgaaactagttacggttacttacgtacggttgggtcggccgacgtaccggccccgtagggaccgaacgggtcttggaggtggtaggtcgggagtggaatcgacgtcgtactaacgtaacgttaggacaaacgtaactaaacgttacgtacgaaccgtaaaccgaaacggtaacccgtacggaacgggtacgaacggtaacgtcgaaacccgtacgacggaaccaaacgacgaacctacaacctaccggacgtacaccggtacggtaccctanaacggtcggaacncgggaacgcgacgtacggattagacctaggaccggaactccggtacgtacgttttacgtacgtaggtacgtacgggaagtaaccggtacggggttaaacggtaaagtttccggttaggtaccgtttacccgggttaccctttagtttaaccgggtacgttacgggtaccggggaaccccgttacggggtccttacccgggg

SEQ ID NO: 197253 - DNA, 762 bp, Homo sapiens
  misc_feature: GYAE6OF01A1RX1.39.81.H04.1.454.CMB.1.raw
  modified_base (660)..(660): a, c, t, g, unknown or other
  misc_feature (660)..(660): n is a, c, g, or t
tcagtcgcactagtcacgaccggtgctcgatttagtagtgtagattcgcgggacccaaaaaccacacccctcccttgggagaatcccctagatcacagctcctcaccatggactggacctggagcatccttttcttggtggcagcaacaacaggtgcccactcccaggttcagctggtacagtctggagctgagatgacgaagccgtgggcctgagtgaacggtctcgtgacgtaacgtcgttcgtacggttacctaccgtttaaccaactatggtatcgtaggttgggtacgcgacgacggtccccgtagggaaccgtaagggctttggaagtgggacgtgggtatcggatacgacggtcgtacgttaaccgtaagtcggtaccaaccgaacgtaaaactagtacgaacaaccgtaacggtaaacccgaccggaggggtacctaaggaaccgtaccgtacccgaagttaaccggaaacccgaacgaacggtaacccaaccgtaaccgttaacccgaacccggaaacgtaaccgaaaccccgggtacccttaaacgtaaccgtaacgggacccgttaagggaaccgggtacgtacccgttaggaaacgtcgtttaaccgacggtaacccggactacccggtacgttacgtactttacggngtacgcggtaagaacggttaggtaacgttagttagtttacgacggttacgttacccgtagtttacgaccgttacggacgggtacgtaaccgggtcctacggg

SEQ ID NO: 197254 - DNA, 729 bp, Homo sapiens
  misc_feature: GYAE6OF01B9Y7B.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctgagtgaaggtctccgtgcaaggtcttctggttaccacctttaccaactagtggtatctaggttgggtgcgacgacggcccctaggacgaagggcttaggacggtggagtgggatggatcgagcgtactaacgagtacggtacaacgaacaaactatcgacaacgaacgaaccctacgaggacgaagacgtaccacacgtcgaaccacgacaaccacactaccgaacgacgaccgaacggaccctaacgacgtacggaacccgtaggaacggtaccggaccgttagggaactagtacgacggtaacccggaaccgtaccggggtacccgttaacgtttaacgtttacggtaacggttcggaaccggtaaggtaacggtaagggttaaacgggtaaaacgttttaggttttaacggtaacccggtttaccggtttaacccgttttcccggtttaacggtaccgtttaacccgggttacgggggaaccccgttaacgggtaacccccggtttaccggg

SEQ ID NO: 197255 - DNA, 744 bp, Homo sapiens
  misc_feature: GYAE6OF01AJU19.39.81.H04.1.454.CMB.1.raw
tcagtcgcactagtcacgaccggtgctcgatttagtagtgtagattcgcgggacccaaaaccacacccctccttgggagaatcccctagatcacagctcctcaccatggactggacctggagcatccttttcttggttggcagcaacaacaggtgcccactcccaggttcagctggtacagtctggagctgagatgacgaagctggggcctcgagtgaacggtctccgtgcaaggtcttcgtcggttacctacctttaccaacttagtcggtatcgtaggttcggtgcgacgtcggcccgtaggacgtagggcttggacgtggtacgtgggatggtacttcgaggtcgtacttacgaagttggtacgaactaacgtaactacgtacgacctaaccgaacggtaaccccgtcgtaacgggactaacggacggttaaccacgagttaaccggaccctagaacggtaaccacgtactccgaacggacgaccgacccgtacgaacgtcgtacggtaaccgtcggaacgtacgtaccggtgtaacgtacgacgtaacggaacggtaacccgtaccgggtcccgttaggttaccgttaggttaccgggagtaccggagggtaacgtaacgggtaaccgggttaaagtttcggttttaacgggtaccgttaccgggttaaccccgtttggttaccgttacggttaccgggtccggggtaacccgtaaaccgggggtcccttaaccccgggg

SEQ ID NO: 197256 - DNA, 647 bp, Homo sapiens
  misc_feature: GYAE6OF01B596Z.39.81.H04.1.454.CMB.1.raw
  modified_base (367)..(367): a, c, t, g, unknown or other
  misc_feature (367)..(367): n is a, c, g, or t
  modified_base (399)..(399): a, c, t, g, unknown or other
  misc_feature (399)..(399): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttaccacctttaccaactatggtatcgagttgggtgcgacgacggcccctggaacgaagggtctttggaggttggagtgggatggatcgacgcgtccttaacaagtggtacaacaacaaaactancgcaacacgaaccctcgaggcagagtcacgancgaccacagacacactaccgaacgacgacgaccggacctaacgagtacggacctaggaggaccgtaccgagtactacgtacgtacggaacggaccgtaaccgggtccgttacgttaacgtttacgttacggtaggacgtagggtaacggtaacggttaacgggtaaattttcgttttacggacgttccgggtttaacccttgttacgtacgttaccgggtcgggacccggtacgggtacccgtacggg

SEQ ID NO: 197257 - DNA, 764 bp, Homo sapiens
  misc_feature: GYAE6OF01C9AAE.39.81.H04.1.454.CMB.1.raw
tcagtcgcactagtcacgaccggtgctcgatttagtagtgtagattcgcggggacccaaaaaaccacacccctccttgggagaatcccctagatcacagctcctcaccatggactggacctggagcattccttttcttggtggcagcaaacaacaggtgcccactcccaggttcagctggtacagtcgtggagctgagatgacggacgccggtgggcctcgaggtaggaaggtcctccgtgacgaaggtcttcgtacggttaacctacctttaaccaacttagtggtactacgtaggtttgggtcgaccgacggaccggtcccgtaggaacgaagggtcttaggaggtaggtaggtaggagtaggatcgacgccgtacgttaacgaagttcggtaacaactaaacctaaacgtagtacgacaacgaaccgtaacccgtacggacggacgaacggtactaccgaccgtagtacgaaccaacgacgtacaaaccgtcctaacccgaacgacggtacccgaacggtccctaagacgtaccgggacgtagggaacggacgtccgtagaatccgttaccggaacgaacccggacgtaaccgggtacgtttagtaccttacggtagggacggaacgggtaacgtaagggtaaccgggttaagggtttaaactttcggtttaggtaacccgtttaccggtttacccgttaagttcgtaacccggtaccggggttaccggggaaccgttaacccgggttcccggttaacccg

SEQ ID NO: 197258 - DNA, 669 bp, Homo sapiens
  misc_feature: GYAE6OF01D2L2C.39.81.H04.1.454.CMB.1.raw
  modified_base (365)..(365): a, c, t, g, unknown or other
  misc_feature (365)..(365): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcattcctttttcttggtggcagcaaacaacaggtcgcccactcccaggttcagctggtacagtctggagctgagatgacgagccgtgggcctcagtgaaggtctcgtgacaggcttctggttacctacctttacaactagtgtatctaggttgggtgcgacgacggtccctggaacgaggtcttggaggtggagtgggagtggactcgagcgtagtaacagttggtacacaaacaaactntacgacaacgacaaccgtcgagggcaagacgtcactagacgaacccaacgagaacctaacgtactaccccgaaggaccgacccgaacggtaccctaaagtaacggtccggaacctaggggaaccgtcgaccgttaggacgtcgttacggacgaaccggacgtaccgggtccgttagttaacgttcgtacggtgaacggtagaaggtaaccggttaagggttaactttggttaacgaccgtttcggttacctttcgttagtacccggtacggtaccggggtaacgtaacccgggtcgttaccggg

SEQ ID NO: 197259 - DNA, 849 bp, Homo sapiens
  misc_feature: GYAE6OF01A3XLF.39.81.H04.1.454.CMB.1.raw
tcagtcgcactagtcacgaccggtgctcgatttagtagtgtagattcgcgggggacccaaaaaccacacccctccttgggagaatcccctagatcaacagctcctcaccatggactggacctggagcattcctttctggtggcagcaacaacaggtgcccactcccgaggttcagctggtacagtctggagctgagatgacgaagcccgtggggcctacgacgtgaacggtcctcctagccaaggtcttccgtaggttaacctaccttacgaactatggtatcgtaggttcggttagcgtacgtacggcccctagggaccgtaaggggtaccttagggacggtagggacgtttagggggaattgggtactacggacgacggtacgtttaacgaacgtcgggttaccaaaccgaaacgtaaaacgtacgtacggtaccgtaaaccgaacgtaaaccccgttaccggaacggggaccgtaagggtaccgtaccgaacccgaacgttaccggaaaccccaacggaaccgaaccgtaaccgtaaccgtacccggaaccggtaacggaccccgtaaacccgggtaccctaaacggtacgtacgggaaccccgtaggaacgggtaccgtacccgtagggaacggttattaccggtacggaaacccgtaacggtaccccgggtacgtttaacgttaaccgttaccggttaggtaccgggtacggtaacggtaacgggtaccgggttaacgggttaaagtttaccggtttacgggtaccggttaccggtttacccgttacgtttacggtaaccccgttacgggtacgggacccggtaaccgggttaacccggtccgg

SEQ ID NO: 197260 - DNA, 741 bp, Homo sapiens
  misc_feature: GYAE6OF01A0T1Q.39.81.H04.1.454.CMB.1.raw
tcagtcgcactagtcacgaccggtgctcgatttagtagtgtagattcgcggggacccaaaaaaccacacccctccttgggagaatcccctagatcacagctcctcaccatggactggacctggagcatcctttcttggtggcagcaacaacaggtgcccactcccaggttcagctggtacagtctggagctgagatgacgaagccgtgggcctcgagtgaaggtctctgacgaggtcttctcggttacctaccttaccaactatggtatcgtaggttggggtcgtacgtacgacgggtccccgtagggaaccgtaagggtccgttaggaggtagggtaggtaggggtagttagggtaacgtcggtaagaccggttacgttaaccgtaagttcggtacaacgtaaacctaaaacgtacgtacgtaccaaaccgtaaccgtaacccgtaccggacggtacgaaccggtacgtaccgaaccacgtaaccgaaccgaaccgaagtaaccaactactaacccggtaccgaagtcccgtaacccgcctaaacgtcgtaccggactacgggacgtacgtcgagacgtagtcgtaacgacgtaaccggtccggtaccgttacgttaacgtcgtagtacggtacggaagaacgggtagtaacgggttaaattacgtttacggtaacgttcggttacccttacgttacgtaaccgttaccgggtagggacccgtacgggtaccccgtacgg

SEQ ID NO: 197261 - DNA, 717 bp, Homo sapiens
  misc_feature: GYAE6OF01BPU6Y.39.81.H04.1.454.CMB.1.raw
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaacggtctcctgacaaggtcttcgtcggttactacctttaccaactatggtatctggttgggtgcgacgacggcccgtaggaacgtagggcttaggaggtgggagtgggtagtggtactcgacggtcgtacttaacgagttcggtacaacaaactaaaactagtagaccaacgaacgaacctccggaggcgaagacgtaccaactacgtaacgaaccaacgacgaaccaacaaccgtaccgaacgagacccgaccggtacctacgaacgtaccggacgtagtacgtacgtccgtagtacggtactacgtacgacggtaacgtaccgggtacccgttagtttaaccgttacggtacggtcggtaacggaggtaaggtaacggttaaagggtaactttagggttttacggaacgttcgggtttaaccctttacggttaacggtaccggttaccgggtaccggggacccgggttaaacgggttccccggttaacccggg

SEQ ID NO: 197262 - DNA, 609 bp, Homo sapiens
  misc_feature: GYAE6OF01DGZY2.39.81.H04.1.454.CMB.1.raw
  modified_base (195)..(195): a, c, t, g, unknown or other
  misc_feature (195)..(195): n is a, c, g, or t
  modified_base (273)..(273): a, c, t, g, unknown or other
  misc_feature (273)..(273): n is a, c, g, or t
  modified_base (381)..(381): a, c, t, g, unknown or other
  misc_feature (381)..(381): n is a, c, g, or t
  modified_base (464)..(464): a, c, t, g, unknown or other
  misc_feature (464)..(464): n is a, c, g, or t
  modified_base (483)..(483): a, c, t, g, unknown or other
  misc_feature (483)..(483): n is a, c, g, or t
tcagtcgcactagtcacgaccggtgctcgatttagtagtgtagattcgcgggggacccgaaaaaccacacccctccttgggagaatcccctagatcacagctcctcaccatggactcggacctggacgcattccttttcgtggtggcagcaacgacaggtcgcccactcccaggttcagctggtacagtctgganctcgagatcgacgacgccgtgggcctcgagtaggagtcgtcctgacgaggtcttacgtggttacctaccttacacgtntggtatcgtagttcggtcgacgaccgtacggtcccgtaggacgagggtctaggacgtggtagtcggatcggatcgacgtcgtactacgagtcgtacactaactaagtntacgactacgacgactccggaggtacacgactaccactacgtacgactacacgtacacactccgaagcgacgacgtacgtacncgtacgacgtggacgtacncgtagacgtatccgacgacgtacgtccggtctagtacctacgtgtacgaggacgacgtagtacggtaattcgttacgacgttccgtaccttggttacgacgttacggcggtaaccgcggtcctccg

SEQ ID NO: 197263 - DNA, 882 bp, Homo sapiens
  misc_feature: GYAE6OF01BEV4H.39.81.H04.1.454.CMB.1.raw
  modified_base (365)..(365): a, c, t, g, unknown or other
  misc_feature (365)..(365): n is a, c, g, or t
tcagtcgcactagtcacgaccggtgctcgatttagtagtgtagattcgcggggacccaaaaaccacacccctccttgggagaatcccctagatcacagctcctcaccatggactggacctggagctattccttttcttggtggcagcaacaacgaggtcgcccactcccgaggttcagcgtaggtacagtcgtggagctagagatgacgacgccggtgggcctagagtagacgttctcgtgacgtacggtcttgtacgttacctaccgttacaactagtgtatcgtaggttggtacgacgtacgaccggtcccgagggaacgaacggttcgttaggacggtaggagtggggagtgggataccggngtaccgttacgttaacacggttggtaaccaaaccgtaaacgttaaaactacgtacgaaaccgtaacgaaaccggtaaaccctaccgggaaggaacgaacggtaaccgtacgaaacccgtacgtaaaccgaaacccggaacaaccggtaacccaaccgtaacccgtacccgaacgggtaaccgaaccccggtaaccggtcccttaaacgtaacccggtaggtaaccgggtaacggaaccggttaccgtaccggttaacggtaagtacccgttaacgggtaaccgtaaccggtaaccgggtaacccgggtaaccggtttaacgtttaacggttacgggttacggttaccggaagggtaaggtacggttaaaccggggttaacgggtttaaacttttaacgggtttttaaccgaccggttttaccccgggttaaccttttaccgggtttaaccggttaccgggttaaccgggttacccggggaaaccccggtcccggggttaaacccggtttaccccggg

SEQ ID NO: 197264 - DNA, 697 bp, Homo sapiens
  misc_feature: GYAE6OF01DQHQH.39.81.H04.1.454.CMB.1.raw
  modified_base (281)..(281): a, c, t, g, unknown or other
  misc_feature (281)..(281): n is a, c, g, or t
  modified_base (549)..(549): a, c, t, g, unknown or other
  misc_feature (549)..(549): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttctggtggcagcaacaacaggtcgcccactcccgaggttcagctggtacagtctggagctgagatgacgaacgccgtggggcctcgaggtgaacggtctccgtagacaaggtccttcgtacggttacctaccttttaaccgaaacttntaggtacttccgtaggttgggtgaccgaccgtaccggtccccgttaggaacgaacgggtcttggacggtggaagtgggactcggtactcgaggcgtacttacaagttcggacacaactaactcacgtacaacgtacgtaaacccgtaccgacgggtacaagtaccgtccacgtacgtacgaacccagaacgtccaacgtactaccgaacgtcggaccacggcctaacgacggtacgtaccgaggaaccggtcaccggtagacgttacncgtaccggacgaccggtacggtacgtgtacttcggtagcggtacgaggaacgttcgggttaaacggtaactttgttaccggtaactttccggtaccctttgtaaccgtaccggtaggtacccggggtacaccggggttacgtacccgg

SEQ ID NO: 197265 - DNA, 656 bp, Homo sapiens
  misc_feature: GYAE6OF01B8XC8.39.81.H04.1.454.CMB.1.raw
  modified_base (409)..(409): a, c, t, g, unknown or other
  misc_feature (409)..(409): n is a, c, g, or t
tcagtcgcactagtcacgaccggtgctcgatttagtagtgtagattcgcggggacccaaaaaccacaccccctccttgggagaatcccctagatcacagctcctcaccatggactggacctggagcatccttttcttggtggcagcaacaacaggtgcccactcccaggttcagctggtacagtctggagctgagatgacgaagccgtgggcctcgagtagaacggtctccgtgacgaaggtcttacgtacggttacctaccctttaccaactgtaggttatacggtaggttcgggtcgaccgaccgtaccggcccgtagggaacgaaggggtcttaggtacggtgggtagtaggggtagtaggacgtcgaggtaccgtacttaacgagtcggtacaacaactaactanacgacaacgaacgtacccgtacggaggccaagactaccaccgtagacaccacgagactacgactaccgagacgacgacccgtactagtacgaccggacctaggacggacgtacgtaggacgtacgtacgacggaccgaccggaccggtcgttagttctacggtagcgtacgagtacgtcggtaaggtaattcgttagtaccgttcgtcttacggtacgtacgtcgggagtacccgtggcccgttcgg

SEQ ID NO: 197266 - DNA, 745 bp, Homo sapiens
  misc_feature: GYAE6OF01DC4UU.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagcctggtacagtctggagctgagtatagacgaagccgtcggggcctcgagtagtaaggtcctccgtgacgaaggtccttcgttacggtttaacctaacccgttttaccaaacgttagttaggttactacgtaggttggggtcgacggtacggacccggtcccgtaggaacgaagggttcgtaggtaggtaggtaggtggagtggactcgacgacgttacttaacgacgttcgaaccaaccaactaactacgtacgacgtaacgaaccgtaacccgtaccgaagggtaactacggtacgtacccaaccgtacgtaccgaacacgaacgacctaacgaccgtacccgaacgacgaccggtacccgtaccgtaacgaacgtcccggacgtagggaccggtacgacgtaagacgtacgtcgaaccgtaaccggtaccgtaacccggtacggttagttaacgtacggtggtcgaacgggtagtaacggagttaacggtattaacgttcgttacgttaccgttacccgtttagtacggttaaccggtgggacccgggaacgtacccgggtgtacccgg

SEQ ID NO: 197267 - DNA, 656 bp, Homo sapiens
  misc_feature: GYAE6OF01AFOT8.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttcgtggttaccacctttaccaactatggtatcgaggttgggtgcgacacggccctggacgaagggtcttggagtggagtgggatggatcgagcgcttacaagtggtacaacaacaaactagtacgacaacaacgaaccctccgaagggacaagacgtaccaacctagtacggaacccacgacgaaccacacgtcccaagacgcgaacccgtcctacagtacggacctggagacgcgtagacgatcgtacgaacgaccgtacgggtacccgttagttacttaccgtggtacgaccggtaagtacggtacggtaaacggggttaatttacggtttaggaccgttccggttaccccgtttacgttttacgggtaaccgttaccgggtacggggaaccctaacgggggttacccttacccgggg

SEQ ID NO: 197268 - DNA, 578 bp, Homo sapiens
  misc_feature: GYAE6OF01EFGQ0.39.81.H04.1.454.CMB.1.raw
  modified_base (132)..(132): a, c, t, g, unknown or other
  misc_feature (132)..(132): n is a, c, g, or t
  modified_base (173)..(173): a, c, t, g, unknown or other
  misc_feature (173)..(173): n is a, c, g, or t
  modified_base (542)..(578): a, c, t, g, unknown or other
  misc_feature (542)..(578): n is a, c, g, or t
tcagtcgcactagtcacgaccggtgctcgatttagtagtgtagattcgcggggccccctagatcacagctcctcaccatggactggacctggagcattcctttttcttgggtggcagcaaacaacagggtcncccactcccaggttcagctggtacagtctggagtctgagtntcggacgaacgtccggtggggcctacgaggtagtacggttccttccgtggacgtaacgggtccttttcggtacggtttaaccttaaccctttaaacctaaagttcttacggttatccggtagggttttacggggcgtacgaaccggtcccggtaccccggtacgggaacggaaacggggttcgttcgggtaaggttagggaggtagggggtaagtgggtaacgtaccgaacggttccgtaacctttaacgtaagttacgggtaccaaaccgtaaacgtaaaacgtacgtacgtacaaccgtaacgaacccgtaccgacgggacgacggtacgtaccgaactaacgtacgaaccaacgaacggaaacccnnnnnnnnnnnnnnnnnnnnnnnnnnnnnnnnnnnnn

SEQ ID NO: 197269 - DNA, 652 bp, Homo sapiens
  misc_feature: GYAE6OF01AV7H1.39.81.H04.1.454.CMB.1.raw
  modified_base (263)..(263): a, c, t, g, unknown or other
  misc_feature (263)..(263): n is a, c, g, or t
  modified_base (368)..(368): a, c, t, g, unknown or other
  misc_feature (368)..(368): n is a, c, g, or t
  modified_base (420)..(420): a, c, t, g, unknown or other
  misc_feature (420)..(420): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccgaggttcagctggtacagtctggagctgagatgacgaagccgtgggcctcagtgaaggtctctgcaggcttctggttacctacctttaaccaacttntggtatcgtaggttgggtgcgacgacggccccgtggaaccgaagggtcttgaggtggagtgggagtggatcgagcgtacttagaagtcggtacactaacaaactncgtacaacgacgtaaccgtcgagggcctaggacgtccaacagtacgaccganacgaacacacgtaccacgacgcctaacccggacctaccgtagtccgggtaacctcgggaggacctccgagggtaactacgtaccgtagaaccgacgtaccgggtcgttagttacgtacgttagcggtacgaaggtacgtaagggtacggttaaagtttcgtttgaacccggttcgttacccgtgtttacggtaccgtaacggtccgggaaccgttacggggtcccttacggg

SEQ ID NO: 197270 - DNA, 654 bp, Homo sapiens
  misc_feature: GYAE6OF01AETB3.39.81.H04.1.454.CMB.1.raw
  modified_base (361)..(361): a, c, t, g, unknown or other
  misc_feature (361)..(361): n is a, c, g, or t
  modified_base (383)..(383): a, c, t, g, unknown or other
  misc_feature (383)..(383): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtggggcctcagtgaaggtctcctgcaaggcttctggttactacctttaccaactatggtatcaggttggtgcgacgcggccccgtggacgagggcttggagtggagtgggagtggatcgagcgtacttacaagtggtaccaactaacaaaactntacgaccaacgaccgtaacccnccgaagggacagacgtaccaacgacgtacggaacccaacgacgaacacctaacgtcccgaacgacgaccgacccggacctacgacgtacggaaccgtacggaacgggacgtccgtaggacgtacgttacgacggaaccgaccgtacggtccgttagtacttacgtgtacgacgagaggtaggtaacggtaagtttagtttacgacgttccggttaccttacgtttacgtacgttacgggaccgggtaccggtaaccgggtccgtacccggg

SEQ ID NO: 197271 - DNA, 616 bp, Homo sapiens
  misc_feature: GYAE6OF01DON5A.39.81.H04.1.454.CMB.1.raw
  modified_base (76)..(76): a, c, t, g, unknown or other
  misc_feature (76)..(76): n is a, c, g, or t
  modified_base (117)..(117): a, c, t, g, unknown or other
  misc_feature (117)..(117): n is a, c, g, or t
  modified_base (128)..(128): a, c, t, g, unknown or other
  misc_feature (128)..(128): n is a, c, g, or t
  modified_base (472)..(472): a, c, t, g, unknown or other
  misc_feature (472)..(472): n is a, c, g, or t
  modified_base (499)..(499): a, c, t, g, unknown or other
  misc_feature (499)..(499): n is a, c, g, or t
  modified_base (505)..(505): a, c, t, g, unknown or other
  misc_feature (505)..(505): n is a, c, g, or t
  modified_base (519)..(519): a, c, t, g, unknown or other
  misc_feature (519)..(519): n is a, c, g, or t
  modified_base (525)..(525): a, c, t, g, unknown or other
  misc_feature (525)..(525): n is a, c, g, or t
  modified_base (546)..(546): a, c, t, g, unknown or other
  misc_feature (546)..(546): n is a, c, g, or t
  modified_base (574)..(574): a, c, t, g, unknown or other
  misc_feature (574)..(574): n is a, c, g, or t
tcagtcgcactagtcacgaccggtgctcgatttagtagtgtagattcgcgggacccaaaaaccacaccctctgganatccctagatcacagctcctcaccatggactggacctggancattccttttntggtggcagacaaacaacgaggtcacccactccgaggttcagctggtacagtcgcggagctgagacgtagaacggaacgccggtgggcctagagtagtacggtctaccgtgacgaaggtcttcgtacggttaacctaacctttaacaacttagtacggtaactcggtaaggtttggcgacgaacgtaccggcccgttaaggaacgaagggttgttaggaaggttggagttaggggattagggactaccgaggtacccattaaaccggattcggacaacgaaacttaacagtcggacaacggaacacccgaggaaggtcaagtctaccgaatagaacgaacaganaacatacacagacgtacgacgtacagngtagcngaagcactgactancgacgngacctcggtactagtaatcgngtcgagagtagtagacgttaagttagtnaacgtcgttcatcggacttacgggagtacgtacggccctacg

SEQ ID NO: 197272 - DNA, 683 bp, Homo sapiens
  misc_feature: GYAE6OF01CJSBS.39.81.H04.1.454.CMB.1.raw
  modified_base (154)..(154): a, c, t, g, unknown or other
  misc_feature (154)..(154): n is a, c, g, or t
  modified_base (226)..(226): a, c, t, g, unknown or other
  misc_feature (226)..(226): n is a, c, g, or t
  modified_base (596)..(596): a, c, t, g, unknown or other
  misc_feature (596)..(596): n is a, c, g, or t
tcagtcgcactagtcacgaccggtgctcgatttagtagtgtagattcgcgggacccaaaaaccacacccctcttgggagaatcccctagatcacagctcctcaccatggactggacctggagcattccttttcgttggtggcacgcaaaccaanaggtcgccctactcccgtaggttcagctaggtacagtcgtggagtctgagatggacgagtccgtgggcctgngtagacgtctcgtgacgtagtcttagtcgttactaccttacattagtgtatcgtaggttcgggtcgacgtacgccggtcccgtaggacggtaacggtcgttaggaggtggtaggtagggtagcgtagagcgtacgtattaacgtagtacgaacaaccgtaactaatcgtacacgaacgaaccgccgtaaccggagacgaaggtacctaaccaccgaactaaccgaccaacggaacctacaacgtaaccgcgaacgtacgaaccgtaccgtacctacgtcgaacggtaccgtagggacggtaacgtccggtaaggtccgacggtacgtaacgccggttacgttacgttagttacgtgtacgtcgaggacgnggttaaccgtaaggttattagtaccgttagttcgttccgttgttaccgacggtttaccggaggtacccggtacgttcgtcggtcccg

SEQ ID NO: 197273 - DNA, 625 bp, Homo sapiens
  misc_feature: GYAE6OF01D07LW.39.81.H04.1.454.CMB.1.raw
  modified_base (314)..(314): a, c, t, g, unknown or other
  misc_feature (314)..(314): n is a, c, g, or t
  modified_base (351)..(351): a, c, t, g, unknown or other
  misc_feature (351)..(351): n is a, c, g, or t
tcagtcgcactagtcacgaccggtgctcgatttagtagtgtagattcgcggggccccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaagtggtacacacaaatntgacacacgaacctcgaggcagagtcaccatcgacanacgacacactccacgaacgccgaaccggtcctaacacgtcggaacccgtggaacgggacgtccgtaggaacgtactaccgtagaacccggaccgaccgggtccgttacggttaacttaccgtggtacggcggaaggtaacgtaggtaaccgggggtaaattggttttacgaccgttacggttacccttcgtttagaccttacgggtcgggacccgtaacgggtaaccccgttggtaccctacccgttacctacccgtacaccgtcctaaccccg

SEQ ID NO: 197274 - DNA, 789 bp, Homo sapiens
  misc_feature: GYAE6OF01CYMYA.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaaacaacaggtgcccactcccaggttcagctggtacagtctggagctgagagtgacgaacgccgtggggcctcgagtagaaggttcctccgtgacgtaaggtcttctacggttacctacctttacgaactgttcggtatacgtggttggtcgacgaaccgcggtcccgtaggaaccgagggtcttaggaggtggacggtagggagtcggatacggaggtccgtaacgttaacgaaggttcggtaaccaacgtaaaccgttaaaacgtcgtacgaacgtaaaccgtaaaccggaaacccgttccggaacggggtaacaacggtaccgtaaccgaccgtaagtaccgaaaccaacgaacgtaacctaaccgaacgtacccgaacggaacggacccgtaaaccgggttaccctaacggtaacggtaccggtaacccgtaagggtaaccggtacgtaccggtaagtacggtactacggaacggaaccgtaaccgtaccgggtcgttagttacgttacgtagggtcgaacggtaacgtacgggtaacggttaacgggtaatttaccggtttagtacggttacgggttaccctttagggttacgtaccggttacgggaccgggtaaccggtaacgggttcccgtaccgg

SEQ ID NO: 197275 - DNA, 675 bp, Homo sapiens
  misc_feature: GYAE6OF01D41IS.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgagccgtgggcctcagtgaaggtctctgcaagcttctgttactaccttacaactatgtatctaggttggtgacgacgacggccctaggacgaagggtcttaggacgtggagtgggatggatcgacggcgtacttaacgacgtacggtaccaacaacgtaaaacttgtacgacaacgaacgtaacccgtccgaacgggacaaggaacgtaccaaccgtagtaccgaacccgaaccaacggaacctaacgtaccgtacccgaacgtaacgacccgaaaccggtacctagacgtacggaccgtacggtacggacgtcctaggaacgtacgtcgaacgaccgaaccgacggtccgttagttaccttacgtaggtacgacggtaacgacggtacggtaacgggttaactttacggttttagacgtttacggttaccctttagttccgacgtttacggacggtaccggacggtcccgttcgg

SEQ ID NO: 197276 - DNA, 793 bp, Homo sapiens
  misc_feature: GYAE6OF01A6B1C.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatcctttctggtggcagcaacacaggtgcccactcccaggttcagctggtacagtctggagctgagatgacgaacgccgtggggcctcgagtggaaggtcctccgtggacgtaagggctttacgtcgggttaaccaccttttaccgaacgttagtgggttaactcgaggttcggtgacgacgacggtcccctgggaacgtaagggcttggacggtggtagtgggaattggatcgaggtcgtacttaacgagtttcgggaccaacgtaacgtaaacgtgtacggaaccaacgtaaccgtaacccgtaccggaacggggactaacgggtactacccgaaccgtaacgtcggaaaccctacgacgtaaccaacgacgtacccgaaccggtaacgccgaacccggtacgttaacaccggtacggacctacgggacggaaccgtcgtaacggtagtaacctccgggttaagacccggtaacggacccgggtacggttacgttaaacgttcccggtagtacggaaccggtaagtacggtacgggttaaaccgggttaaagttaccgtttacgaacccgggtttcggtttaaaacccccgtttggttaacccgggtaaacccgttacggggtaccccggggaaccgtttaaaccgggggtaccccttaaccgggg

SEQ ID NO: 197277 - DNA, 700 bp, Homo sapiens
  misc_feature: GYAE6OF01BGRHI.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtgggcctcgagtggaaggtcctccgtgacaaggtcttcgtggttacctacctttaccaactagtgtactcgtagttgggtgcgacgacggtccccgtaggacgaagggtcgttggaggtggagtggggtataggatcgagtccgtacttaactaagtcgtacgaacctaactaactagtcgacaacacgaaccgtcgacggacacggtacgtccaccgatacgaaccacaacgacaccaactaccgacgaccgacgacccggacctacgtacgtacggtaccgtggaacggcgccgtagacgtacgtacgacggaaccgaccggtaccggtccgtagttacgttcgtacgtgggtacgtaggaacggttaagggtaaccgggttaaaattttccggtttaggtaccggtttaccggttaacccgtttccgtttacgggttaacgttcccggggtaccggggtaccccggtaacggggttacccccgtacccggg

SEQ ID NO: 197278 - DNA, 740 bp, Homo sapiens
  misc_feature: GYAE6OF01B6N1H.39.81.H04.1.454.CMB.1.raw
  modified_base (263)..(263): a, c, t, g, unknown or other
  misc_feature (263)..(263): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtgggcctcgagtgaaggtctcctgcaggtcttcgtggttacctacctttaccaatntggtatcgtaggttggtcgcgacacggccccgtggacgaagggtcttggagtggagtgggagtggatcgagcgtacttacagtcgtacaacgaactaaactgtcgaccaacgaacgtacccgtcggacgggacaacgtacgaccaccgatacgaacctaacgacgaacactaccgtacccgaacggaccgaaccgacccggtaccttaacgacgtaccgggtaccgtaggacgggacgtacgttaggacgtagtccgtacggaccgtaccggtaccggtaccgttagttacgttacgtacggtacgacgggtaacggtaacggttaacgggtaacgggtttaaactttaacgggttttacggaaccggttttcccgggtttaaccccgttttaggtttaacccggtacgggtttaaccccgggggttaccgggtaacccccggggttaaccggggttaaccccggtttaccccgggg

SEQ ID NO: 197279 - DNA, 688 bp, Homo sapiens
  misc_feature: GYAE6OF01BK1DZ.39.81.H04.1.454.CMB.1.raw
  modified_base (415)..(415): a, c, t, g, unknown or other
  misc_feature (415)..(415): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtcgcccactcccaggttcagctggtacagtctggagctgagatgacgaagccgtggggcctcgaggtacgaaggtcctccgtggacgtaacggtcctttcgttacgggtttaacctaccttttaaccaaacgtagttaggttatcgtaggtttggggtgaccgtacggacgggtccccgtagggaacgtagggtcttaggacggtggagtagggagtggactacgaggctacgttacgagttcggtacacaactaaactntcgacaacgacaccgtcgaggcaagacgtacacgtactacgaacctacaagaccacgtactaccgacgacgaccaaccgtccaacgtcgacggtaccgtggaacggtcaccgtagacgtactcgacggacgaccggtaccggtacgttaacgttacgttacgtaggtcgacggtaggaagtcgggttaaaggttagttacggttggtaccgttacgttaccgttacgttacggtacgttacgggacgggtaccgtaaccgggtctaccccggg

SEQ ID NO: 197280 - DNA, 793 bp, Homo sapiens
  misc_feature: GYAE6OF01AXQD7.39.81.H04.1.454.CMB.1.raw
tcagtcgcactagtcacgaccggtgctcgatttagtagtgtagattcgcggggacccaaaaccacacccctccttgggagaatcccctagatcacagctcctcaccatggactggacctggagcattccttttcttggtggcagcaacaacaggtcgcccactcccaggttcagctggtacagtcgtggagctgagagtgaacgagccgtgggcctcgaggtgaggtctccgtgacgagtcttcgtacggttacctacctttacaacttagtggttatcgtaggttggtacgcgacgacggtccctagggactaagggtcttggaaggtcggaaggtcgggagttacggaactcgtacggtcgtacgttaacgtaacggttcggtaaccctaataaaccgtaaaacgttagcggtaaaccctaaccggtaaacgtaaaccccgtccggaaaagggggtacctaacggtaaccggtaccaaaccgtacgtaccggaaaccctaagaacccgaacgaacctaccgtaaccgacggaacgtaccgtaaccggtaaccaccgtacggtaccggtaccggtacggaacggaccgtaccgagtaacgtataccgaacggaacccggtaaccggaccggttaccgtacggttaaccttcggtacggtacggaacgtaacggtacgggtaaccgttaaggggttaactttacggttagtaccgttaccgggttacctttaccgttaagggttacctaacggggtaccggtaaccgggttaacccggtcgggttaaccccgg

SEQ ID NO: 197281 - DNA, 752 bp, Homo sapiens
  misc_feature: GYAE6OF01CFRTR.39.81.H04.1.454.CMB.1.raw
  modified_base (438)..(438): a, c, t, g, unknown or other
  misc_feature (438)..(438): n is a, c, g, or t
tcagtcgcactagtcacgaccggtgctcgatttagtagtgtagattcgcggggcccctagatcacagctcctcaccatggactggacctggagcatcctttttcttggtggcagcaacaacaggtgcccactcccaggttcagctggtacagtctggagctgagatgaacgaagccgtggggcctcgagtgaacggttcctccgtgacgaaggtcttacgttacggttaacctaacccttttaaccaaacttagttcggttaagtaccgtaggtttgggtgaccgacgaccggtcccgtaggaacgtaacgggtcgttaggtaggtaggagtgggataggatcgagcgtactttaacgaagttcgtaccaaactaacgtaaactgtccgaacaacgaacgtaacccgtacgaacgggacaaggtacgtaccaacgtanaccgaaccaacaacgaaccacgtactaccgaacgtacgaccgaccgtacaacggtataccggaccgagaggacccgctagggatacgtgtaccggacctaccgggacgttacggtactttaacgttacgtcggtagaacgggtaagaacgggtaaggggtttacggttaaattttacggtttcgaaacgttttccgtaccccggttttagtaccggttaacggtaccggtaccggggtaacccggtacgggtttaaccccgtcggggttaaccctccccggttactacccgtaccgtaccgtcccgtaacccgg

SEQ ID NO: 197282 - DNA, 771 bp, Homo sapiens
  misc_feature: GYAE6OF01BDDBJ.39.81.H04.1.454.CMB.1.raw
  modified_base (190)..(190): a, c, t, g, unknown or other
  misc_feature (190)..(190): n is a, c, g, or t
  modified_base (641)..(641): a, c, t, g, unknown or other
  misc_feature (641)..(641): n is a, c, g, or t
  modified_base (684)..(684): a, c, t, g, unknown or other
  misc_feature (684)..(684): n is a, c, g, or t
tcagtcgcactagtcacgaccggtgctcgatttagtagtgtagattcgcgggggacccgaaaaaccacacccctccgttgggagaatcccctagatcacagctcctcaccatggactggacctggagctatccttttcgttggtggcagcgaactaacgaggtcgcccactcccaggttcagctggtacngtcgtggagcgtgagtagtacgacgaacgccgtgggcctcgagtggtaacggttctaccgtgacgaacggtcctttcgtacggtttaaccctaaccgtttaccgaaacttagtacgggttaactcgttaggttcgggtacgaccggacgaccggtaccccgtaaggaaccggtaagggtccgttaagggtacggtagggtagtacggggtagtagggtaactttcggaacgtaccggtttaacttaaacgggcgttaacgggtaaccgaaacctaaaaccgtaaacggtgttaaccggaaccaaaccggtacctaaacccggtacggaccgggtaaccgtaacgtaccggtacaaacccgtagggtaccccaacgaacgtacgaccctaacgtaccacccgacgacgccgaaccgacctaacgtaggtacgcggtagaacggcgtaaccgngtaccgtagaccgtagaaccgtaccgacggttccgtaacggtnttacgtggacgtacgggaagtacggtagtacgttaatcgttagacgttcggtacctagtagaccgttggacgacgtaccggtcgtcg

SEQ ID NO: 197283 - DNA, 699 bp, Homo sapiens
  misc_feature: GYAE6OF01BQNOM.39.81.H04.1.454.CMB.1.raw
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctccgtgcaaggcttcgtggttacctacctttaccaactagtggtatcgtaggttgggtgcgacacggcccctggacgaggtcttggagtggagtggggatggatcgagccgtacttaacaagttcggtaccaacaacgtaaacttagtacgacaacgaacgaacccgtaccgagggacaacggtacgtaccgaacctagtaccgaacccaacgacgaacaaccgtactacccgaacgacgaccgaacccggtacctaacgaacgtccggaaccgtggaacggacgtccgtaggtcgtacgttccgtacggaaccgacgtaccgggtccgttagttacttacgtgtacgacggtaggaaggtacggttaacggggttaatttacggttttacggaccgtttcggttacccctttacgtttacggtaaccgttaccgggttacggggacccgtaaccggggtacccgttaccggg

SEQ ID NO: 197284 - DNA, 777 bp, Homo sapiens
  misc_feature: GYAE6OF01DP9OE.39.81.H04.1.454.CMB.1.raw
  modified_base (161)..(161): a, c, t, g, unknown or other
  misc_feature (161)..(161): n is a, c, g, or t
tcagtcgcactagtcacgaccggtgctcgatttagtagtgtagattcgcggggacccaaaaccacacccctccttgggagaatcccctagatcacagctcctcaccatggactgggacctggagcacttccttttctgggtggcagcaaacaacgaggtcncccactcccgaggttcaggctggtacagtcgtggatctgagagtggacgacggccgtgggcctgaggtggacgtctcagcgacggtcttcgtacggttaacctaccgttacgaacttgtacggttatcgtaggttcgggtcgtaccgacgccggtacccgtaggaacggaggttcgtagggtaggtaggagggtagggtagtcggtacgtacggacggtccggtacttacgtaagtcggtaacaacgaactaacgtatacgacgaacgaacgaccgtacggacggacgtacgacgtacgaacgtacgtacgacgacgtaacgactaccgtaccgaaccgtaccgaacgtccgtaacccggtaccaacggtacgtaccgggtaaccgagggtaaccggtacgtaccggtaacggtacgtacgaccgggtaacggccccgaagggtaaccccggtgttaaggttaaccgttcgggttaaccggaccggtaacgggtaacggtaggttaaacggggttaacgtttaaaggtttccgtaacccggttaacggttccggttacccgttaggtaccgtttacgggacggtaccgggtacccggtacgggtcccggtacccgg

SEQ ID NO: 197285 - DNA, 898 bp, Homo sapiens
  misc_feature: GYAE6OF01BCLQ4.39.81.H04.1.454.CMB.1.raw
  modified_base (803)..(803): a, c, t, g, unknown or other
  misc_feature (803)..(803): n is a, c, g, or t
  modified_base (808)..(808): a, c, t, g, unknown or other
  misc_feature (808)..(808): n is a, c, g, or t
tcagtcgcactagtcacgaccggtgctcgatttagtagtgtagattcgcggggacccaaaaccacacccctccttgggagaatcccctagatcacagctcctcaccatggactggacctggagccactttcccttttcgtgggtcggcagaccaacaacgtaggtccacccaccgtcccgtaaggttccacggtccgttagggtaactaggttccgtagggtacgtaccgtacggaaggtacgttacgggaaccggtaaccgggtcccgggttacgggggtaccctaaggacgggttacggtaacgggtttcccctaccggtacggaaccggtaacggttcccgttttaccggttaccggtttaaccctttaacccttttaacccgaacgtttaggtaccggttacgttacggttaggggttttcggggtaccggaccggtaaccggacccggggtaccccgtaggggaacggtacggggttcgtttaggggacggttagggtagggttggggtaacgttacgggtacgtacggacggtaccggttaacttaacgtaacggtttccggtaaacctaaccgtaaccttaacgttacgtaccggaaccaaccggaaccgtaacccggtacgggtaacggtaccgtaacggtaccgttaaccgaacctacgtaccgaaacccacgaacgtaccgaactaccgaccgtaacgacgtaccgacccgttaccacgagtaccggacgtaggaccggactacgagacgtactacgacggtacctacgggcggttaccttagttaccttggngacgnggaacgtacggtacggtaacgtttacttaggtaccggactttccggtacttcgtacggtacctaggggtaccggacgtacgtccggtccg

SEQ ID NO: 197286 - DNA, 671 bp, Homo sapiens
  misc_feature: GYAE6OF01AUSLL.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtcctaccgtgacgaaggtctttcgtggttacctaccttttaccaacttataggttactcgtaggtttgggtcgccgacgacggtcccctaggacgaagggtcttggagtggagtgggatggatcgagcgctaacaagtgtacacgaactaactagtcgaccaacaacgtaaccctaccgacggactacgacgtacccaaccgtacgacgaccaacacgaccacacgtacccacgacgaccgacgacctacgacgtcgaccgtgggacgacgtccgtaggacgtactccgacggaaccgacccgggtacggtaccgttaagttaaccttcggtacgtcgggaaccgagaacgggtacgtaacggggttaaatttcgtttacggacgtttcccgttacccgttgttaccgaccgttacggtaccgggaccccgtagggtacccgtcggg

SEQ ID NO: 197287 - DNA, 659 bp, Homo sapiens
  misc_feature: GYAE6OF01A2P62.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaaagcccgtgggggccctcgagtgaaggtcctcctgcaaggcttctggttaccacctttaccaactatggtatctaggttggtgcgacacggcccctggacaacgggcttggacgtggagtgggatggatcgagtcgcttacgaagtcggtacacgaacaactatcgactacacgtaaccctccgagggcagacgtacaccgtatacgacccacacgaccactactacccgacgacgtaccgacggacctacgacgtacggaccgtaggacggaccgtcctggacgtactcgtcggaacgtaccgtacccgggtaccgttacgttacgttacgtggtacggtacggagaacggtacggtaacggggttaaactttcggtttagacccggttccggttacccttacgttttacgacgtttaccggtaccggggacccggtaacgggtaacccgttccggg

SEQ ID NO: 197288 - DNA, 805 bp, Homo sapiens
  misc_feature: GYAE6OF01DEQEI.39.81.H04.1.454.CMB.1.raw
tcagtcgcactagtcacgaccggtgctcgatttagtagtgtagattcgcggggacccaaaaaaccacacccctccttgggagaatcccctagatcacagctcctcaccatggactggacctggagcattccttttctggtggcagcaacaacaggtcgcccactcccaggttcagctggtacagtctggagctgagatgaacgagtccgtggggcctcgagtgaaggtcctcctggactaaggtctttcgtacggttaacctaacccttttaccgaaacgttagttggtacttccgtaggttggggtcgacgtaccgaccggccccgtaggaaccgacgggtcttaggaggtggacggtgggaagtgggaatcggacgccgtacgttaacgaagttccggtaacaacgaaacgtaaaactcgtacggtaccaacgtaaccgtaacccgtaccggacggggtaccaacggtacgttaacccgaccgtagtaccggaaccctaactacggaacctaacgtacctaacccgacggtacgacccgaaccgtccgtaactagtccgggtaactggaacggtacgcgtacggaaagtcgtaccgtaacgaaccggtaccgacggttacgttagttaacgttacccggtaggtcgaaccgggtaggtaaacggttaccgggttaaagggttaaatttaccggtttacccgggtaacccgtttaccgggttaaccccttttcggttaaccggtaacccgtttaaccggggtacccgggtaacccgggttaaccgggaacccccggtttccggg

SEQ ID NO: 197289 - DNA, 812 bp, Homo sapiens
  misc_feature: GYAE6OF01EL11Y.39.81.H04.1.454.CMB.1.raw
tcagtcgcactagtcacgaccggtgctcgatttagtagtgtagattcgcggggcccctagatcacagctcctcaccatggactggacctggagctactttcctttttcgttgggtggcagaccaaacgaacgaggtcgaccccaccgttcccgagggtttccaggtcgttggtaccaggttcgtgggtagcgtagagtagtcggaaccggaacggtcccggtcgggtacccttgaggttacggtaacggttcctacgtagacgtaacggttccgtttacgttacggtttaacctacctttaacctaagttcgttagtacgttaggtagggttggtcgaccgaccggaccggtacccgtaggaacggtagggtcgttaggtagggtggtaggtagggtagtggacgtcggacgtcgtaacctacgtagttacgtaccgaacctaacgtaaactcgacgtaccgaacgacgtaacccgtacgggaacggtacgaacgttaccgaacgaacgtacgaaccacgaaccgaacgaaccctaacgtacccgtaacgacgtacggtacccgaccgtaccgtacggtacgtaacggtacgtacggacgtacgacgtagtacgtacgtcgtacgaccggactcggtatacggtactgtgaggacgtagacggtaacgttaacggttatttaggtaccgttccggtttaaccttcgttaccgttacggtaccggtaccggtacggggtacccgtacggggttaccctacccgttacccgttaccgacccgttaccgaccgttcccggtaacccgtaacccgg

SEQ ID NO: 197290 - DNA, 648 bp, Homo sapiens
  misc_feature: GYAE6OF01BA42J.39.81.H04.1.454.CMB.1.raw
  modified_base (492)..(492): a, c, t, g, unknown or other
  misc_feature (492)..(492): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaagtctcctgcaaggcttcgtggttacctacctttaccaactgtggtatcgtaggttggtgcgacgcggtcccctaggaccgaaggtcttaggagtgggagtcggggtatgggtatcgaggcgtacttaacgagtggtacaacaactaaactatcgaccaacaacgaacccgtccgaagggacacgtacgtacaccagtacgaacccacaacgacacactaccgacgtacgccaaccggactacgactcggactgacggacgtacagagtacncgtacggaaccgaccgtaccggtccgttagttacgttacgtaggtcgacggtaggtaacggtaacggtacgggtaaagtttcggtttagtacgttccggttaacccttgttaccggtacgttaccggtaggggtacccgtacgggtacccgttcgg

SEQ ID NO: 197291 - DNA, 689 bp, Homo sapiens
  misc_feature: GYAE6OF01ATUOI.39.81.H04.1.454.CMB.1.raw
  modified_base (231)..(231): a, c, t, g, unknown or other
  misc_feature (231)..(231): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagcctggggcctcagtgaaggtctcctgngaaggtcttcgtggttaacctacccttttaaccaacttactggttaatcgtaggttggggtacgccgacgacggcccctaggaaccgaagggtcttaggagtggagtggatggatcgagcacttacgaatggtacacaactaaactatcgaccacgaacgtaaccctcgaagggcaacggagtacccacgaataccgaaccaacgtaacgaaccaactacctacccgaaccggacgaccgaacccggtacctaacgaacgtacggacccgtagggaaccggacgtaccgtacgaagtacgtcgtacgaaccgaacgaccgggtaccgttagttaacgttacgtaggtacgacgaggtacgaggtaacgggtaaaagtttacgttttagacgttccggttaccgttacgttacgtaaccgttacggtaccggggaccgtaacgggtaacccgttaccgg

SEQ ID NO: 197292 - DNA, 752 bp, Homo sapiens
  misc_feature: GYAE6OF01D154E.39.81.H04.1.454.CMB.1.raw
  modified_base (193)..(193): a, c, t, g, unknown or other
  misc_feature (193)..(193): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagccaaacaacaggtcgcccactcccaggttcagctggtacagtctgganctgagatgacgagccgtgggacctcgaggtgaacgtcctccgtgacgaaggtcttcgtacgttacctacctttaacactagtagtatcgtaggttcgggtcgacggaccgaccggtccctaggaacgacggtcttaggaggtggaggtagggtagtcgggaacttcgacggtcccgttacttaacgtacgttacggtacctaaccaaacgtaaacttcacggaccaaccgtaacgtaaccccgcggaacgggctaaacggacctaccgaccgtacaccggaaccacggaactacccaaccgtaccaccgaaccggacgaccccgtaaccgaacccgtaagaccggtacggaacccgtagggtaacccgacggtccgaaggaaccttacgtaccggaacgacccggtaccgggtaaccggttcgttaaatcgttacgtcggtccgaaggtagtaccggtaagggttaacggttacgtttacgtttacggacgtttacccggtactttcggttaaccgacgtttacggaccgggttaacccgtaccggttccgttacccgg

SEQ ID NO: 197293 - DNA, 800 bp, Homo sapiens
  misc_feature: GYAE6OF01DOQBY.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcattccttttctggtggcagcaacaacaggtgcccactcccaggttcagctggtacagtcgtggagctgagatgacggacgccgtcggggcctcgaggtgaacggtcctacctgacgaacggtcttcgtcggttaacctaccctttaccaacgtagtcggtactacgtggttagggtcgaccgtaccgacggtccccgtaggaccgaaggtcttaggaggtggaggtggtagtggactcgagccgtattaacgagtttccggaacaccgtaactaacgttgacgaccgaacgaaccgtaacccgtcggacgtacgaaggtactaccacgtacgacgaaactacgaacgtaccaagtcctacccgaagggtaccacccggtaacgtacctaagtaccggtaccggtaacgttacgggaaccgtacggtaccttagggaacgtacgttaccggaacgggtaacccgaaccgggttaccggttacggttaacggttttaccgtacgttaccgggaggtaacgggtaaaccgggttaggtaacccggggttaaggggttaaaccttttaaacggtttaccggtacggttttaccccggttttacccggttagtttaaccccgggacgtttacccgggggtacgggaaaccccgggtttcccggaacccggtttacccggg

SEQ ID NO: 197294 - DNA, 724 bp, Homo sapiens
  misc_feature: GYAE6OF01C43PI.39.81.H04.1.454.CMB.1.raw
  modified_base (232)..(232): a, c, t, g, unknown or other
  misc_feature (232)..(232): n is a, c, g, or t
  modified_base (474)..(474): a, c, t, g, unknown or other
  misc_feature (474)..(474): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttctggtgcagcaacaacaggtcgcccactcccaggttcagctggtacagtctggacgctgaagagtcggaaccggtaacgccggtcggggtccctaggnggtacggaacgggttcctaccgtggacgaaggtccttacgttacggtttaacctaacctttaaccaacgttagtcggttactccgtagggttcggtacggcgtaccggaccggtccctagggaaccggtagggtccgtaggtaggttggtaggtggagtcgggatcgtagaccgttactaacgtacgtcgtacaacgtaataacgtagcgactaacgacgtactcgacggacagacgtaccngagtccgaacacgacgtaacacaccgtacacgacgaccgacgtactaacgtcgacgtaccgagggacgtacggtactacggacgttacgacgtacgaacgaccgtcgggtacttaggtactaggttcgacggtagtaccggtaggtaacccgggtaagttaacgttttacgacgttaccggttccggttacccgttagttaccggtacggtacgggtcccggtaccggtaaccgggtcccgttacccggg

SEQ ID NO: 197295 - DNA, 675 bp, Homo sapiens
  misc_feature: GYAE6OF01DB2DT.39.81.H04.1.454.CMB.1.raw
  modified_base (340)..(340): a, c, t, g, unknown or other
  misc_feature (340)..(340): n is a, c, g, or t
  modified_base (453)..(453): a, c, t, g, unknown or other
  misc_feature (453)..(453): n is a, c, g, or t
tcagtcgcactagtcacgaccggtgctcgatttagtagtgtagattcgcggggacccaaaaaccacacccctcttgggagaatccctagatcacagctcctcaccatggactggacctggagcattccttttctggtggcagcaaacaacaggtgcccactcccaggttcagctggtacagtctggagctgaagatgacgacgccgtggggcctcgagtgaaggtcctcgtgctaaggtcttcgtacggttactaaccctttaacaacgttagtggtaactcgtggtttagggtcgcgaacacggcccctaggacgaaggtctggagtggagtggatggntcagcactagaacttggacaacgtaactaacgtatacggacaacgtaacgaacccgtcgaggaacgtaaggtactaccgaacttacgaacgaaccagaaacgtacacgtaacncgaacgactaccgacgtactaacgaagtacggacgtacggacggtaagcgttagatacgtacgtacgaaccggtactacggtaacgttcgtaacgttcgaggtacgtacggaggtaaacgacggttacggtaaaggtttacgttaacggttactttaccggtaccgtttcgttaaacggtccgtaaacgggttccgggaacggcccgggtttagtaacccgg

SEQ ID NO: 197296 - DNA, 716 bp, Homo sapiens
  misc_feature: GYAE6OF01A07W7.39.81.H04.1.454.CMB.1.raw
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaacggtctccgtgcaaggtcttcgtcggtttacctaccctttaaccaacttagttggtatcgtaggtttggggtgacgtacgacggtccccgtaggaacaaggggtccttggaggtggtagtgggattggactcgagtccgactttaacgaagttcggtacaaccgtaacctaaaattacgtcgacaaccgaacgtaaaccctccggaaggggaccacggtaacgtaccaacccgagtaccggaaccacgaacgaaccaaccactacccgacgacgaccgacccggccctaagacgtacggaccgtacggacgggtaccgtaccgtaggagactacgtacggaaccggaaccgaccggtaccgttacgtttaaccgttacgttcggtacgacggaagtaacggtaaggtaacgggtaacgttagttacggtacgttcccggttaaccttcgttacgtacttacgggaccgggaccgtaccgggtacccgttaccgg

SEQ ID NO: 197297 - DNA, 792 bp, Homo sapiens
  misc_feature: GYAE6OF01D5GGG.39.81.H04.1.454.CMB.1.raw
  modified_base (125)..(125): a, c, t, g, unknown or other
  misc_feature (125)..(125): n is a, c, g, or t
tcagtcgcactagtcacgaccggtgctcgatttagtagtgtagattcgcggggcacccaaaaaccacacccctccttgggagaatcccctagatcacagctcctcaccatggactggacctggancattccttttcgtggtggcagcaaacaacaggtcgcccactccctagttcagctaggtacagtcctggagctggaagactagacgaacgcctcggggcctcgagtagaacgtcctacgtagtacgaaacggttcttacgtcggttaacctaccgtttaaccaacttagtcggttaatcggtaaggtttcgggtacgaccggaacgaccggtcccggtaggaaccgaacgggtccgttaggaacggtggtaggtagggtacgttaggaacgttacggacgtacggttacctttaaacgtaacgttacgtaaccaacaaacgtaaaacctagaccggtaacaacgaacgtaaccgtacggaacgaggaaccgtactaaccgaacctaagaccgaaaccgaacgtaacaccgtaaacacgtaaccgacgaacgtaaccgacggtaactaccgtaagtaccggaactaaccgggagaccggtaaccgtcggaacgtacgtacgtaaccggtaacggaacgtaccgggttaacttacgttaacgtacggtaggaaccggtaggaagtaccggaaaggttaacgggttaaattaccgtttaggtaaccgtttaccggttaacctttcggtaacgtacctaacccggggtcgggaaccggttaacgtacccggg

SEQ ID NO: 197298 - DNA, 1017 bp, Homo sapiens
  misc_feature: GYAE6OF01CRDM2.39.81.H04.1.454.CMB.1.raw
  modified_base (125)..(125): a, c, t, g, unknown or other
  misc_feature (125)..(125): n is a, c, g, or t
tcagtcgcactagtcacgaccggtgctcgatttagtagtgtagattcgcggggacccaaaaaaccacacccctcttgggagaatcccctagatcacagctcctcaccatggactggacctggganctattccttttcgttgggtggcagcaaacaacaggtcgcccacctacccgtaggtttccaggtcgttggtacctaggtcgttagggacgcgtaggagagtacggaacggaacggtcccggtcggggccctaggtaaggtggaaggttccttaccgtaggccgtaaacggttactttccggttacggttaaccttaacccgtttaaccgtaaacttggtacggttactacggtaggttgggacgaccgtacgaccggtacccgtaggaacggtagggttcgttaggaggtacgggtaggtaggggtagtggtaccgtacggtacgtccgttaacgttaaccgtaagttacgggtaacccaaaccgtaaaaccgtaaacgttaccgacgaaacccttaacggaaaacccgtacccggtaaccggaacggggacccgaaaggtcctaaacccgtaacccgtaacgggtaaacccgaaccgaaccggaacgaacccgtaaacaccgtaaacccggaaccgaacggtacccccgtaaaccgggtaccttaaaccgggtacggtaaccgggtaaccgggtaaagggtaccgggtaaccgtcgggtcgggtaaaacgttacggaacccgggtaacggaaccccgggttaaccggggtaacccggttacccggttttaaggtttaccgttaacgggtttacggaaccggggtttggaaacccggggtttagggaaaccgggtttaaacggggtttaaacgtttttaaccgggttttacccgggttaacccgttttaccggggttaacccgtttttaacgggttacccggttacgggtttaacccggggttacccgggggaaaaccccggtttacccgggtaaccccggtttaacccgggg

SEQ ID NO: 197299 - DNA, 775 bp, Homo sapiens
  misc_feature: GYAE6OF01DGVSO.39.81.H04.1.454.CMB.1.raw
  modified_base (151)..(151): a, c, t, g, unknown or other
  misc_feature (151)..(151): n is a, c, g, or t
  modified_base (156)..(156): a, c, t, g, unknown or other
  misc_feature (156)..(156): n is a, c, g, or t
tcagtcgcactagtcacgaccggtgctcgatttagtagtgtagattcgcgggacccaaaaaccacacccctcgttgggagaactcccctagatcacagctcctcaccatggactggacctggagcattccttttctggtgcagcaacaacnggtcnccactccaggttcagctaggtacagtcgtgagtcgtagagtagtggaacggaacgccggttggggcccttagaggtaggtaacggtcctaccgttaggaccgtaaggttccttaccgtttacggttaaaccttacctttaaccgaagttagttacggtaacttggtacgggtttggacggacgtaaccgccggtacccgtaggaaccgtaggttccttagggaggttagaggtaggtacgtggtaacgttcgaggtacctacttaacggtaacgttacgtaaaccaaactaaccggtttaaacacgtacggaccaaaccgaaccggtaaccgtaccgggttaacgacgaaacggttaacgaccctaacggactaaccggaactaacggaaccaacacgttaaccaccggaacgacgacgaacccgtacgaagtaacggcgaacgtaggaccgtaaccgcgacgtactaacggtcgtaacggaacctaaccgggtcgttacgttaacgtacgttaggttccgggagtacgtaagaggttacggttaaatacgtttacgttaaggtccgttaccgttagtcgttacgtccggtaacggaggtccgtaaccggtcgtaaccg

SEQ ID NO: 197300 - DNA, 757 bp, Homo sapiens
  misc_feature: GYAE6OF01E0L5O.39.81.H04.1.454.CMB.1.raw
  modified_base (337)..(337): a, c, t, g, unknown or other
  misc_feature (337)..(337): n is a, c, g, or t
  modified_base (342)..(342): a, c, t, g, unknown or other
  misc_feature (342)..(342): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatcctttctggtgcagcaacaacaggtcgcccaactcccaggttcagtcgtaggtacagtctggagtctagagtatgacgaacgtccgtggggcctcaggtgaacggtcctcagctagtcttactacgttactaccttaacactagtgtactgtacgttggacgacgacgccgccggtaggacgaggtcgtaggacggtggacgtggtagngtacncgtacgtacgtacgtaactagtacgtacctaacgaactaacgtacgtacgacgtaacgaaccggaccgtacggacggacgtacgtaacgtaacgtaaccgacgtaaccgaccgtacgacaaccgtactaccgtaccgaaccggtacgtaccgaccggtaccaggtaccggtaacgtaccggtaggtaccgggtacgtacggtagtaccgaaccgtcggtaacccgaccggttaaccggtccggtacgttaacggtacttacgggtacgtacggggaaccgttaacggtaggttaaacccgggttaaggtttaactttaccgggttaacgtaccggtttaccccgtacgttttaccggaaccggttacccggtacggggtaaccccggttaacggtacccggggtcccgttaacgg

SEQ ID NO: 197301 - DNA, 783 bp, Homo sapiens
  misc_feature: GYAE6OF01EIY7L.39.81.H04.1.454.CMB.1.raw
  modified_base (168)..(168): a, c, t, g, unknown or other
  misc_feature (168)..(168): n is a, c, g, or t
  modified_base (203)..(203): a, c, t, g, unknown or other
  misc_feature (203)..(203): n is a, c, g, or t
tcagtcgcactagtcacgaccggtgctcgatttagtagtgtagattcgcggggacccaaaaaccacacccctccttgggagaatcccctagatcacagctcctcaccatggactggacctggagactattccttttcgttgggtaggcaggacaaacaactagggtcncccactccgagttcagcgtggtacagtcgtggacnctaggagatacggacggaacgccggtgggcctagaggttcggaacggttcctcgtagtacgtaaggtcttacgttacggttacctaccgtttaaccaagttacgtaggtaacttcgtacggttggggtaccgacgtacgaccggcccgagggaaccgtaaggtcttggacggttaggaggtagggacgtggacgtcgaacgtacgtattaacgtactacgggtaacaaccgtaaactaacgtactaccgaacgtaacgaacgtacccgtacgaagggtacgaacggtacgtaaccgaacgtagtaccgtacctaaacgaacggttaaccaacgtaccgtaccccggaagtacggtaccgaacccgttacgaacgttacggtaccggtacgtagggtaccgacggtacccgtaggtacgtacgtacgaacggtacaccgggtacgtacgtcgtttaaacgtggtacgaggtaccgaggtaacgtacgggtaaacggttaacgtttcgttaacggtacttaccggttaccctggtttacgacggttaacggggtacgaacggtacccgggtagttaccccgg

SEQ ID NO: 197302 - DNA, 727 bp, Homo sapiens
  misc_feature: GYAE6OF01CRJOP.39.81.H04.1.454.CMB.1.raw
  modified_base (124)..(124): a, c, t, g, unknown or other
  misc_feature (124)..(124): n is a, c, g, or t
  modified_base (433)..(433): a, c, t, g, unknown or other
  misc_feature (433)..(433): n is a, c, g, or t
tcagtcgcactagtcacgaccggtgctcgatttagtagtgtagattcgcggggacccaaaaaccacacccctccttgggagaatcccctagatcacagctcctcaccatggactggacctggancatccttttcttggtggcagcaacaacaggtcgcccactcccaggttcagctggtacagtctggagctgagatggacgaacgccgtcggggcctacgaggtaggaacggtcctccgtgaccgaaggtctttaccgtacggtttaacctacccttttaaccaacgttagttacgggttaatccggttaagggtttgggtcgaccggaccgaccggtccccgttagggaacgacgggttcttggaggtgggtacggtagggtagtcggatacgcgtccgtactacgtacgtcggtaccaacgaactaactntcgacaccgaacgaccctaccggaggacaggactaccacacgtacgaccacgacacgtaccacgtacccgacgtacgaccgtacccgtacctagtacgtccggtacgtaggaccgtacgccgtaaggactaacgccgttaaccggaccgtaccggacggttaccgttaagttacttacggtggacgtacggaaggtacggtaacggttagggttaactttcgttacggtacgttaccgtaccgtttgttaccgtacggttaccgggccgggtacccgaacgggttccctacggg

SEQ ID NO: 197303 - DNA, 795 bp, Homo sapiens
  misc_feature: GYAE6OF01DF276.39.81.H04.1.454.CMB.1.raw
  modified_base (273)..(273): a, c, t, g, unknown or other
  misc_feature (273)..(273): n is a, c, g, or t
  modified_base (280)..(280): a, c, t, g, unknown or other
  misc_feature (280)..(280): n is a, c, g, or t
  modified_base (288)..(288): a, c, t, g, unknown or other
  misc_feature (288)..(288): n is a, c, g, or t
  modified_base (318)..(318): a, c, t, g, unknown or other
  misc_feature (318)..(318): n is a, c, g, or t
  modified_base (352)..(352): a, c, t, g, unknown or other
  misc_feature (352)..(352): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctgggagctgagatgacgaaggcctggggctcgagtgaaggtctcctgcgaaggtcttctggttacctaccgttaccaactatgtatcnggttggngtcgaacncggccctggacgaagggtctggagtggtanggggtagtggtatcgaaggtccgtacctttaaanacgttacgggtactaaacaacctaaaaccgttagacggacctaaacgtaaacccggtaaacccgttacccggaaggggacaacgggtacggtaccctaaaccctagtaccggaaccaaccgaacggaaaccaccgtaactacccggaacggtacgaaccccggaacccggccgtaaaccgtacggttaacggaccccgggttaaggaacccggtaacggaccccgtaggtaaactagtaccgtaacggttaaccgaaccccgtaaccgggtcccgttaagttaccgttaacgtacggttcggaacggtaaacggaccggttacgggtaaacgggtttaaacgtttacgggtttaccgtaagggtttcccgttaaccgttttagttaaccgggttaccggtaaccgacgggggtttacccgaacggggtacccgttaccccggg

SEQ ID NO: 197304 - DNA, 891 bp, Homo sapiens
  misc_feature: GYAE6OF01CF0BI.39.81.H04.1.454.CMB.1.raw
  modified_base (836)..(836): a, c, t, g, unknown or other
  misc_feature (836)..(836): n is a, c, g, or t
tcagtcgcactagtcacgaccggtgctcgatttagtagtgtagattcgcggggcccctagatcacagctcctcaccatggactggacctggagcattccttttcttggtggcagcaacaacaggtcgcccactcccaggttcagctggtacagtcgtaggagctaggagagtagaacgacgccgtgggcctcgagtggacggttcctccgtgacgaaggtcctttcgttcggttaacctacctttaaccaacgttacgtggttactcggttacgggtttaggggtcgaccgtaccggaccggtaccccgtagggaaccggaacgggttcgttagggtaaggtggggtaggttcggggtaacgtacggtaacgttccggaacggtacccgtaacctttttaaccggaaggtttaccgaaccaaacgtaaccgtaaaactggtaacgaccaaccggaacctaacccgtacggaacgggcgtaaacggtaccgtaaccctaacgtacgtaacccgaaccggtacaaccgaaaccgtccgtaaccctaaccggaccggtaaccggtaaccgccccgggttaaccgtaccgtaaggtccccggggttaacgacgggtaacggtaccccggtacgttacgggtaaactccggttaccggtaaccggaaccgttacccgttaaccgtttacgtttaggtacttaaacggtgacggttaacgggagtaacgggttaccggtaaaggttacttttaacggtttacgacccgggttacgtttacccttacgggtttaagttacccgggacgggttaccgggtaaacccggtcccgggtttacccgngttacccccgttaccttcccggtaaccctttccgacccggtttccccaaaccggg

SEQ ID NO: 197305 - DNA, 914 bp, Homo sapiens
  misc_feature: GYAE6OF01B2Y2I.39.81.H04.1.454.CMB.1.raw
tcagtcgcactagtcacgaccggtgctcgatttagtagtgtagattcgcgggggacccaaaaaccacacccctccttgggagaatcccctagatcacagctcctcaccatggactggacctggagcattccttttcttgggtggccagtcaacaacgaggttcgcccactcccgaggttccagtcgtaggtacaggttcgtggagtctaggagtacgtcggaacggaacggtcccggtagggggccctcgaggtacggtaacggtcctaccggtgacgtaacggttcttacgttcggtttaaccctaaccttttaaccgaacgttagtacggtactcgtagggtttgggacgacccgaccggtaccgggccccgtaggggaacgtacggggttcttagggacggtacggggtaggtacggggagtaggaactacggacggtccgttaccgttaaccggtaggttccggtaaccaaccgtaaacgtaaacgttcgtaccggacctaaaccggaaccgtaaaccccgtacgggaacgggtaacccgaacggtaaccggtacccaacgtaacggtaccgaaaccaccgtaacgaaccgtaccctacgtaacccgaaccggtaacggaccccgttacccggaaccgttaacgacggtaccgggtaaccgagggtaaccgggtaccgttaccggacggttaaccggttacgtacccgttaacggggaacccgtaccgggtacccggttacgtttaacggtaccgttaccggtggttacgggaaccgggttaaggaacggttacgggttaacggtttaacttacgggtttacgtcccgggttaacgtttcccgtttacgttaacgggtcccggttaccggggtacggggaacccgtttaacccggggtccccgttacggg

SEQ ID NO: 197306 - DNA, 698 bp, Homo sapiens
  misc_feature: GYAE6OF01CI8JT.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagctattccttttctggtggcagcaacaacaggtcgcccactcccaggttcagctggtacagtctggagcgtgagagtgacgaagccgtggggcctcgagtgaaggtcctcgtgacgaaggtcttcgtaggttacctacctttaccaacttagtggtactcgtaggttcggtgtcgacgtacggccccgtagggaccaagggtccttaggaggtggtagtggtagtaggactcgagtccgtacttaacgaagttggacaacgaactaaactagtacgacaaccgtaaacggacccctacgacgggtacaacggtagttacccgaacgaacgtaccgaacctaacgaacgtaccgaactaccgtacgacgtacgaccgaccgtactacgacgtacggtacgtaggacgacgctaggacgtataccgacgacggtaccgacggtaccgtagttacgtacgtggacgacgagtacgtaggtaacggttaagttccgtttagtaccggttaccgttacccgtttacgttacgttaccggttaccgggtagggtaccccggtaagggtcccccgttacggg

SEQ ID NO: 197307 - DNA, 787 bp, Homo sapiens
  misc_feature: GYAE6OF01AXYZ5.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtcgcccactcccaggttcagctggtacagtctggagctgagatgacggaacgccgtgggcctcgagtaggaacggtctccgtagcgtaaggtctttcgtacggttacctacctttaaccaacttagtggtactacgtaggttggtcgcgacgacgcccgtaggacgaggtctaggagtggagtggagtggactcgacgtacgtacttacgagtcgtaccaacgtaactaaactacgtacgtaaccaaccgtaaccgtaacccgtacccggtaacgggacgtaacgggtacgtaacccgaacccgaagtacccgaaacccaacgacgaaccctaacaccgtacccgaacggaccgaaccgacccgggtaaccttaacgaaccgtaccgggtaccgtacgggaaccgtaccggtaccgtacggaacgttaccgtccgtaacggaccggaaccggtacccgggttaccgttacgtttaaccgttacggtacggacggtacggtaaggtaacggtaacgggttaaacggggttaattttaacggttacggtaccgtttcccgttaccgtttacgtttacggtaccggttaccggggttaccgggaacccgggttcccggttaacccggttaccggg

SEQ ID NO: 197308 - DNA, 713 bp, Homo sapiens
  misc_feature: GYAE6OF01DGIWW.39.81.H04.1.454.CMB.1.raw
  modified_base (121)..(121): a, c, t, g, unknown or other
  misc_feature (121)..(121): n is a, c, g, or t
  modified_base (140)..(140): a, c, t, g, unknown or other
  misc_feature (140)..(140): n is a, c, g, or t
  modified_base (146)..(146): a, c, t, g, unknown or other
  misc_feature (146)..(146): n is a, c, g, or t
  modified_base (184)..(184): a, c, t, g, unknown or other
  misc_feature (184)..(184): n is a, c, g, or t
  modified_base (380)..(380): a, c, t, g, unknown or other
  misc_feature (380)..(380): n is a, c, g, or t
  modified_base (396)..(396): a, c, t, g, unknown or other
  misc_feature (396)..(396): n is a, c, g, or t
  modified_base (403)..(403): a, c, t, g, unknown or other
  misc_feature (403)..(403): n is a, c, g, or t
  modified_base (424)..(424): a, c, t, g, unknown or other
  misc_feature (424)..(424): n is a, c, g, or t
  modified_base (535)..(535): a, c, t, g, unknown or other
  misc_feature (535)..(535): n is a, c, g, or t
  modified_base (587)..(587): a, c, t, g, unknown or other
  misc_feature (587)..(587): n is a, c, g, or t
tcagtcgcactagtcacgaccggtgctcgatttagtagtgtagattcgcggggacccaaaacacacccctcttgggagaatcccctagatcacagctcctcaccatggactggacctgganctattccttttctggtcgnagcaanaacgtaggtcgcccactcccagttcacgcgtaggtacngtcgtgggatcgtgagagtaggacggaacggtccgggtgggtcctcggtaggtacgtacggtccttccggagacgacggttcttacggtacgttacccttaaccctttacgacttgtacgtagttcgtagggttcggagaccgaccgacgtcgacggaggtacggtacgttggaggtggagaggacgttgacgcgnggtactactcgtagcnctaacanaacgtcgacagtaaccgtacncgggaggctaacgactaccgactaacggtacaaccgaacgtaccacctactacgacctaaccgggccgtacgaacccgtcaacgcgtaacgggaccttagggacgtaccgngtaacggacgtcgttacggaccgggactaacccggggttacgtaaccggttnttacccggtgtaacgggtcggaaggacggtaggtacgttaaagggttactttacggtagtaacgtttacccgtttaccgagtttacccggacggggtaccgtaggtaacccggtgtccccgtccgg

SEQ ID NO: 197309 - DNA, 674 bp, Homo sapiens
  misc_feature: GYAE6OF01EYQXP.39.81.H04.1.454.CMB.1.raw
  modified_base (107)..(107): a, c, t, g, unknown or other
  misc_feature (107)..(107): n is a, c, g, or t
  modified_base (251)..(251): a, c, t, g, unknown or other
  misc_feature (251)..(251): n is a, c, g, or t
  modified_base (305)..(305): a, c, t, g, unknown or other
  misc_feature (305)..(305): n is a, c, g, or t
  modified_base (341)..(341): a, c, t, g, unknown or other
  misc_feature (341)..(341): n is a, c, g, or t
  modified_base (348)..(348): a, c, t, g, unknown or other
  misc_feature (348)..(348): n is a, c, g, or t
  modified_base (365)..(365): a, c, t, g, unknown or other
  misc_feature (365)..(365): n is a, c, g, or t
  modified_base (479)..(479): a, c, t, g, unknown or other
  misc_feature (479)..(479): n is a, c, g, or t
  modified_base (517)..(517): a, c, t, g, unknown or other
  misc_feature (517)..(517): n is a, c, g, or t
  modified_base (615)..(615): a, c, t, g, unknown or other
  misc_feature (615)..(615): n is a, c, g, or t
tcagtcgcactagtcacgaccggtgctcgatttagtagtgtagattcgcggggacccaaaaccaccacccctccgttgggagaatcccctagatcacagctcctacnccatggactggacctggagcatccttttccttggtggcagcaacaactaggtgcccactccccaggttcagctggtacagtctggagctgagatgacgaagccctggggcctcagtcgaacggtctccgttgcaaggctttccnggtttacaccctttaccttaaccgtatgtatcgtagttcgggtcggcggaccgncggacccgtacgggtacgtacgggtacgtacggacngttgganttagggtacgttacggntacgtacgtacggtaccgtacgttaaccgtaacgttacggtaccgtaacctaaccgtaaactaacgtaccgtacgtacgtaacgtaacccgtaccgaacggaccgtacgaacgntaccgaccgtaccgaccgaaccaaccgaaccgaaccgnaccgaccgtaccgccgtaccgtaccgaccggtaccgtaacgtacgtacggaccgtacggtacggacgtacgtacgacgtacgtacgtaccggtaccgntacgtaccgtacggtcgtacgtacgtacgtacgtacggaagtacgttaggtacggtacg

SEQ ID NO: 197310 - DNA, 704 bp, Homo sapiens
  misc_feature: GYAE6OF01CNWNF.39.81.H04.1.454.CMB.1.raw
  modified_base (190)..(190): a, c, t, g, unknown or other
  misc_feature (190)..(190): n is a, c, g, or t
  modified_base (399)..(399): a, c, t, g, unknown or other
  misc_feature (399)..(399): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctgganctgagatgacgaagccgtgggcctcgagtgaagtcctacctgacgaaggtctttactacggttaacctaacccttttaccaaacttataggttaattacgtaggttgggtcgcgaacgacggtccccgtaggacgaagggtccttggaggtggaggttaggagttgactcgaggtcgtacgttacaagtcggtacaacactaaaacgtntacgacaacgaacgaaccctacgaggcaagagtacaccagtaccgaaccaactaagaccaacgactaccgaacgacgcaacccggttaccaactaagtcggaacctaggaaggacgtacccgtaaggaccgtattccgacgggaaccgaaccggtacggtcccgttaagggttactttacggtagtacggagtaacggtacgtaacgggtacgggttaaaagttttcgtttaacggaccgttacgggttaaccccttgtttaccgacgttaacggtgggaacccgaacgggttacccgttaccgg

SEQ ID NO: 197311 - DNA, 873 bp, Homo sapiens
  misc_feature: GYAE6OF01AV7UH.39.81.H04.1.454.CMB.1.raw
tcagtcgcactagtcacgaccggtgctcgatttagtagtgtagattcgcgggggtacccaaaaaccacacccctaccttgggagaatcccctagatcacagctcctcaccatggactggacctggagcatcctttcttggtggcagcaacaacaggtgcccactcccaggttcagctggtacagtctggagctgagatggacgaagccgtggggcctcagtgaagtctcctgacaggtcttcgtggttacctaccttacaagtatggtactcgaggttgggtgccgtacgacggtccccgtggaccgtaaaggggtccttaggaggtggagtggggactggtactacgaggacgtacgtttaaccgaagttcggtacctaaccgaacaaaaccttacgtacggaccctaaccgtaaaccggtaaacccgtaccggaacggggaccgtaacggtacggtacccaaacccgtaagtacccgaaacccacgaacgacctaacgactaccccgaaggacgaccgtaaccgggtaccctaacgaacgggtaccgggaaccctaggggtaaccgggtaaccgtcccggttaaggtacggtaaccgttccggtaaacgggaacccgtaacccggttaacccgggggtaccggtttacgggtttaaaccgtttacgggtaccgggttaccgggaacggtaacggtaacgggtaaacggggttaaacccggggtttaaaagttttcggtttttaaccgggtaacccggttttacccggttaaacccccgttttcgggtttaaaaccccggttcggttaaaccccgggggtcccgggggaaacccccgttaaacggggggtacccccccctttaaaccggggg

SEQ ID NO: 197312 - DNA, 907 bp, Homo sapiens
  misc_feature: GYAE6OF01C8UU5.39.81.H04.1.454.CMB.1.raw
  modified_base (365)..(365): a, c, t, g, unknown or other
  misc_feature (365)..(365): n is a, c, g, or t
tcagtcgcactagtcacgaccggtgctcgatttagtagtgtagattcgcggggacccaaaaaccacacccctccttgggagaatcccctagatcacagctcctcaccatggactgggacctggagcattccttttcttgggtggcagcaacaacaggtgcccactcccaggttcagtctggtacagtcgtggagcgtgagatcggacgaacgccgtcggggcctcgaggtgaacggttctccgtgacgaacggtcttcgttacggtttaacctaccctttaacctaaacttacgttaggtactacgtaggttggggtacgacggtaccgacgggtccccgtaggggaccgaaggggtcttagggnggttgggacggttgggagttggacgtacggtaggcgtaacttacgtaacgttacgtaccgaaccaaaacgtaacgttacgtacgactaaaccgaaaccgttaaccgaccggaacgggtacaaacgggaccgttaaccaccgtaaggtaaaccccgaacccgtaaacggaaccgtaacccgaaaccgttaacccgaacccggaaaccgggaaccggtaacccgggtaacccggtacccgttaaaccggtacggttacccggtacccgggtaaggggaaccgtaccggtaccgttacgggaacgtacggtaaccggtacggaacccggtaaccgggtaacccggtttccggtttaaccggtttaacgttaccgggttagggtacccgtacgggtaacgtaaacggggtaccgggtttaaagggtttaaccgttttacggtttacgggtacccggtttaccggttaaccccgtttaggtttacccggttaacggttacccggggacggggttaaacccggtaccggggtaaccccggttacccgg

SEQ ID NO: 197313 - DNA, 821 bp, Homo sapiens
  misc_feature: GYAE6OF01AECOQ.39.81.H04.1.454.CMB.1.raw
tcagtcgcactagtcacgaccggtgctcgatttagtagtgtagattcgcggggacccaaaaccacacccctccttgggagaatcccctagatcacagctcctcaccatggactggacctggagcattccttttctggtggcagcaacaacaggtcgcccactcccgtaggttcagcgtagtacagttcgtggagcgtgagagtcgacgaagtccggtcgggcctacgagtaggaacgtcctccgtacgacgtacgtcttcgtacgttaccttaccttaacgacgttagtgttacgtcgttaggttgggtacgaccggacgtacccgggtcccgtaggaacggtacgggtcgttagggtacggttgggacggtagggtacgtaggaccgttacggacgtaccgttaccgtttaaacggtacggtaccggttaaccaaaccgtaacgttaacgtcgtaaccgaccgtaaccgtaacccggtaacccgtacggaacggtaacgtaccggtaactacccgtaaccgaacgacccgtaacccgacgacgtaacccgacctaccgaaccgaaccgtacggaccgtacccgtacgttaacgacggtaggaccgtacggacggtaccgacgtagtaccgagtaccgtaaccgaccggaacccgttaccggttacgttaacggttaccgttacggacggtacggacgttaagggaccgttaacgggttaacgtacggttttaacctagtttacccggactttttacccgtagttaccgggttaccggttaccgggacgggacccggtttaaccgggcccgttaacccggg

SEQ ID NO: 197314 - DNA, 857 bp, Homo sapiens
  misc_feature: GYAE6OF01C03N1.39.81.H04.1.454.CMB.1.raw
  modified_base (166)..(166): a, c, t, g, unknown or other
  misc_feature (166)..(166): n is a, c, g, or t
  modified_base (184)..(184): a, c, t, g, unknown or other
  misc_feature (184)..(184): n is a, c, g, or t
tcagtcgcactagtcacgaccggtgctcgatttagtagtgtagattcgcggggcccctagatcacagctcctcaccatggactggacctggagcattccttttcttggtggcagcaacaacaggtcgcccactcccaggttcagctggtacagtcgtggagctganatgaacgagcgtgggccnagtgaggtctcgtgcgagtcttcgtcgttaacctacctttaacaacttagttacggtactcgtaggttcgggtcgaccgtacgaccggtcccgaggtaacggaacgggtcttggaacggtggtacggtggtaagtcggatccgaggccgtacgtttaaaccgtagttcgtaccaacgaaacctaacgttagcggaacctaacggaaaccgtaaccccgaccggtaacgggaccgtaacgaaccggtaccctaaacggtactaaccgaacccgaaacgtaaccgtaaccgaacctaacccgtaaccgggaaaaccggtccgaaccccggtaaccggttacccgtaaacgtaaccggttaccccgggaacggtaccgggaaacgggtaccgtacccggtaaggtaacgtaccgtttaccgtaacgggaaccccgtaccgggtaacccgggttccggttttaacgttaaccgtttacgggtttcggtaacggacggtaacggttaaggggtaaaccggttacggggttaaactttttacggtttaccggtttaacgggtttaacccggttaccgtttacgtttacggtaccggttaacggttcccggggtaaccggtaaccgggtacccggtttacgtcctacccggttccgtactcccgaccgtcccgtacccgg

SEQ ID NO: 197315 - DNA, 897 bp, Homo sapiens
  misc_feature: GYAE6OF01BKYEC.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaacgccgtggggcctcgagtgaacggttctcctggacgaaggtcctttcgttcggttactacccttttaaccaacttagtacggtaatacgtaggtttgggcgtaccggaaccgtaccgggccccgtaagggaaccgtaaacggggtcgtttggaacggttgggtaacgtcgggggtattcgggacttacggaggtaccgtaaccttttaacgaagtttaccgggtacaaacctaaaaccgtaaaaccgttagtaccgaaccgtaaaccgtaaaccggtaaacccccggtacccggtaaacgggggacctaaacgggtaaccggttaacccaaacccgtaagtaacccggaaaccccaacgtaaaccggaacctaaccgtaacgtaccccggaaacgaaccggacccgaacccgggtaacctaacggaacgttaccgggaaccgtagggaacggtaaccgtccgtaggacgtaccgtacgaacggaaccggaaccggtaccgggtccgttagtttaacgttcgtaacggtcggaacggtaaaggtacgggttaaacggggtaacgggtttaaacgttttacgttttaacggtacccggtttacccggtttaaccctttcgggtttaaccgtaacccggggtttacggggtacccggggtaaaccccgggttaaaccggggtccgttaaccccgggg

SEQ ID NO: 197316 - DNA, 635 bp, Homo sapiens
  misc_feature: GYAE6OF01DNG1P.39.81.H04.1.454.CMB.1.raw
  modified_base (185)..(185): a, c, t, g, unknown or other
  misc_feature (185)..(185): n is a, c, g, or t
  modified_base (366)..(367): a, c, t, g, unknown or other
  misc_feature (366)..(367): n is a, c, g, or t
  modified_base (410)..(410): a, c, t, g, unknown or other
  misc_feature (410)..(410): n is a, c, g, or t
  modified_base (416)..(416): a, c, t, g, unknown or other
  misc_feature (416)..(416): n is a, c, g, or t
  modified_base (432)..(432): a, c, t, g, unknown or other
  misc_feature (432)..(432): n is a, c, g, or t
  modified_base (459)..(459): a, c, t, g, unknown or other
  misc_feature (459)..(459): n is a, c, g, or t
  modified_base (474)..(474): a, c, t, g, unknown or other
  misc_feature (474)..(474): n is a, c, g, or t
tcagtcgcactagtcacgaccggtgctcgatttagtagtgtagattcgcgggggacccaaaaaccacacccctccttgggagaatcccctagatcacagctcctcaccatggactggacctggagcattccttttcttggtggcagcaacaacaggtcgcccactcccaggttccagctggtacngtctggagctgagatcgacgaagccgtggggcctcgagtgaacggtctcctgcgaagtcttacgtgtacctaccttacactagtggatcgtaggttggcgtcgacgcggtccctagacgaggtcttggaggtgagtgggatggtactcaggctctaacgagtcggtacaacaactaactannacgaacacgtacccacgaggcaagactacacagacgaacccanactaanaccacgaccaggaacnccgacgtaccaacgtacgacggtacgnggacggacgtaccgnggtaacgacttaccggacgtaacccggacggtaacgggtcccgttaaggttacgtttaacgtggttacggaacgacggtaaggtaacgggtaaggttaacgtttaggttacgtacgttccgttaccttgtacgtacggtacgtcggacgtccggtcgtcgg

SEQ ID NO: 197317 - DNA, 829 bp, Homo sapiens
  misc_feature: GYAE6OF01D0M3W.39.81.H04.1.454.CMB.1.raw
tcagtcgcactagtcacgaccggtgctcgatttagtagtgtagattcgcgggacccaaaaaccacacccctccttgggagaatcccctagatcacagctcctcaccatggactggacctggagctattcctttttcttggtggacaggacaaacaacaggtcgcccactcccgagtcagctggtacagtctggagctagagatggacgacgccgtgggcctacgagtaggaacggtctaccgtagacgaacggtcttacgtacggttaacctacccgtttaactaacttagttcggtacttacggtaggttgggtacgacgtaccggaccggtacccgtaggggaaacgtacgggtcgttaggtacgggtggtaaggtcgggtaagttcggtaacgtcgtacgtacgttaacttaagaacgttcggtaacccaacgtaacaaacttaacgtccgaacccaacgtaaccgtacccgtaccggaaccggtacaaacggttacgaccctaaactaccgaacggtaaccaacgaacgaaaccgtacctaccgaacccgtaacgccgaaacgggaaccccgtaaccgtacgtaacgggttacccggaaccgacgggtaacgacccggtacgtacggtaacgtaccttacgaacgggtaacccgaaccggttacgtacccggtttacgtacgttcccgaggtacgtaacgagggtaacgttaacggtaacgggtttaatttaccggttacggttaccggttcccggttacgttacgttaccggtaaccggttccgggtaacggggtacccgttaaacgggtcccgttaacccggg

SEQ ID NO: 197318 - DNA, 680 bp, Homo sapiens
  misc_feature: GYAE6OF01CO4PN.39.81.H04.1.454.CMB.1.raw
  modified_base (396)..(396): a, c, t, g, unknown or other
  misc_feature (396)..(396): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtggggcctcgagtgaaggtctcctgacaaggtctttcgtggttacctaccgtttaaccaacttagttggtatcgtaggtttgggtcgcgtacgacgggcccctagggacgaagggtcttaggaggttgggtaggtggggtattgggatacgagcggtacttaacgaagtcggtacaacgaactaaactntacgacaacgacgaaccctacggacggtacaaggtactaccgaaccagtacggaccagtaacacgtaacacctaccgacgacgtacgaaccgtaccatacgtcggacctggacgacgcgagacgtagtccgacgaccggaactccggtacgtgttacgtacgtggtacgtacggaggtaacgtagtaccggggttaaatttcggtttaggaccgtttacggttacccgttagttacggtacccgttaggggtaccggtaaccggacggttaaccccggttacgg

SEQ ID NO: 197319 - DNA, 684 bp, Homo sapiens
  misc_feature: GYAE6OF01DITCX.39.81.H04.1.454.CMB.1.raw
  modified_base (272)..(272): a, c, t, g, unknown or other
  misc_feature (272)..(272): n is a, c, g, or t
  modified_base (515)..(515): a, c, t, g, unknown or other
  misc_feature (515)..(515): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaagtctctgcaggcttcgtgtacctaccttacactatggtatcgtagttggngacgacgacgcccgtaggacgaagggtcgttaggaggtggtagtgggtacgtggaactcgaggtaccggttacttaacgtaagtcggtacaaccaaacgtaaactacgtcgaacaaccgtaacgaaccccgtacggaagggtaccaacggtacgtaaccaccgtaacgtaccaaaccgacgaacgaccaacgtaccacccgagacgaccgacgacctaagacgtacgaccgtaggacggtacncgtagactactcgaacgacgacgtaccggtcctagttacgtcgtaggcgaacgagggtacgtagggtaaacggttaagtttaccggttagttaccgttaccgggtttaccctttgtacggttaacgggttaaccggccggggtacccgttaaccgggccggtttacccg

SEQ ID NO: 197320 - DNA, 940 bp, Homo sapiens
  misc_feature: GYAE6OF01C5C6U.39.81.H04.1.454.CMB.1.raw
tcagtcgcactagtcacgaccggtgctcgatttagtagtgtagattcgcgggggacccaaaaaaccacacccctccttgggagaatcccctagatcacagctcctcaccatggactggacctggagcattcctttttctgggtggcagacaaacaacgacggtgcccactccctaggttcagctaggtacagtcgtggacgtctagagtagtacggaacggaacggccggttcggggacctcgaggtaggtaacggtctccgtagacgaacggtcttccgtagttaacctaaccttaccaacgttagttaggtactcgttagggttgggtacgacggtacggaccggtacccggtaggggaacgtaacgggtctagggtacgggtacggaggtacggaagttggtacgtacgtacggacgttaaccttaagtaaggttacccggtaaacaaccgtaaaacgtaaacgttagaccgaaaccgtaccgtaaaaccgaaacccgtaccggggtaacggtaaccggaacgtaacgttaacccgaaacgtaaccggtaaaccgaaacccgtaaacgaaaacggtaccctaaccggaacctaaccgaaaccggaccgggtaacctaacccgggtaaacctaacggtaaccgggtaccggttaacccggtaaggggaaccggtaccgggtacgtacgtaacgttcgtaacccggtaacggaaccggaccggtaccggttaacgtttacgggttaacttacgggtacgtaacgggtacggttaacggggtaaaccggttaaggggtaacggtttaaaggtttttaacccggttacgggttaaacccggtttcccggtttaacccggtttacgtttaaccgggggttacccggttaaaccgggtaccggggggtaacccgttaaccgggggtacccggttaaacccggg

SEQ ID NO: 197321 - DNA, 738 bp, Homo sapiens
  misc_feature: GYAE6OF01A6Z21.39.81.H04.1.454.CMB.1.raw
  modified_base (267)..(267): a, c, t, g, unknown or other
  misc_feature (267)..(267): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggccagcaacaaacaggtgcccactcccaggttcagctggtacagtctggagctgagatgacgaagcctggggcctcagtgaaggtctcctgacaaggtcttctcggttactacctttaccaacttntaggtatcgtagttgggtgcgacacggcccctggaccgaagggtcttggaagtggagtggggatggacttcgagcgtacttaacgaacgttcggtaccaacgaactaaaacgtacgtacgacctaacgaacgtaaccgtaccgaacggggccaaggaccgttaccaaccgtaagttaccgaaacccgtaacgaacggtaacccactaaccgtacccaacggacgaaccgtacccggacctaacgaagttaccggaacccgtggaccggacgtacccgttagaacgtacgtacgtacggaaccgtaccgtaccggtaccggtttagttaacttaccggttaggtacgaccggtaaggaacgtaggtaaacgggtttaaagtttaccgtttagggaaccgtttcggtttacccttacgtttttacggacccgtttaggtaccggggtacccgtaaacgggttccccgtacggg

SEQ ID NO: 197322 - DNA, 818 bp, Homo sapiens
  misc_feature: GYAE6OF01BU6VX.39.81.H04.1.454.CMB.1.raw
  modified_base (579)..(579): a, c, t, g, unknown or other
  misc_feature (579)..(579): n is a, c, g, or t
  modified_base (613)..(613): a, c, t, g, unknown or other
  misc_feature (613)..(613): n is a, c, g, or t
tcagtcgcactagtcacgaccggtgctcgatttagtagtgtagattcgcggggacccaaaaaccacacccctccttgggagaatcccctagatcacagctcctcaccatggactggacctggacgcattccttttcgttggtcggcagcaacaacgaggtcgcccactcccgaggttcaggcttggtacacgtcgtggagcgtgagtatacggaacgaacgccgtcgggggtcctacgagggtacgtaacggttccgttaccgtggacgtaaacggtccgtttcggttaccggtttaaccttaaccctttaaccgtaacgtacggtttacggtacttaccgggttagggtttacgggtacgtaccggtaaccggtaccgggtaccccggtaaggggaacgggtaacgggttcggtttaggaggggttacgggtaaggttcgggggtaatcgggtaacggtccggaggtaccgtttaaccggttaacgtaacgggtaccgtaaccggtaaaacctaccttaaaacgtcgttacggaaccgttaaccgaaaacggtacccgtaacggagggcgtaaaacgngtaaccacgtacgacgaaccgagtacaacgtacncgtaaccgacgtaccgaccgacgacctacgtaacgacggtacgtacggacgacgcggtcacgtacaccggacgacgaacgtcggtacgtcgttacacgtcggagacggtagtcggaacggttaagtagtttacggtacgtacggtttcgttcccggtattacggtacgtaccggggtaccggacccgggtaaggttcccgtacgg

SEQ ID NO: 197323 - DNA, 779 bp, Homo sapiens
  misc_feature: GYAE6OF01AFG48.39.81.H04.1.454.CMB.1.raw
  modified_base (409)..(409): a, c, t, g, unknown or other
  misc_feature (409)..(409): n is a, c, g, or t
  modified_base (457)..(457): a, c, t, g, unknown or other
  misc_feature (457)..(457): n is a, c, g, or t
tcagtcgcactagtcacgaccggtgctcgatttagtagtgtagattcgcggggacccaaaaaccacacccctccttgggagaatcccctagatcacagctcctcaccatggactggacctggagctattccttttcttggtggcagcaacaacaggtcgcccactcccaggttcagctggtacagtctggagctgagagtgacgaacgccgtgggcctacgaggtaggaaggttcctaccttgacgaaggtcgttcgtacggtttacctacctttacctaacgtgttaggtactacgtggttacggtcgtcgaccgtaccggtacccgtggaacgaacgggtcgttggaggtacggtaggtacgggtagtggagttacgacggtccgtacttaagtagtcgacaactanaactacgcgacacgactaacgcggagacaggacactacatcggaccanacgtacacacgaccgacgacgtacgacctacgtacacggtacgacgtagggacgtaacgcgtagtaacggtctaaccgacgtaaccggtacccggtaacgggtacccgtttaaggtaaccgtttacgtacggttacggaaccgggttaaggaccggttaacggggttaaaaccgtaacgggtttttccgtttaacggggttaacccggtttccccttttaacccgggggtttaactaacccggggtttaaaccggttaccccggggggtacccgtttaaaaccccgggggtaaccggggtttaaacccccgtttccccgggg

SEQ ID NO: 197324 - DNA, 852 bp, Homo sapiens
  misc_feature: GYAE6OF01A1URE.39.81.H04.1.454.CMB.1.raw
tcagtcgcactagtcacgaccggtgctcgatttagtagtgtagattcgcggggacccaaaaccacacccctccttgggagaatcccctagatcacagctcctcaccatggactggacctggagcacttccttttcgtgggtggcgagacaacaacgtaggtcgcccaccttcccgaggttccacggtcgtaggtacgtagtcgtgggagcgtagagtagtacggaacgaacgggtccgtcggggcctacgtaagggtacggtaacgggttcctccgtgacggtaaccggtctttaccgtacgggtttaaccctaaccgttttaccgaaacgtttacgttacggttaagtcggtacgggtttcgggtaggcccggaaccgtaccgggtcccgagggtaaccggtacgggtcgttacgggaggttaggacggttagggagttacggacgtaccgaggttaccgttactaacggttacgtacggtacgaacaaactaagtcgtcgaacaaccgtacgaccgtacggacggacgtaacgtacgtacgaaactcgaaccgtaaccaggtaaccaccgtaaccgacgtaaccgcggaaccgacccgtacgtaacctaaccggtcgaacgggaacccgtacggtaacggaaccgtctaccgggtaggtaacgttccgaaccgggtccggaaccggttacccgggttacgtaacgttaacgttcggaaccgggtaggtaccgtaaggtaccggtaagggtacggttaaacgttttaaggttccgttaccgggttcgtaaccgtttcgtaacgggttaccggtaccgggttaccgcccgggaaaccggttccggtacccgg

SEQ ID NO: 197325 - DNA, 648 bp, Homo sapiens
  misc_feature: GYAE6OF01ET8WA.39.81.H04.1.454.CMB.1.raw
tcagtcgcactagtcacgaccggtgctcgatttagtagtgtagattcgcggggacccaaaaaccgacacccctccttgggagaatcccctagatcacagctcctcaccatggactggacctggagcatccttttcttggtggcagcaacaacaggtgcccactcccaggttcagctggtaccagtctggagctgagatgacgaagcctggggcctcagtgaaggtctcctgcaaggcttcgtggttaccacctttaccaacttatggtatcgagttcgggtgcgacacggccctggacgaagggtcttggagttcggagtgggatggactcgagcgacttacgaatcgggtacacgaacgaaacgtagtacgacaacgaacgtaaccctccgagggcaacggacgtaccaacccgatcgaacccactacgaacacactccacgacgccgacgacctacgagtcggacctggacgacgccgtagacgactcgtacgaaccgacgaccggtcgttacgttagttacgtgtacggacggaggacggtaacggtacggggttaaatttcgtttacgtacgttccgggttaacccttcgtttacgtaacccgttacggtaccgggtaccggtaaccgggtacccgttaccggg

SEQ ID NO: 197326 - DNA, 714 bp, Homo sapiens
  misc_feature: GYAE6OF01EJ4GI.39.81.H04.1.454.CMB.1.raw
tcagtcgcactagtcacgaccggtgctcgatttagtagtgtagattcgcggggacccaaaaaccacgaccctccttgggagtaatcccctagatcacagctcctcgaccatggactggacctggagcagtccgtttctggtggcagtcaacaaccgacggtcgcccactccgaggttccagctaggtacgagtcgtggagcgtgagtagtgacgaagccgtggggcctacgagtcgaacggtctccgtagacgtaaggtcttcgttacggtacctaccttaaccaagttagtggtactcgtaggtttcggacgacgtacgacgggtaccccgttaggaaccgtaagggtccgttaggacggttagggtaagtggggtactagggactacggacgccggtacttacgtaagttcggtaacactaaccgtaaatgtacgacaacgaacgtaacccgcgaggtcaacggcacaccgtagacgacctaacgactcaactagcccgaagccgtacgaccgtacgacgagttacacgtaggaacgctccggagtacggtactcgggacaaccgacggttaaccggtcgttaacgtaagtttcggcggtacggccggaagaacggtacgtaaacgggttttaacgtcgtttaccgacgggttcttacccgttagttacgtaacggttacggtaccgggaacgtaaccggtccggtaaccgg

SEQ ID NO: 197327 - DNA, 730 bp, Homo sapiens
  misc_feature: GYAE6OF01CCMG3.39.81.H04.1.454.CMB.1.raw
  modified_base (460)..(460): a, c, t, g, unknown or other
  misc_feature (460)..(460): n is a, c, g, or t
  modified_base (467)..(467): a, c, t, g, unknown or other
  misc_feature (467)..(467): n is a, c, g, or t
  modified_base (499)..(499): a, c, t, g, unknown or other
  misc_feature (499)..(499): n is a, c, g, or t
  modified_base (543)..(543): a, c, t, g, unknown or other
  misc_feature (543)..(543): n is a, c, g, or t
tcagtcgcactagtcacgaccggtgctcgatttagtagtgtagattcgcggggcacccaaaaaaccacacccctccttgggagaatcccctagatcacagctcctcaccatggactggacctggagcagttcctttttcttgggtggcaggcaacaacaggtcgcccactcccgaggttcagtctggtacagtcgtggagctagagagtgacggaagccgtcggggcctacgaggtcgtaacggtctcctgcgaaggtccttcgtacggttacctacctttaccaacttagtgtactcgaggttcggtcgtacgaccgacggtcccagggtaacgagggtcgttacggaggttaggagtgggtagtaggactcgacggtctacttaacgtaacggttcgacaaacctaacaaacgttacacgaaccgaacgtaacgaccgtaccggacggtacgagtacncaacgtnacgaaccaacgactaacactacaccgagaccnccggtactacacgtacgtcgtacgagacgtactgatacgcgtanccgaacggtaccggtcgtaccggtttaagtacctttaggtacgtacgggaaggtacgggtaacggttaaccgggtaagggtttaaacgttacggtttaccgggttaaccggtaccgtttttaccggttacgtttaccgggtaacggttaccggggtacccggggtaaccgtaacccgggtaacccgg

SEQ ID NO: 197328 - DNA, 235 bp, Homo sapiens
  misc_feature: GYAE6OF01ETPR5.39.81.H04.1.454.CMB.1.raw
  modified_base (157)..(157): a, c, t, g, unknown or other
  misc_feature (157)..(157): n is a, c, g, or t
  modified_base (233)..(235): a, c, t, g, unknown or other
  misc_feature (233)..(235): n is a, c, g, or t
tcagtcgcactagtcacgaccggtgctcgatttagtagtgtagattcgcgggacccaaaaaccacacccctccttgggagaatcccctagatcacagctcctcaccatggactggacctggagcattcctttttcttggtggcagcaacaacaggtncccactcccaggttcagctggtacagtctggagctgagatgacgaagcgtgggcctgagtgaggtctctgacagtnnn

SEQ ID NO: 197329 - DNA, 864 bp, Homo sapiens
  misc_feature: GYAE6OF01DRV2B.39.81.H04.1.454.CMB.1.raw
tcagtcgcactagtcacgaccggtgctcgatttagtagtgtagattcgcggggacccaaaaaaccacacccctccttgggagaatcccctagatcacagctcctcaccatggactggacctggagcattccttttcttggtggcagcaacacaggtgcccactcccaggttcagctaggtacagtctggagcgtgagaagtgaacgaaggccgtcggggcctcgagtaggaaggtcctaccgtgacgaacggtcttcgtacggtttaacctacccttttaaccgaaacgttagttgtaacgttacgttagggttgggtcgaccgacgtaccgggcccgtaggaacgaacgggtcgttaggaggttaggaaggtgggtagtcgggagtacgaacggtccggtaacttaacggtaagttcggtaaacccgaactaaaaccgtaaaacgttacgacggaaaccctaaacggaaacccggtaaaacccgtacccgggaacgggaaccgtaaagggacgttaccaaccgtaaccgtaaccgaaccgaaaaccgaacgtaacccgtaacctaaccgtaacccggaaaccggtacggacccgaaaccccgggttacctaaacgtcggtaaccgggtacccgtaagggtaaaccggtaccggtacggacggttaacggaccggttaccgtacggaaacccggaaccgggtaacccgggttaccggtttagttacccggttagttacgggacggtacgggaaacgtagggtaacggttaagggtaaacgttttacgttaggttaccgttacggttaccctttagttacgtaccggtacggtacggggtaacccggaccggttaccgtaccggg

SEQ ID NO: 197330 - DNA, 637 bp, Homo sapiens
  misc_feature: GYAE6OF01CA3QO.39.81.H04.1.454.CMB.1.raw
  modified_base (307)..(307): a, c, t, g, unknown or other
  misc_feature (307)..(307): n is a, c, g, or t
  modified_base (315)..(315): a, c, t, g, unknown or other
  misc_feature (315)..(315): n is a, c, g, or t
tcagtcgcactagtcacgaccggtgctcgatttagtagtgtagattcgcggggactggacctggagcatcctttttcttggtggcagcaacaacaggtgcccactcccaggttcagctggtacagtctggagctgagatgacgaagcctggggcctcagtgaaggtctcctgcaaggcttctggttacacctttaccaactatgtatcagttgggtgcgacacggcccctggacgaagggtcttggaggtggagtgggagtggatcgaggcgtacttaacgaagttcggtaccaacaactaaaactntgaccaanaacgaacctcgagggcagactaccacatcgaaccagacacaactacaccaacgacgaccgaccggacctaacgacgtacggaccgtaggacggtacgcgtagacgtactcgacgaccgacggcggtccgttagttacttagtgcggacgagagtagtacgggtaattagtttacgacgttcgtaccttcgttagtacgtcggtcgggaccgacgggtaccgtcgtaccgtccgtccgtcctacgaccgtaccctaccgaacccgtaccggaccctcggttcccgttccccttcccccgtagtcccctcccgtcccgtaaccg

SEQ ID NO: 197331 - DNA, 625 bp, Homo sapiens
  misc_feature: GYAE6OF01AXGDH.39.81.H04.1.454.CMB.1.raw
  modified_base (282)..(282): a, c, t, g, unknown or other
  misc_feature (282)..(282): n is a, c, g, or t
  modified_base (444)..(444): a, c, t, g, unknown or other
  misc_feature (444)..(444): n is a, c, g, or t
tcagtcgcactagtcacgaccggtgctcgatttagtagtgtagattcgcgggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctctgcaaggcttctggttacaccttaccaactatggtatcgagttggtgcgacgnggcccctggacaagggcttggagtggagtgggatggatcgagcgacttacaagtggtacaacacaaactatcgcaacacgaacctccgagggcagacgtcacatcgaccaacacgacacactaccgacgacaccacggcctacatacggactggaaggtacnccgtagagtacgtcgtagaaccgacgaccgggtcgtagttaacttacgtgtacgacgaaggagtacgggtaccggggtaaaattttacgttttaggaccgttccgggttaacccctttccggtttacgtaaccgtttacgggttacgggggacccgtaacgggggtaaccccgttacgggg

SEQ ID NO: 197332 - DNA, 801 bp, Homo sapiens
  misc_feature: GYAE6OF01DTW8O.39.81.H04.1.454.CMB.1.raw
  modified_base (189)..(189): a, c, t, g, unknown or other
  misc_feature (189)..(189): n is a, c, g, or t
  modified_base (203)..(203): a, c, t, g, unknown or other
  misc_feature (203)..(203): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttctggtggcagcaacaacaggtcgcccactcccaggttcagctggtacagtctgganctgagatgacgaanccgtggggcctacgagtgaacggttcctcctagacgtaaggtcctttcgtacggtttacctaacccttttaaccaacttagttggtacttacgtagggttcgggtacgaccggtaccgaccggtccccgaggaaccgtaagggtctttaggacggttgggacgtgggtaacgtggtacgtccggagtccgtacgttaacgaagtttaccgggtacaacccgtaaaacgtaaacgttactaccggactaaaccgtaaccgtaaccccgtacggtacgggaaccgtaaacggtaccggttaacccaccgtaaacggttacccgaacccgaaagaaccgaacctaaccgtacccgtacccgaaccggtaaccgaccgtaaccccgggtaaccaacgtagttaccggaccgtaaggaccggtacggtacccagtaagtaaccgtcgtaaccggaccgaccggtaacggtcgtttagtacgtttaacgtcggtaggacgtaaccggtaggacggtaaccgggttaaatttacggtttcgaaccgttaccgtacctttcgtacggtccggtaaccggtcggaaccggtcgtaaccccgggttcg

SEQ ID NO: 197333 - DNA, 750 bp, Homo sapiens
  misc_feature: GYAE6OF01ALKQD.39.81.H04.1.454.CMB.1.raw
  modified_base (283)..(283): a, c, t, g, unknown or other
  misc_feature (283)..(283): n is a, c, g, or t
  modified_base (319)..(319): a, c, t, g, unknown or other
  misc_feature (319)..(319): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattcctttttcttgggtggcagacaacaacaggtcgcccactcccaggttcagcttggtacagtctggagctgagatgacgagccgtcgggcctcgagtgagtctcctgcgagtcttctgttacctacctttaccaatagtggtatcgtaggttgggngcgaccgacggtcccgtaggacgaagggtcttaggnggtggaggtgggatggaactcgaggcgtacttaacaagttcggacaacgtaaactaacgtacgtcgacaaccgaaacgtaacccgtaccggaagggaccgaacggtaacctacccaaccaacgtaccgaaacccaacgtaaccggaaccacgtactaacccgaacggtaccgaacccggtaacctaacccgtaacgtaacggtacgggtaacccaggggtaacccgggtcgtaccgtaagggtaacgtacgttccggaacggtaccgaacccgggtacgggttaccgtttaggttaaccgtttgttacgggaggaccggttaagggaacggttaacggggtaaagggtttaacttttacggtttacggtaccgttcgtttaccctaggttaccgtacggtacggtgggaacccgtaaccgggtcgtaccgg

SEQ ID NO: 197334 - DNA, 758 bp, Homo sapiens
  misc_feature: GYAE6OF01EKHWP.39.81.H04.1.454.CMB.1.raw
tcagtcgcactagtcacgaccggtgctcgatttagtagtgtagattcgcgggggacccaaaaaaccacacccctccttgggagaattccctagatcacagctcctcaccatggactggacctggagcatccttttcttggtggcagcaacaacaggtgcccactcccaggttcagctggtacagtctggagctgagatgacgaagccgtggggcctcagtgaacggtctcctgcaaggcttctggttaccacctttaccaacttagtggtatcgtaggttggggtgtcgacgacgggcccctgggacgaagggtccttggaggttggagtgggggtatgggatcgacgtcgacttagagtggtacacgtaaacctaaaccgttagacgtaccgaacgtaacgtaaacccgtccggaaggggtaccaaacggtacgtaccaacccgtagttaccggaaccctacgaacgaaccgtaactactaaccccggacggtaacgacccgtaacccggaccttaacgaaggttaccggacccgttacgggacggtaccggtcgttacgggaacttaacggttcgtaacggtaccgaacccgtaaccggggtccgttaggtttaaccttacggttcggtacggtacggtaaggaccgggtagttaaccggggtaatttaaggttttacggacgtttacgttaccccgtttagtttacggtaccggttacggtaccgggggtactaaccggggtacccgtaccgggg

SEQ ID NO: 197335 - DNA, 716 bp, Homo sapiens
  misc_feature: GYAE6OF01AJZYF.39.81.H04.1.454.CMB.1.raw
  modified_base (448)..(448): a, c, t, g, unknown or other
  misc_feature (448)..(448): n is a, c, g, or t
  modified_base (456)..(456): a, c, t, g, unknown or other
  misc_feature (456)..(456): n is a, c, g, or t
  modified_base (486)..(486): a, c, t, g, unknown or other
  misc_feature (486)..(486): n is a, c, g, or t
tcagtcgcactagtcacgaccggtgctcgatttagtagtgtagattcgcggggtacccgtaaaaaccgacacccctccttgggagaatcccctagatcacagctcctcaccactggactggacctgggacgcgtattcccttttcgtgggtggcaggtcaactaacaggtcgcccatcccaggttcagctggtacagtccgtggagtcctggagatcgacgaagccgtggggcctcgaggtcggaacggttctccgtgacgaacggtcttcgtaggttaccctaccgttaaccgaacttagtacgtatcgtaggttcgggtacaccgtacgtaccggtaccgtaggaccaagggtcttaggagtacggagtcggacgtaggactcggacgtccgtacttaacgacgtgtaccaacgtactaagtgtcgacgtacacgactcggagcanacgcacgntcacgacagactactacgtacgacgtaacncgtacgacttacgaacgacggtacgtacgggagccgtacggagtacgtacgtacgtaccggaacgtaccggtaccggtacgtagtttaaccgcgttagtaccggtctaacggtacggttaacgggtaaccgggttaagtttacggttacggtacggttacccgttaccgttaacgttaccggtaaacggtccggttaaccgggacccgtaaccgggtaccggttacccgg

SEQ ID NO: 197336 - DNA, 572 bp, Homo sapiens
  misc_feature: GYAE6OF01EPCCT.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacaggccctggacaagggcttgagtggatgggatggatcgagcgcttacaatggtcaacacaaactatgcaacagaacctcgagggcaaggagtcaaccatcgaccaacagaacacactaccacgagacaccggcctaacagtacggacctggaggacgcctggagactcgacgaacgacgaccggccgtagttacttacgtgtcgcggagagaggtacgggtaaagttattttaggacttcggttacccttcgtttacgacgttacgtaggggccgtaacgggtaacccgtcggg

SEQ ID NO: 197337 - DNA, 1066 bp, Homo sapiens
  misc_feature: GYAE6OF01BGEZA.39.81.H04.1.454.CMB.1.raw
  modified_base (189)..(189): a, c, t, g, unknown or other
  misc_feature (189)..(189): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctgganctgagatgacgaagcctggggcctcagtgaagtctctgcaggcttctggttacctacctttaccaacttataggtactcgtaggttagggtcggccgtaacgacgggtccccctagggactaacggggtcctttaggaggttgggaagtggggattagggacttcgacggccgttactttaaccgaagttcggtaccaactaacctaaacgtatacgaaccgtaaccgaaccgtaacccgttacccggaagggacgtaacggtaaccgttaccaacccgtaaacgtaccggaaaccccgaaacgaaccgtaacccgtaaaccgtaaccccgttacccgaaaccgggtaaccccgggtacccgtaaaaccccccgggttaaccccgttaaacccggttaacgggtttaacccccggggaacccgggtttaacgggaaacccgggggttacccgtaaccccgggtttacgggtaaaccggttaacccgggttaaccccgggtttaaccggggaaacccccggttaaaaccccgggggtaacccgggggtttaacccccggggttttaaacggtttttaaaccggtttaacccccggggttaacgggtttaccccgggggaaacgggtaaaaccgggggttaaacgggtttaaaacccgggggtttaaaccgggggggttttaaaaaacttttttagggtttttaaaccccggggttaaacccgggtttttaacccccggggtttaacccccgtttttaaaccccgggtttttaacccgggttaaaccccgggttttaaaccccgggggtttaaccccggggggtaacccccccgggtttaaaaccgggggttaccccccccgggttttaaacccggggg

SEQ ID NO: 197338 - DNA, 748 bp, Homo sapiens
  misc_feature: GYAE6OF01DEGBU.39.81.H04.1.454.CMB.1.raw
  modified_base (123)..(123): a, c, t, g, unknown or other
  misc_feature (123)..(123): n is a, c, g, or t
  modified_base (182)..(182): a, c, t, g, unknown or other
  misc_feature (182)..(182): n is a, c, g, or t
  modified_base (276)..(276): a, c, t, g, unknown or other
  misc_feature (276)..(276): n is a, c, g, or t
  modified_base (439)..(439): a, c, t, g, unknown or other
  misc_feature (439)..(439): n is a, c, g, or t
tcagtcgcactagtcacgaccggtgctcgatttagtagtgtagattcgcggggacccaaaaaccacacccctccttgggagaatccctagatcacagctcctcaccatggactggacctggancattccttttcttggtggcagcaacaacaggtcgcccactcccaggttcagctggtacngtcgtggagctgagatgacgagccgtgggcctcagtgaagtctcctgacaaggtcttgtacggttactacccttaccaattacgtggtatacgnggtttacgggtcgaccggtacgtaccggtccccgtaggaacggtaacgggtcgtttagggaacggttgggaaggttaggggtagtaggtacgttcgacggccgtttactaacgtaaggtttcgaacactaaaactaactagtcgactaaccgaactaacccgnggacgacgagacgtacacagtacgaaccagtaaccgataacccacgtcccgaaacgacgtaccgaacccgttactacggtaacggccgtaacggtacgggaacggtctaccggtagaacgtcgtcgtaagggaaccctacggtaccgtccgggttaatcgttacgagggtccgaggtaaccgtagggtaaggtacggggttaaaactttcggttaacgtttaacccggttaccggtttaccgttaccgtttaaggtacccggttcggggttaaccggaccccgggttaaacgggttacccggttcccgg

SEQ ID NO: 197339 - DNA, 724 bp, Homo sapiens
  misc_feature: GYAE6OF01EI0L3.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtgggcctcgagtgaacggtctccgtgcgaaggtcttcgtcgttacctacctttaccaactagtaggtatcgtaggttggtgaccgacgacggccccgtaggaacgagggtcgttgaggttggagtggggtatgggtactcgacgtcgtacttaacgaagttcgtacaacgaactaaacttagtacgaccaacgaacgaacccgtacggaagggaccaaggtaccgtaacaaccgtagtaccggaaccaacgaacgaccaacactacccgaacgacgccgaacgaccctaagacgtcggaccgtaggacggacgtcctaggaatcgtacggtaacgaccggtaacgaccgggtacgttacgttaacgtttcgtaggtacgacggtacggaaggtaacgggtaacggttaaagttttcggtttaaccggtacggtttcccggtttaccgttacgtttaccgggtaacgtttaccggggaccggggttaacccgtaacccggggttaaccggttacccggg

SEQ ID NO: 197340 - DNA, 604 bp, Homo sapiens
  misc_feature: GYAE6OF01BDC8K.39.81.H04.1.454.CMB.1.raw
  modified_base (188)..(188): a, c, t, g, unknown or other
  misc_feature (188)..(188): n is a, c, g, or t
  modified_base (294)..(294): a, c, t, g, unknown or other
  misc_feature (294)..(294): n is a, c, g, or t
  modified_base (358)..(358): a, c, t, g, unknown or other
  misc_feature (358)..(358): n is a, c, g, or t
  modified_base (363)..(363): a, c, t, g, unknown or other
  misc_feature (363)..(363): n is a, c, g, or t
  modified_base (439)..(439): a, c, t, g, unknown or other
  misc_feature (439)..(439): n is a, c, g, or t
  modified_base (449)..(449): a, c, t, g, unknown or other
  misc_feature (449)..(449): n is a, c, g, or t
  modified_base (478)..(478): a, c, t, g, unknown or other
  misc_feature (478)..(478): n is a, c, g, or t
  modified_base (497)..(497): a, c, t, g, unknown or other
  misc_feature (497)..(497): n is a, c, g, or t
  modified_base (503)..(503): a, c, t, g, unknown or other
  misc_feature (503)..(503): n is a, c, g, or t
  modified_base (532)..(532): a, c, t, g, unknown or other
  misc_feature (532)..(532): n is a, c, g, or t
  modified_base (542)..(542): a, c, t, g, unknown or other
  misc_feature (542)..(542): n is a, c, g, or t
  modified_base (560)..(560): a, c, t, g, unknown or other
  misc_feature (560)..(560): n is a, c, g, or t
  modified_base (573)..(573): a, c, t, g, unknown or other
  misc_feature (573)..(573): n is a, c, g, or t
  modified_base (578)..(578): a, c, t, g, unknown or other
  misc_feature (578)..(578): n is a, c, g, or t
  modified_base (586)..(586): a, c, t, g, unknown or other
  misc_feature (586)..(586): n is a, c, g, or t
  modified_base (593)..(593): a, c, t, g, unknown or other
  misc_feature (593)..(593): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatcctttcttggtggcagcaacaacaggtgcccactcccaggttcagctggtacagtctgganctgagatgacgaacgccgtgggcctcgagttgaaggtctccgtgacaaggtccttcgtacggttacctaccgtttaaccaactagtggtaactcgtaggttcgggngaccgacgacggtccctagggaacaagggtcttaggaggtggagtcgggatgggactcgagtcncttanagtgacacaactaaacgtgacgactaacaacgtaccctacggacggcaagaacgtcaacctagtccgaaacacganacaaccgtanaccgtaacgcaacccggtacgacctacgnggtacgtccaggacgtacncgtagntacgctaacgcacgcgcttagacttcgtncgacaggagngtaacggtaattcggttnaggttcaccgttntacgngtaccggnggtaccngggtccctagg

SEQ ID NO: 197341 - DNA, 851 bp, Homo sapiens
  misc_feature: GYAE6OF01CB7A8.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtcgtggagcgtgagtatgacgaacgccgtggggcctcgagtgaacggttctccgtgacgtagtcttctcggttacctacctttaacaacttagtaggtatcgaggttgggtcgaccgaccgaccggccccgtaggaaccgtaacgggtcttacggtaggtgggaagttgggaacgtggactcggacggtcgtactacgaagtacggtaccaactaactaaaccgtacgtccgaaccgtaaccgtaacgaaccccgtacggtaccggacgaacgtaaccgtacctaaccgtaacgtaccgaacccaacgaacgaacccacgtaaccctaccgacgggaccgtaccgaacccggtaccctaaccggtaactaccgggtaccgaacggtacggcggtacccgtagtacgtacgttaccgaccggtaccgaacccggtacccgggtcggttaacgtttaccgttacggtacgggacggtaacgggtacggtaaggggttaaaccgggttaaaggggttaaacttttcggggttttaacccggttaaaccgggttttcccccgggtttaaccccgttttacgggtttaacccgtttaacggggttaccccggggtttaccccgggggtaacccccgggttaaaaccggggtttcccccggttaacccccggggg

SEQ ID NO: 197342 - DNA, 712 bp, Homo sapiens
  misc_feature: GYAE6OF01AYPGU.39.81.H04.1.454.CMB.1.raw
  modified_base (194)..(194): a, c, t, g, unknown or other
  misc_feature (194)..(194): n is a, c, g, or t
  modified_base (383)..(383): a, c, t, g, unknown or other
  misc_feature (383)..(383): n is a, c, g, or t
  modified_base (426)..(426): a, c, t, g, unknown or other
  misc_feature (426)..(426): n is a, c, g, or t
  modified_base (611)..(611): a, c, t, g, unknown or other
  misc_feature (611)..(611): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacagtgcccactcccaggttcagctggtacagtctggagctgagntgacgagccgtggggcctacagtacgaaggttctccgtgccaggcctttcgtggttaccaccttttaacgactagtggtatctaggttcggtcgccgtacgcgcccgttaggacgtacggtgtgaaggtggagtagggacttggaactcgacggtcgtccgtaacgtagtacgtacaacaacaaacgtntacggacacgtaacgccgaccgtaaggacctaaggacccgtanaacccggtacgttaaccggaaacccacggaacaccgaaaccgtacctaaccgtaacggacgaccgtaacggtaccctaacgtacgtacgtaacggacggtaacgggacgtccgtaaggacgtacgtacgtcgggaacgaccggtaacggtcggttacccgttaagtacgtacggtacggtaacgnggtaacggtacgggttaacgttaaaggtccgttagtacccggttagtacccgttataccggtacgtaacggttacggacgggtaccggtacccgtaccggg

SEQ ID NO: 197343 - DNA, 1030 bp, Homo sapiens
  misc_feature: GYAE6OF01DYFO8.39.81.H04.1.454.CMB.1.raw
tcagtcgcactagtcacgaccggtgctcgatttagtagtgtagattcgcggggcacccaaaaaccacacccctccttgggagaatcccctagatcacagctcctcaccatggactggacctggagcacttccttttctgggtggcagcaaacgaacgaggtcgcccactcccgtaggttcacgtcgtacggtactacgtcgtaggacgtcgtagaagacgtacggaaccggtacggtccggtcgggggtacccttagaaggttacggtaacggttccttccgaggtaccgtaacggttcctttaccgtttaccggtttaaccttaacccgtttaaacttaaccgttaggtttacggtaacttcggtttaggggttacgggtaccggtaccggtaaccggtaccccgggtacccgtaaggggtaaccgggtaacgggttcgttaacgggtagggtagggtacgggttagggtacgtaggtaacgtacggacggtaccttaaacttaacgggtagttaccggaactaaaccgtaaaacgtacttagtacccgtaacgaaccgttaaaccgcccgtaacgggaggaaacccgttgaacccgtaccctaacgtaaacggtacccccaaaacgaaccgaaccgtaacccgtaaccgttaacccgaacccggtaaccgaaccgggttaaccccggtaaccgtaccgtaacggttaacccggacggtaacggtaacgggtaacgtaccgtacgggtaacgtaacgttaccgtacgggaaccggtaccggtaaccgggttacccggtttaccggtttaaacggtttcccgttaaacgggttacgggaccggttaaggggtaacgggttaaaccggaaacggggtttttaaaccgggttttaattttaaccggggttttaacccggttacccgggttttaaccccggtttttaacgttcccggtttaaaccgggggttaccgggttaaaccccggggttaccgggggttaacccgggttaaaccccgggtttacccggg

SEQ ID NO: 197344 - DNA, 726 bp, Homo sapiens
  misc_feature: GYAE6OF01AXX5B.39.81.H04.1.454.CMB.1.raw
  modified_base (193)..(193): a, c, t, g, unknown or other
  misc_feature (193)..(193): n is a, c, g, or t
  modified_base (348)..(348): a, c, t, g, unknown or other
  misc_feature (348)..(348): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccagttcagctggtacagtctggagctgngatgacgaagcctgggcctcagtgacgtctcgtgacgaggtcttcgtggttactaccctttacaactagtaggtatcgtaggttgggtgacgtacgcggcccctaggaacgtaaggggcctttaggacggtgggagtggggtatgggtataccgnggtaccgtccgtttaacaagtttggacctaaccgtaaacgtaaacgttacgtcgaacacgtaacgtaacctccggaggtaccaggtactacctacgaagttacgaccgtaacgacaccgtaacaccgtaacgaccgtacgacccgtaacccggtacgtaacctaacggtccgtaacgacgacggtaccgaccgtaggacgtacgtacgtaggaccgtacgcgtacgttacggttacttacggtgtcggaacggaggaacggtacgtaaacgggtttaacgttgttttacggaacccggttttccggtaacccttttaccgttacgggtaacccttacggggttacggggacccgtaaaccgggttcccggtacccggg

SEQ ID NO: 197345 - DNA, 853 bp, Homo sapiens
  misc_feature: GYAE6OF01DMJTY.39.81.H04.1.454.CMB.1.raw
  modified_base (745)..(745): a, c, t, g, unknown or other
  misc_feature (745)..(745): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcacttccttttcgtggtggcagacaaacacgaggtcgcccactccccgtaggttccagtcgttacgggtacagttcgtgggagtacgttgaagtacgtaggaaccggtaacggcccggtcgggggtccctacgtaacgggtaaggtaaccgggttccctccggttacgaccgtaacggtttcctttaccggtttaaccggttaccccttaaccctttaacccgtaaagttagttacggtaacttcgggtaggggttagggtaccggaccggtaacgacccggggtaccccgtaggggaaccgtaacggggtctttagggaggttagggaggtggggtacgtcgggtactcggtacggtaccttagtaacggttacgtacgtaacccaacgttaaaacctacgtactacgaccaacggaccgtaaaccgaccggacggaacgtacggtaacctaccgactacgaaccgacctaacgaacggacaaaccgacctaccggaacgacggacccgtaaccgtaacgtacgtaccgggtccgaaccggtggaacgggttacaccggtaggactaccgtcgtaacggaaccgcgggtacccgtaggttacgtaccgtttagcgggtanaccgggtaaggtacgtaggttaaacggttacgttatttacggcggtttaccgggtaccttgtaaccgggttacggaacggtcccgggacggtaacggtccccgtccgg

SEQ ID NO: 197346 - DNA, 785 bp, Homo sapiens
  misc_feature: GYAE6OF01EDZIS.39.81.H04.1.454.CMB.1.raw
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaaacaacaggtgcccactcccaggttcagctggtacagtctggagctgagatgacgagccgtgggcctcgagtgaagtctctgcgaagtcttctgttacaccttacaactatggtatcgtaggttggtcgcgacgacggtccctaggaacgaagggtcttaggaggtggagtgggagtaggactcgacggtcgtacgtttaacgaagttcggtacaactaacgtaaaactatacgaacctaacgaaccgtaaccctccggaagggacctacggacgtacccaaccgtagtaccggaaacccaacgaacggaacctaacccgtaacgtaccccgaacggtaaccgaaccggtaacccggaccctaacgtaccggtaccgggtaaccgtagggaacggtacgtacccgtaaggaacgtacgtaccgggtacggaaaccgtaacccggaacccgggttccgtttaaggttaaccgtttacgagggttaccgagggtaaacggacgggttaacgggtaaacggggtttaaaatttcgggttttacggtaacggttttaccggttaccccgttttagttaccggttaaaccggtttacgggtaaccgggggtaacccggtaaccggggttaaccccggtccggg

SEQ ID NO: 197347 - DNA, 783 bp, Homo sapiens
  misc_feature: GYAE6OF01CZH13.39.81.H04.1.454.CMB.1.raw
  modified_base (125)..(125): a, c, t, g, unknown or other
  misc_feature (125)..(125): n is a, c, g, or t
  modified_base (469)..(469): a, c, t, g, unknown or other
  misc_feature (469)..(469): n is a, c, g, or t
tcagtcgcactagtcacgaccggtgctcgatttagtagtgtagattcgcggggacccaaaaaccacacccctccttgggagaatcccctagatcacagctcctcaccatggactggacctggacnctactttccttttcgttgggtggcaacgacaaaaccaacgtacggtccgcccctaaccgtccccgtaaggttccagtcgttacgggtaacctagtccgtgggacgtcgttaggaagtagtacgaaccggaacggtccggttacggggcccttacgaggttacggaacgtcctcgtagacgaaggtccttacggtacgttaacctaccctttaacaacgtagtgtactaacgttggttcggtacgacgaccgaccggtccctaggacgaaggtcgtaggtaggaggtaagtggacgttggactacgacgtcgttaactacgtagtacgtaactaccaaagtaacnctacgacaacctaacgaccgaaggtacgagtaaccggacaccgtaaactcgaaccgaacgaccgaaacctcaaccgtaccaaccggacgaccgtaacgaccgtaaccgtaacgacggtccgacgtacggtacgacgacgtacgacgtaacgtacgacgtaaccgacgtaaccggttacgttaacgttacgtcgttacggacggtaaggaacgtaagggtaacggttaaggttaacgttacgttacgtaacggttcgttacggttacgttacggtacgtaccgggtaggtaacccggtccggtaaacgtccccgg

SEQ ID NO: 197348 - DNA, 730 bp, Homo sapiens
  misc_feature: GYAE6OF01DLY9R.39.81.H04.1.454.CMB.1.raw
  modified_base (196)..(196): a, c, t, g, unknown or other
  misc_feature (196)..(196): n is a, c, g, or t
  modified_base (279)..(279): a, c, t, g, unknown or other
  misc_feature (279)..(279): n is a, c, g, or t
  modified_base (316)..(316): a, c, t, g, unknown or other
  misc_feature (316)..(316): n is a, c, g, or t
  modified_base (540)..(540): a, c, t, g, unknown or other
  misc_feature (540)..(540): n is a, c, g, or t
  modified_base (570)..(570): a, c, t, g, unknown or other
  misc_feature (570)..(570): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcttggtgcagcaacacaggtcgcccactcccaggttcagctggtacagtcgtggagctgagngtgacgagcgtcgggctcgagtgacgtctcgtgacgacgtcttcgtcgtacctaccttacaactgtagtactgtagttggcgnacgcgtccgaggacgtacggtcgtaggtaggtacggnggtacgggtacgtaggtactacggacggttaccgttacgtttaacgaaggtttaccggtaaccctaaaccgtaaaccggtaaaccgttaacgccgaaacctaaccggtaacccggtaaaccccgtacgggacggtaacgaacgtaacgtacgaccgtaacgtaaccgaacgtacgaaccgtaacaccgtaacctaccgaacggtaccgaccgacgtactaacgngttaccgcgtagaacggctacgatacgacncgtaacgaccgacggtacggttaggtactttagttcgagggactacgggaaggttacgaaggttaacgggttacgtttacgttacggtaccgttaccggtttaccgtagtttaacgaccggttcgggaaccggttaccgggttaccgtaccgggttaccg

SEQ ID NO: 197349 - DNA, 945 bp, Homo sapiens
  misc_feature: GYAE6OF01AQQ9X.39.81.H04.1.454.CMB.1.raw
  modified_base (281)..(281): a, c, t, g, unknown or other
  misc_feature (281)..(281): n is a, c, g, or t
tcagtcgcactagtcacgaccggtgctcgatttagtagtgtagattcgcggggtgatcaggactcctcagttcaccttctcacaatggaggctccctgctcagctccgtggggctgctaatgcctcgtcgggtcccaggactccgaggtggggattggttgtgatgactcgagtcctccgagtcctccctcgccccgtcctacccgttggaccgtccggcccggtacctaccattccctccgtagcctaggtctagtaccaaacgtcctacgtaattactnttaggacgtaacggtaaacctaccttaacgtttagtaacgtttcggtttcaagtaccgaaggtaccgggacccgaacggtacccctaaacggttcccgtaacccggaacgggtaccgttaaccgttttaaagtttttaacggtttaaaccgggtttaacccggtaaacccggggtccgtttacccgggttccggggacccctaagaacggttagtaccgttacggaaccgggtaccgggtaacgtacggggttacgggtaccgtaacgggtacctaacggtttacggtaacttaaccgaacccgttaaacgtaaacggtaaaacgtaccggtaaagggtacgggtaaccgggggtaaggggtaacggtaccgggttaaggggaaacgggtttacggggttttacggggggtttttaacggttttaccggttaaccgtcgggtaccgtaaacggttaacggaacccggtaaaacggtaacccgtacgttaccccggttaccgggtttacccgtaaccggtttaccgtttaaccgggtttccgggaacccgggtaacccggggtaaccggtacccgtagggttaaccgggaacgttaaccgggtaacgtaaaccggttcggtaccggtagtacccgtacgtacccgaccgtttgtcggtttacccg

SEQ ID NO: 197350 - DNA, 1053 bp, Homo sapiens
  misc_feature: GYAE6OF01EGTQN.39.81.H04.1.454.CMB.1.raw
  modified_base (123)..(123): a, c, t, g, unknown or other
  misc_feature (123)..(123): n is a, c, g, or t
tcagtcgcactagtcacgaccggtgctcgatttagtagtgtagattcgcggggacccaaaaaccacacccctccttgggagaatcccctagatcacagctcctcaccatgactggacctggancatccttttctggtgcagcaacaacaggtcgcccactcccgaggttcagctggtacagtctggagctgagagtgacgacgccgtggggtcctcgaggtaggtaacggtcctaccgtggacgtaacggtctttacgtccggtttaaccctaaccgtttaaccaacgttagttacggttaacttccggtagggtttacggggccgtaccgaacggtaccggtcccggtagggaacccggtaagggtccgtttaggacggttaggggtaggttacgggggtaacgttacggggtaaccttacgggaacggtacccggttaaccgtttaaaacggtaacggttaccccgggttaaaccaaacccgttaaaaccccgttaaaagttacggtaaccgaacccgtaaacccggtaaacccgggttaaccccgttaccgggggaaaccggggtaccgtaaacggggttaaacccttaacccgaaaccccggttaacgttaaccccgggaaacccctaaacggtaaaacccgggtaccctaaacccggttaccgttaacccgaaacgggtaacccgggtacccgtaaccccgggtacttaaccgggtaacgggttccccggtaaaccgggtaggttaacccggggaccgttacgtaaagggacccgttaacgttaccccgggtaacgggaccccgggttaaccggggtacccggttaacgggtttaacctttaaccgggttaacgtttccggggaacgtaaagggtaaaccccgggttaaggggttaaacggtaaacccggggggttttttaaaacttccggttttaaaccggtacccggtttttacccgggttaacctttaccggggttaaccgggttaccgttaacccggggggttacccggacccgggggttaaccggtaccccggtttaaccggg

SEQ ID NO: 197351 - DNA, 742 bp, Homo sapiens
  misc_feature: GYAE6OF01DGQFH.39.81.H04.1.454.CMB.1.raw
  modified_base (150)..(150): a, c, t, g, unknown or other
  misc_feature (150)..(150): n is a, c, g, or t
  modified_base (178)..(178): a, c, t, g, unknown or other
  misc_feature (178)..(178): n is a, c, g, or t
  modified_base (427)..(427): a, c, t, g, unknown or other
  misc_feature (427)..(427): n is a, c, g, or t
tcagtcgcactagtcacgaccggtgctcgatttagtagtgtagattcgcgggacccaaaaaccacacccctccttgggagaatcccctagactcacagctcctcaccatggactggacctggagctattccttttctggtggcagccaanaacaggtcgcccactcccgaggttcagntggtacagtctggagctgagatgacgaacgccgtgggcctcgagtagaagttcctccgtagcgtaaggtcttcgtaggtttacctaccgtttaacaattattgggtaattccgtaggtttcggtacgaccgtaacgtaccggtcccctaaggaacgtacgggttactaggaggttaggaaggttagggagttcggacgttacgaaggccgttacgttacgaaaggtttccgaacaacgaacctaactancgactaacgacgtaaacccgcgaacgggcaagggactaccgaaatcaacggaaccgacgtaaaccgtctaacctactacgaaccgacgtaaccgacccggtacctaaacgtcgtaacgggaacccgtaggaaccgggtaacacccgttaggaaccgtacgttaccgtaacgaaccgggttacgaaccggtaccggttagtaacgttcgggattcgggaacgtaacggaaggtaccgtaagggttaattacggtttaccgtactttcggtaccttcgtaacgtggtaacccgtcgggaccggtcgtacccggtacg

SEQ ID NO: 197352 - DNA, 763 bp, Homo sapiens
  misc_feature: GYAE6OF01EUULF.39.81.H04.1.454.CMB.1.raw
  modified_base (296)..(296): a, c, t, g, unknown or other
  misc_feature (296)..(296): n is a, c, g, or t
  modified_base (304)..(304): a, c, t, g, unknown or other
  misc_feature (304)..(304): n is a, c, g, or t
  modified_base (414)..(414): a, c, t, g, unknown or other
  misc_feature (414)..(414): n is a, c, g, or t
  modified_base (431)..(431): a, c, t, g, unknown or other
  misc_feature (431)..(431): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttctggtggcagcaacaacaggtcgcccactcccaggttcagctggtacagtctggagctgagatgacgaagccgtggggcctcgagttggaaggtctcgtgcgaaggtcttcgtaggttacctaccctttaccgaacttacgtggttactgtaaggttcggggngccgaacncggtccccgtggacgaaacggggctttaggaggttcggagtggggtacttaggggatccgaggtacgtcctttaacgaacgttggttaccaacgtaaacgtaactagtanaccgtagaacgtaaccnccggaggacgtacggacgtacgtaaccagttccgaacctaacgaacgaccgaaccgacgttaccaacggtacgacctaccggacctaacgacgtcgggactacggaaggcgttacgacgaacgtacgtcgacgggtaaccgaccgacgggttacccggttagttaacgtttcgtgggttacggacggtaacgtaagggttacgttaaaccggggttaagttttaaccgggtttagtaacccggtttaggttaaccccgtttttcgttaaccgggttaccgttaaccgggtaccggggttaccccggtaacccgggggttccgtaaccccggg

SEQ ID NO: 197353 - DNA, 680 bp, Homo sapiens
  misc_feature: GYAE6OF01BEN5L.39.81.H04.1.454.CMB.1.raw
  modified_base (169)..(169): a, c, t, g, unknown or other
  misc_feature (169)..(169): n is a, c, g, or t
  modified_base (266)..(266): a, c, t, g, unknown or other
  misc_feature (266)..(266): n is a, c, g, or t
  modified_base (449)..(449): a, c, t, g, unknown or other
  misc_feature (449)..(449): n is a, c, g, or t
  modified_base (665)..(665): a, c, t, g, unknown or other
  misc_feature (665)..(665): n is a, c, g, or t
tcagtcgcactagtcacgaccggtgctcgatttagtagtgtagattcgcggggcccctagatcacagctcctcaccatggactggacctggagctacttccttttcttgggtggcagcaaacgaacaggtcgcccactcccgaggttcagcgtggtacagttcgaggancgtagagatcggaacgacgtccggtgggcctcgagtggaacgtcctcgtcgacgtaacggtctttcgtcgttacctaacctttacgaactgtgtacncgttaggtggcgacgacgaccggtccgaggacgaggtcgttggagtagggaggtggacgtggacgttacgacggttcgtacgttaacgtaggtacgtaccgaactaacctaaacgtagtaccgacttaaacgaacgtacccgacgacgggtaacagtactaccgaacgacgtacgaccaaagnaacctacgacgtccgaaacgcgacgtaaccggactacggactacggacgtaggacgacggacgagacggtactacgtacggaacctacgtaccggtacgtattcgtacgtcgtaggaacgtacggaagttacgggtaacggttatacgtttacgaccgttacgtacttcgttagacgtacgtcgggacgtaccgcgtacgccgtcgtacgtacccncgacgtcccgtaacg

SEQ ID NO: 197354 - DNA, 730 bp, Homo sapiens
  misc_feature: GYAE6OF01EH77Z.39.81.H04.1.454.CMB.1.raw
  modified_base (124)..(124): a, c, t, g, unknown or other
  misc_feature (124)..(124): n is a, c, g, or t
  modified_base (198)..(198): a, c, t, g, unknown or other
  misc_feature (198)..(198): n is a, c, g, or t
  modified_base (313)..(313): a, c, t, g, unknown or other
  misc_feature (313)..(313): n is a, c, g, or t
  modified_base (365)..(365): a, c, t, g, unknown or other
  misc_feature (365)..(365): n is a, c, g, or t
  modified_base (602)..(602): a, c, t, g, unknown or other
  misc_feature (602)..(602): n is a, c, g, or t
tcagtcgcactagtcacgaccggtgctcgatttagtagtgtagattcgcggggacccaaaaaccacacccctccttgggagaatcccctagatcacagctcctcaccatggactggacctggancattccttttcttgggtggcagcaacaacaggtgcccactcccaggttcagctggtacagtctggagctggagntagacgaagccgtgggggccctgaggtgaacggttcctccgtaggcgaagggtcctttaccgttacggttaacctacccttttaaccaacttagtcggtattcgtaggttcgggngacgacgaccggtcccgtaggacgaagggtctggaggtggagtgggagtggntacgaggtctacgttaacgagtcgtaccaacgtaacaaacttgacgaaccacgtaaacggaacccctacggaacgggacgaacgtacggtacaaccgtaacgtaccgaaaccactaacgacctactaacctccgaacggacgcccgtacgtaaccactacgttacggacgtaggtacggacgtccgtagacgtacgtcgaaccgtcggaaccgtccggtacgttagttacgttacgnggacggacgtaggaaacgtcgggttaaacggttagtttacggttttagacccgggtttaacctttccggttcttaaccggttacgggttacgggtacccgggaaccgttcggtaaacccccgggtcgg

SEQ ID NO: 197355 - DNA, 701 bp, Homo sapiens
  misc_feature: GYAE6OF01C7CSR.39.81.H04.1.454.CMB.1.raw
  modified_base (124)..(124): a, c, t, g, unknown or other
  misc_feature (124)..(124): n is a, c, g, or t
  modified_base (184)..(184): a, c, t, g, unknown or other
  misc_feature (184)..(184): n is a, c, g, or t
  modified_base (192)..(192): a, c, t, g, unknown or other
  misc_feature (192)..(192): n is a, c, g, or t
  modified_base (343)..(343): a, c, t, g, unknown or other
  misc_feature (343)..(343): n is a, c, g, or t
  modified_base (492)..(492): a, c, t, g, unknown or other
  misc_feature (492)..(492): n is a, c, g, or t
tcagtcgcactagtcacgaccggtgctcgatttagtagtgtagattcgcggggacccaaaaaccacacccctccttgggagaatcccctagatcacagctcctcaccatggactggacctggancattccttttcttggtggcagcaacaacaggtcgcccactcccaggttcagtctggtacngtctgganctgagatgacgacgccgtgggcctgagtagaacgtcctacctgacgagtcttcgtacggttacctacctttacaacgttgtgtatacgtaggttgggtacgcgacgtaccggtcccgtaggaccgaggtcgtaggaggtcggtaggtaggngtaggtacgtacgacgcgtactaacgtagttcggtacactaaactaacgtagtaccgacaaccgaaccgtacccgtacggacgggtactaacggacgtacccgactagaccgaacctacgaaccgacacctacctacccgaaggtaccncgtaaaccccgtcgtaagaaccgtccggtaaccggagggtacgaaccgtccttaagggataccgttacgaacgaacccgtacggtaccggttacgtacggttaacgtcggtaggtccgaagtaacggtgtaacggttcggtaatttcggttacgacgtttaccgtcttagttacgaacggttcggccggaccggtccgttcccggtacg

SEQ ID NO: 197356 - DNA, 837 bp, Homo sapiens
  misc_feature: GYAE6OF01BXTN5.39.81.H04.1.454.CMB.1.raw
  modified_base (126)..(126): a, c, t, g, unknown or other
  misc_feature (126)..(126): n is a, c, g, or t
  modified_base (594)..(594): a, c, t, g, unknown or other
  misc_feature (594)..(594): n is a, c, g, or t
tcagtcgcactagtcacgaccggtgctcgatttagtagtgtagattcgcggggacccaaaaaccgacacccctccttgggagaatcccctaggatcacagctcctcaccatggactggacctggancatcctttcttggtggcagcaacaacgacggtcgcccactcccaggttcaacgtcgtaggtacacggtcgtcggacgtctggagagttacggaccgtaacggccggttcgggggaccctacgaacggtagtaacggttctacccgtggacaacgggttcttcgtacggttacctaaccgtttaccaacgttacgtaggtactacgttaaggttacgggtacgtaccggtacgtaaccggtccccgtaaggaccgtaaagggtcccgttaggacggtagggaccgtagggtaccgtggaacgtccgtaggtacccgtacgttaacgtaacgttacgggtaacctaaaccgtaaacgtaaaacccgttacgtaaccggaaccaaccgtaaaccggaacccggttaccggaacggtcggaacggaacgtcccggaacaaccggttacgaaaccccgagtacccgtaaaccnccgttacaacccggactaacgacccgttaccgaacccgttacgaaccggtacggaccgtagtaccgggaacgtccggttacgaaggttacctacgtaacggtacgaacccgtaccggtacgttaagttaccgttagtcgtacgacgtaggcttaacggaacgggtatttaacggtcgtacggtttaccgaccctttaggtaccgttaaccggtgggaccggtaccggaacgtccgggttaccg

SEQ ID NO: 197357 - DNA, 920 bp, Homo sapiens
  misc_feature: GYAE6OF01ACIN9.39.81.H04.1.454.CMB.1.raw
  modified_base (553)..(553): a, c, t, g, unknown or other
  misc_feature (553)..(553): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcgtggtggcagcaacaacgaggtcgacccacttcccgaggttcagcgtggtacagtctggagctgagatggaacgacgccgtcgggccctagaggtagaacgtcctccgtggaccacggtctttcgtcggttacctaaccctttacctaacgttagttacggtactacgttagggttgggtcgacgaaccggtaccggtccccgtaggtaaccgggtacggttcggttagggtaggtacgggtgggttaggggtactagggtaacctcggtaccggtaccggttacgttaacgtacgtttaccggaccctaaaccgtaaacctaaacgttcgtacgaccctaaaccgaaccggtaacccgtacgggaccggtacgtacggtacgtacccgaaccctacgtaaccgaaacccaccggaanaacccaactcccgtaacccggaccggtaccggaccgaaccccggtcccgttaacggaccggtaaccgggtcggtaacgggtaccgacccgtacggtaccggtaattcccgaacgggtaaccggacccggtaacccgggttacggttaacgtttaaccggtttaacccggttacggttaccgggtaagaaccgggttaaacgggtacgggttaaaacccgggtttaaacggggttttaaacggtttaacccgttttcgggtaaccccgttttggttaaccccccggttttaaggttccccggttaaacggttaccgggggtaaccccggggtacccgggtaaacccggttcccgggtttaaccccggg

SEQ ID NO: 197358 - DNA, 925 bp, Homo sapiens
  misc_feature: GYAE6OF01BEUX2.39.81.H04.1.454.CMB.1.raw
tcagtcgcactagtcacgaccggtgctcgatttagtagtgtagattcgcggggcacccaaaaaccacacccctccttgggagaatcccctagatcacagctcctcaccatggactggacctggagcattccttttcttggtggcagacaacaacgaggtcgccctactcccgaggttacagctaggtactagtcgtggagcgtggagagtcggacgaacgtccggtcggggtcctaggtaggtacggtaacgggttccttaccggtacggaccggtaacggttccttttacggttacggtttaacccttaacccgttttaaaccgtaaacgttagttacggttcttacggttacggggtttcggggtaccgaaccggaaccgttacccggacccggtaggggaaaccggtacggggttacgttagggggtaggttaggggtaagttcggggggtaatcgggtaacgtcggtaaccggtaccggttaacgttaaccgtaaggtttaccggtaacccgtaaaaccgaaaaccgtttaaacggtataccgggaaaccaaccgaaacccggggttaaacccccggaggaaaccgggtacctaacggaacccggttaaccaaaccggtaaacccaacgggaaaccccacgggtaaaccaaccgtaacctaaccggaacccgtaaccggaaccggaacccgtaaccggtacccgtaagtaccggtaacccgacgggtaacgacggtacctaacggaggtaacctcgtaccgtaacggaacggacccggtacggttacggttaccttaggtcggtacggacgtacgtagggtaacggtaacggttacggttaacgtttacgttacggtaccgttccgttaaccgttacggtaccggtaccggtacgggtacgggtaaccgtccggggtaccg

SEQ ID NO: 197359 - DNA, 644 bp, Homo sapiens
  misc_feature: GYAE6OF01AU9AA.39.81.H04.1.454.CMB.1.raw
  modified_base (259)..(259): a, c, t, g, unknown or other
  misc_feature (259)..(259): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctctgcaaggcttctggttaccacctttaccaactntggtatcagttggtgcgacgacggcccctggacaagggcttgagtggagtgggatggatcgagcgacttaacgaagtggtacacaaacaactatcgactacgaacgtaaccctccgagggaccaagacgtaccaccagtacgaaccaacgacgacacactaccacggacacgacccggcctacagtacgggaaccgtggaacggacgccgtaggacgtaacgtcgtacggaaccgaaccggtacccgggtaccggtttgttaaaccgttcgttagggtcgacgggaagtaggaacgggttacggggaaattttcggtttagtacgttcgggttaccccttggtttacgacgttacggtcggggaaccgtccgggtaacccgtcgg

SEQ ID NO: 197360 - DNA, 694 bp, Homo sapiens
  misc_feature: GYAE6OF01AIQ80.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtgggcctcagtgaaggtctcctgcaggtcttcgtgttacacctttaccaactatggtatcgagttggtgcgacgacggcccctaggacgaaggcttaggagtggagtgggatggatcgaggccgtacttaacgaagttggtaccaacaacgtaaaactcgtacgaccaaccgaacgaacccgtaccgaggggaccaaggacgtacaaccataccgaaccacacggaaccacactaccgaacgacgaccgaccggtacctaacgacgtacggaccgtacggaacggacgtccgaggtacgactaccgacggaaccgaccgtaccgggtacgttacgttacttaccgtaggtacgggacgaacggaggtaaccggttaaagggttaaacgtttacgtttaccggacggtttacccgggttaccctttgtttaccggtaaccgttaccgggtacccggggtaccggtaacccggggtacccgttacccggg

SEQ ID NO: 197361 - DNA, 787 bp, Homo sapiens
  misc_feature: GYAE6OF01CRXH5.39.81.H04.1.454.CMB.1.raw
tcagtcgcactagtcacgaccggtgctcgatttagtagtgtagattcgcggggacccaaaaaccacacccctccttgggagaatcccctagatcgacagctcctcaccatggactggacctggagcatcctttctggtggcagcaacaacaggtcgcccactccctaggttccagctggtaccagtctggacgctaggagactagacgaagccgtgggcctcgaggttgaacggtcctaccgtgacgtaacggctttacgtacggttaacctacccttttaacgaaacttagttacggtaacttccggtaaggttttcggacggccgtaaaccggtccggtcccccgttaggggaacccgtaagggtcctttagggaagttacgggtatttacggggataccggtaagtccgtacgtacgtactaacgaacgtcggttaccaactaaccgtaaacttgccgaacaccgtaaccgtaacccgtcggaacgggactaaccggcctactaacccgtagtaccgaaaccgtaacacggtaacctaccgactaaccgacgtaccgaaccgtaaccggacttacgaaccggtacgaccttagggaacgttccggactaggacctagaccgtacgaccgaccggtcggtaccgtacgtacgtaacgtcggtcgtaaccgaggtacgtaacggtacgttaaagtttacgttaaccgttacggttaaccgtttacccggttcttacccggtaaggttacccggtagggtaaacccccggtggtacccccgttacgg

SEQ ID NO: 197362 - DNA, 710 bp, Homo sapiens
  misc_feature: GYAE6OF01CAMQ2.39.81.H04.1.454.CMB.1.raw
  modified_base (156)..(156): a, c, t, g, unknown or other
  misc_feature (156)..(156): n is a, c, g, or t
  modified_base (366)..(366): a, c, t, g, unknown or other
  misc_feature (366)..(366): n is a, c, g, or t
  modified_base (608)..(608): a, c, t, g, unknown or other
  misc_feature (608)..(608): n is a, c, g, or t
tcagtcgcactagtcacgaccggtgctcgatttagtagtgtagattcgcggggacccaaaaccacacccctccttgggagaatcccctagatcacagctcctcaccatggactggacctggagcattccttttctggtggcagcaacaacaggtcncccactccaggttcagctaggtacagtctaggagcgtgagatgaccggaagtccgtcggggcctcgaggtacgtaaggtctccgtggacgtaacggtctttcgttagggttacctaccttttaaccaacttagtaggttaactacgtaggttagggtgcgaacgagggcccctagggaacgtaagggtcttagaggttacggtagtaggntacgagttccagcggtactaacgtagtacggtaccaagaaactaacctaagtagacgaacaacggtacccacgaggactaaggacgtaccaaccgtacgtaccaaccgaaacagttaaccaccgacgtaccgaacggacgtaccgaacccggtactaactacggtacgtaccgtaggaacgacgtaccaggtacgagtaccgtacgaaaccggctaccggtaccgtagttaacgtctacggngaccgacgggtagtaccggtaacggtaacgttagtaggttacgacccgttactttcccggttacgttacgtacgaccggggtaccctaggcccgttaccggg

SEQ ID NO: 197363 - DNA, 790 bp, Homo sapiens
  misc_feature: GYAE6OF01DZ8FN.39.81.H04.1.454.CMB.1.raw
tcagtcgcactagtcacgaccggtgctcgatttagtagtgtagattcgcgggacccaaaaaccacacccctccttgggagaatcccctagatcacagctcctcaccatggactggacctggagcattccttttcttgggtggcagccaaacgaacaggtcgcccactcccaggttcagctggtacagtctgggagtctgagatagacgaacgccgtcggggcctacgagtggaacgtctccgtagacgaagtcttcgtacgttaacctacctttacaacttataggtatcgtaggttcggtcgacgacgcggcccgtaggtaacgacggtgtggaggtggaggtagggtgtaggctacggaggtcgtacttaacgtagttcggtaaccaactaaaccgttaagtacgtacgaaaccgaaccgtaaaccggtaaccggtaccggaacgggtacgtaaaggacgttacccaaccgtaacgaccgaaccaaaccgaacgtaccctaagacccgtaacccgagggaacccgtaccgaaccccgggtactaacggtagtacccgggtaacgtgggaaccgtcggaccgttaggacgtaacgtacggaccgtaaccggaacgggtaccgttacggttaagttacgttacgtaggacgggtaacggaaggttaacggttaacggtaacgggttaacttttacggttcgggttaacctttccccggttaacgttttcgaacggttaccgggtaaccgggtaccggggtaaaccggtaccggggtttcccgtaacccgg

SEQ ID NO: 197364 - DNA, 866 bp, Homo sapiens
  misc_feature: GYAE6OF01DSRDE.39.81.H04.1.454.CMB.1.raw
  modified_base (665)..(665): a, c, t, g, unknown or other
  misc_feature (665)..(665): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaaacaacaggtcgcccactcccaggttcagctggtacagtcgtggagctgagagtgacgacgccgtggggcctcgagtgaaggtcctccgtgacgaaggtcttcgtgttacctacctttaccaattacgtggtatcgtaggttggtcgcgacgaccggcccgtaggaacgaggtcgttggcggttaggaggttggggactaggggactacgtacggtaccgtactttaacgtaaggttccgtaaaccaaccgtaaactaaacgttagtaccgacgaaacgtaacccgtaaccgtccggaacgggacttaacgggaccgttaccgaacctacgtaacaccgaaacacgaacctacgtacacccggaacggtaccaccggtaaccccggttacaaccgtaggtaccgtacgacgggaacgggtacccacggttaggaaccgttaacgttccgtaacccgggaaccggtaaaccccggtccggggtaccgttttaacgttaaccgggttcttttaccggggnggaacccgggttaaaggtaaccgggttaaaacggggtttaacgggttaaaccttttttagggtttaaccccgggtaccgggttttttaaccccggttaaacccgttttttcggttaaaccggtttaaccggggttaccccgggtaacccgggggggtttaaacccccggttacccggggttaccgggttaacccccccggg

SEQ ID NO: 197365 - DNA, 671 bp, Homo sapiens
  misc_feature: GYAE6OF01DM7UQ.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactccccaggttcagctggtacagtctggagctgagatgacgaagccgtggggcctcgagtgaaggtcctccgtgcaaggtcttcgtggttaccaccttttaccaactatggtatcagttgggtgcgacgacggtccccgtggacgagggtcttagaggtggagtggagtggatcgagcgtacttacagtggcacaacaaactatcgacaacgacgaaccctccgagggacaggacgtaccaccagtacgaccaacacgaaccacacgtccaacggacgtaccgaacccggtacctaacgagtaccgaccgtggaacggtacgtccggtagaacgtactcgtaacggacccgaccgtaccgggttccgttagttacggtttacgaggtcgaaggtacgagggtaacggttaacgggtaaatttacggtttacgaccgtttaccgggtacccctttgttaaccggtaccgttacgggaccggggtacccgaaaccggggttcccgttaccggg

SEQ ID NO: 197366 - DNA, 923 bp, Homo sapiens
  misc_feature: GYAE6OF01CRDLY.39.81.H04.1.454.CMB.1.raw
tcagtcgcactagtcacgaccggtgctcgatttagtagtgtagattcgcggggacccaaaaaaccacacccctccttgggagaatcccctagatcacagctcctcaccatggactggacctggagcattccttttcttggtggcagcaacaacaggtcgacccactccctaggttcagcgtggtacagtctggagtctaggagtagtcgaacggaacggtccgtcgggggtcctacgtacggtaggaacggtttcctaccgttggacgtaacgggttccgtttacggttacgggtttaacccttaacccttttaaccgaaacgttagtttacgggtaattccggttaaggggttggggttaccgacgaacccggtaccgggtaccccgtaggggaaccggtaaacgggtcgttaggacgggttagggtcgggtagggtgttagggtacgacgtaacgggtccgtaccgttaactacggttaccggtacctaaaaccgtaaaccgtaaaacgttacggaaccgtaaccctaaaccggaaacccgttaaccccctaacggggtaacggaccggtaaccgggaacttaacccggaaccgttaaaccggaaacccgtaccaaaccggaaccgtaaccgtaaccctaccggtaaaccccgacgtaaccgggtaacccaaccgggttaccctaacggacgttaccgggaacgttaacgggacgacccgtcggtacggaactcgttaccggaacggaccggaacggttacccggtacgggtttacttaccgtaacggttcggaccggaagtaacgggtatacggggttaaacggtattttaacggttcgggtaacccgttcttacccggtttacgttccggtaacgggttacggtaaccgggtccggtaacccgggtcccgttaaccggg

SEQ ID NO: 197367 - DNA, 672 bp, Homo sapiens
  misc_feature: GYAE6OF01C2CFU.39.81.H04.1.454.CMB.1.raw
  modified_base (484)..(484): a, c, t, g, unknown or other
  misc_feature (484)..(484): n is a, c, g, or t
tcagtcgcactagtcacgaccggtgctcgatttagtagtgtagattcgcgggacccaaaaaccacgacccctccttgggagaatcccctagatcacagctccgtcaccatggactggacctggagctacttccttttcttggtggcacgcaacaacaggtcgcccactcccaggttcacgcgtggtacagtctggagctgagatcgacgaacgccgtcggggcctcgagtaggaacggtcctccgtgacgacgtcttcgtacggttaacctaccttaaccaactgtcggtactcgtaggttggacgtcgtacgccggtcccgaggaacgacggtcgtggaggtggacgtcggagtcggtacgtcgacgtcgtacgtaactacgtacgaccacaacgtaactatacgaccaacgtaacgtaccaccgtaggacaagcgtacactaacgacgaaccaacgacgtacaacgtaccgacctaacggtnacccgtaaccgtccaagtactcggagtggaacggtcgactagtactacgtcgtacggaaccgtcggtacccggtcgttagtaccgtggtacgcggacgaaggtacggtagggtaacgtttagttaccggttcgaacgttaccgttccgttagtacgtacggttacgccgggtacgaccggttcgtccg

SEQ ID NO: 197368 - DNA, 647 bp, Homo sapiens
  misc_feature: GYAE6OF01C5VG5.39.81.H04.1.454.CMB.1.raw
  modified_base (217)..(217): a, c, t, g, unknown or other
  misc_feature (217)..(217): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcattccttttcttggtggcagcaaacaacaggtcgcccactcccaggttcagctggtacagtctggagctgagatgacgagccgtgggcctnagtgaaggtcctccgtgacgaaggtcttcgtacggttacctacccttttaccaacttagttggtatcgtaggttgggtcgcgacgaccggtccccgtaggacgaaggtcttggaggtggagtgggatggatcgagcgtacttacagttggacaacaactaactagtacgacaacgaacgtaaccctacggacggacgaagacgtacacgtagaccgaacacgacgacacgactaccgacgacgcgacccgctaacagtcggacctaggaacgtcgcgtagacgtactcgacggaaccgacggtaccggtcgtttagtacttagtggacggacgaagtacggtaacgttaagggttaatttcggtttagccggttaccgttacccgtttgttacgaccgttacgggcgggtaaccgtccgggtacctccgg

SEQ ID NO: 197369 - DNA, 678 bp, Homo sapiens
  misc_feature: GYAE6OF01AUGSP.39.81.H04.1.454.CMB.1.raw
  modified_base (282)..(282): a, c, t, g, unknown or other
  misc_feature (282)..(282): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaacggtctcctgcaaggcttctggttacaccgtttaccaactagtggtaatcgtagttgggtncgacacggcccgtgacgaagggtcttgagtggatggggatggaactcgagtcgtcttaagaacgtcggtacaacgaacctaaaactctacggaccaacgacgtaaacccctcggagggtacacggtacgttaccaaccaacgtacgaacccacgtaacgaacgactacgtacccgaacgtacgcccgtaacccggtcctaacgacgttaccggacctagggacggtaccgaccggtagacggtactcgtaggacgtacgaccgggtctagtactacgtgtacgacgtaggacgtaagtacgggtaaatttcgtttacgaccggttccgttaccgttcggtttaacggtaaccttaccgggtacgggtacccggtaaagggtaccccggttaccggg

SEQ ID NO: 197370 - DNA, 701 bp, Homo sapiens
  misc_feature: GYAE6OF01A86D3.39.81.H04.1.454.CMB.1.raw
  modified_base (519)..(519): a, c, t, g, unknown or other
  misc_feature (519)..(519): n is a, c, g, or t
tcagtcgcactagtcacgaccggtgctcgatttagtagtgtagattcgcggggactggacctggagcatccttttcttggtggcagcaacaacaggtgcccactcccaggttcagctggtacagtctggagctgagatgacgaagccgtggggcctcagtgaggtctcctgcaaggtcttctcggttactacctttacaactatggtatctaggttgggtgcgacacggccctaggacagggctggagtggagtgggatggactcgacgtccgtacttacgaagtcggtaccaacaaccgtaaacttgcggacctaaccgaacgacccgtaccggacgggacaacgtacgtcccaacgtacgtaccgaacccaacgacgtaacccaacgtaccgtacccgaacgacgacccgtaaccggtaccctacgtacggtaccggacccggtagggaccggactccggtaagacgtacgtaccgtacggaaccggacggtaaccggtcgttaagttacgttacgngtacggacgaggtacgtaaggttacggtaatttcgttacggtacgttccgttaccttgttacgacggttacggcgggtacaccggtccgtagccctacgtccctacgtaccgccgtccctaccgtaccgccgggtccctacgttcccgtacccgttccccgcgtcccctcctcccgtaaccg

SEQ ID NO: 197371 - DNA, 650 bp, Homo sapiens
  misc_feature: GYAE6OF01AJOK8.39.81.H04.1.454.CMB.1.raw
  modified_base (351)..(351): a, c, t, g, unknown or other
  misc_feature (351)..(351): n is a, c, g, or t
  modified_base (360)..(360): a, c, t, g, unknown or other
  misc_feature (360)..(360): n is a, c, g, or t
  modified_base (389)..(389): a, c, t, g, unknown or other
  misc_feature (389)..(389): n is a, c, g, or t
  modified_base (414)..(414): a, c, t, g, unknown or other
  misc_feature (414)..(414): n is a, c, g, or t
  modified_base (496)..(496): a, c, t, g, unknown or other
  misc_feature (496)..(496): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttctggtggcagcaacacaggtcgcccactcccaggttcagcgtggtacagtctggagctgagatgacgaagccgtgggcctgagtgaggttctccgtgacgagtcttcgtgttacctaccttacgaacttatgtatcgtaggttggcgacgagaccggccctaggacgaggcttgagtgagtggagtgagacgacgtcgtactacgtagtcgacctanaacgtaacngtcgacacgaactaccgacgacgcgtaanacgtacactagacgacctaagcaanaccgtacaacccaggaaccgccggtaacccaccgtaaagtaccgtaccggtaacctaggacggttaccacgtagcggtaacnccgtaaggacccgtaacggtccggtaagttacgtaacgttcgacggttagaaacgacggttggaacgggttaccgttaagttttcgtacggacgtcgttttaccgtacgttacggaccgtacgggttaaccggacggttcgttaacccgtccgg

SEQ ID NO: 197372 - DNA, 742 bp, Homo sapiens
  misc_feature: GYAE6OF01C3ZTS.39.81.H04.1.454.CMB.1.raw
  modified_base (124)..(124): a, c, t, g, unknown or other
  misc_feature (124)..(124): n is a, c, g, or t
  modified_base (724)..(724): a, c, t, g, unknown or other
  misc_feature (724)..(724): n is a, c, g, or t
tcagtcgcactagtcacgaccggtgctcgatttagtagtgtagattcgcggggacccaaaaaccacacccctccttgggagaatcccctagatcacagctcctcaccatggactggacctggancattcctttcgttggtggcagcaacacaggtcgcccactcccgtaggttccagcgtgtacagtcgtggagctagaagtgtaggaacgaacgtccggtcggggacctcgaggtggaaacggtcctaccggtgaaccgtacggttccgtttacgttaccggttaaccttaccctttaaccaaacttagttcggttaattccggtagggttgggtacggaccgtaccggaccggtacccgtaggaacggacggtcgttaggaggtacggtaggtggaagtgtacgtacgacggactacttacggaagttacggtaacacgtaaccaacgttagaccgtactacgaaacgttacccgaggtaacggacgtacgtaccgtacaccgtaacgtacgaaccgtaacgaacaccaactacgtcccgaacggtacgacccgtaaccgtaccgtaacgtacggtaccgacgttacggacggtacgacgtagaacgtacgtaccgtacggaaccgtccgtaccgggtactttacgacgttacgttgacgtacgagtaagtacggttaggttaacttgttacgtcttcggttaccttgtacgtacgtacggngaccgtacggtccgtacg

SEQ ID NO: 197373 - DNA, 749 bp, Homo sapiens
  misc_feature: GYAE6OF01D4N5N.39.81.H04.1.454.CMB.1.raw
  modified_base (339)..(339): a, c, t, g, unknown or other
  misc_feature (339)..(339): n is a, c, g, or t
  modified_base (348)..(348): a, c, t, g, unknown or other
  misc_feature (348)..(348): n is a, c, g, or t
  modified_base (409)..(409): a, c, t, g, unknown or other
  misc_feature (409)..(409): n is a, c, g, or t
  modified_base (430)..(430): a, c, t, g, unknown or other
  misc_feature (430)..(430): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcacttccttttcgttggtggcagcaaacaacgaggtcgcccactcccgaggttcagtcgtaggtactagtctggacgctagagatgacgagccgtgggcctgagtggagtctctgactaggtcttcgtgttacctaccttaccattagtagtatcgtaggttggcgacgtaccgccggtcccgaggaacacgggtcttaggaggtggaggtggngtcgatcgngtactattaagaagttcgaacaacgtaaacaacttatccgaacaacgtaacgtaaccccgnggtaacggctaaccggtaacnccctaaccgtacgaccggaaacctagaacgtaccacgtaaccaacccggaagtaccgaccgtaccgtaacccgagtaaccggagtacccgtgggaaacggccgttacggacgtacgtacgtacgacgtaacccggaacgtaccggttaacgtttacgttacggttacgacggtgggaaccggaagtaaccggttacgggttaaaggtttaaaccggttgtttacccggttaacgtttcccgggtttaccctttaggttaaccggtaccggtttacgggaccccggggttaaacgtcccggggtaacccgtttacccggg

SEQ ID NO: 197374 - DNA, 804 bp, Homo sapiens
  misc_feature: GYAE6OF01AO0C1.39.81.H04.1.454.CMB.1.raw
  modified_base (183)..(183): a, c, t, g, unknown or other
  misc_feature (183)..(183): n is a, c, g, or t
  modified_base (192)..(192): a, c, t, g, unknown or other
  misc_feature (192)..(192): n is a, c, g, or t
  modified_base (478)..(478): a, c, t, g, unknown or other
  misc_feature (478)..(478): n is a, c, g, or t
  modified_base (512)..(512): a, c, t, g, unknown or other
  misc_feature (512)..(512): n is a, c, g, or t
  modified_base (663)..(663): a, c, t, g, unknown or other
  misc_feature (663)..(663): n is a, c, g, or t
tcagtcgcactagtcacgaccggtgctcgatttagtagtgtagattcgcgggggacccaaaaaccacacccctccttgggagaatcccctagatcacagctcctcaccatggactggacctggagcactcctttctggtggctagcaacaactaggtgcccacgtccaggttcagctggtacngtactggancgtgacgataggacgaacggccgtcggggcctactagtaggtaacggtcctccgtgacgaggtcttcgtcggttaacctaccttaaccgtaacttgtaggttatcggtaagttgggtcgacggtaccgacggcccctagggaaccgtagggtccttgggtacggtaggtacggtagggtctaggtactaccggaacgtcgttacgtttaacgacgttcgtaacgaactaactaaacgttcaaccgtacgtaacgacccgtaaccacccggaagggtaccggtaacnccggttaacaccgggtactaaccgggccctaaanaccggaacctaccgaccgtaccgaacgtaccggaccgacccgttaaccacgtaaccttacgggaacctgggaaacccgggctccgtacggaacttaccggtacgaccggacccggtacggtacccgtaacgttacgttacgtttacccggnggttacggaacgtaaggacggttaacgggtaacccggttaatttacgggtaccgtttaccgggaaccccgttttcggttacgttaacccgttacgggttacccgggtaccggaccgggttaacccgggttaacgtccccgg

SEQ ID NO: 197375 - DNA, 782 bp, Homo sapiens
  misc_feature: GYAE6OF01AIMNX.39.81.H04.1.454.CMB.1.raw
tcagtcgcactagtcacgaccggtgctcgatttagtagtgtagattcgcggggtgatcaggactcctcagttcaccttctcacaatgaggctccctgctcagctcctgggctgctaatgctcgtggtcccaggactccaggtggggattgttgtgatgactcagtctccagtcctccctcgcccgtcacccgttgaccagcccgcctaccatcgtcctgactagtctagtacaacgtcctacgtatactagttcgagtacggtaaacctaccgttaacgttagtaacgtttacgggttaccaggccgaaggacggtacccgtaacggaccctaacgttaccgtaccgaacgggtcctaaacccgtttaattttaccggttaaacggtttacccgtaaccccgggacgtttaccgggtaccgggttaccgaacggtactaccggtacgttacgacggcggtaccgaggttacgggtacaacggtacttacgtacggttacttaacgactaacgtttaaaggaaacttccgaaggtacgtaacgggggtggtacccggtaggtagggtacgggtaagtttagggttttaacgggttttacaccgtcgtaagtaacgtacggtaccgaacggtaacgtaccgtaacgttccggttacccgtaccgttacgtacggtttaccggacggtaacccggtaactacgggacccgtaaggtaacggtaacctaaggtaaaccgtaccggtacgggtctaaccgccggaacttacgggccttcgttaccgg

SEQ ID NO: 197376 - DNA, 727 bp, Homo sapiens
  misc_feature: GYAE6OF01CMJ79.39.81.H04.1.454.CMB.1.raw
  modified_base (168)..(168): a, c, t, g, unknown or other
  misc_feature (168)..(168): n is a, c, g, or t
  modified_base (392)..(392): a, c, t, g, unknown or other
  misc_feature (392)..(392): n is a, c, g, or t
  modified_base (468)..(468): a, c, t, g, unknown or other
  misc_feature (468)..(468): n is a, c, g, or t
tcagtcgcactagtcacgaccggtgctcgatttagtagtgtagattcgcggggacccaaaaaaccacacccctccttgggagaactcccctagatcacagctcctcaccatggactggacctggagcattccttttcgttggtggcagcaacaactacggtcgacccnctacccgtaggttcagcgtggtacagtcgtggacgcgtaggagactggaaccgacggtccggtcgggaccctgtaaggtcggtacggtaccttccgtggacctaacggtctttccggtacgtttaaccttaccctttaaacgacttggttacggtacgttcgtacgggttggtcgacgtaccgccggtccgtaggacgtaggtcgttggaggtggacggtgggntagacgcgtcacgttacgtactacgtaccggactactaaacaacgtagctaccaacgtaccgaaccgtcgaacggnacaccgtacacacgtaccacgacaagtcccaactcctaccgacgaccggaccgtaccctaacgtccgaggtaccggaccggtaacggcgtaccgtccgtcggtaacgtcgaacccgaacggccgtaacgggcccgggtagtttaccgtacgttcgtacggcgacggtacgagggttaaggtaggttaaacggtttcgtacgttcggtaaccgtttcgttacgtcgtaccggttcggaccggtaccgcggtacgtcccgg

SEQ ID NO: 197377 - DNA, 822 bp, Homo sapiens
  misc_feature: GYAE6OF01B193Z.39.81.H04.1.454.CMB.1.raw
tcagtcgcactagtcacgaccggtgctcgatttagtagtgtagattcgcgggacccaaaaaccacacccctccttgggagaatcccctagatcacagctcctcaccatggactggacctggagcattcctttttcttggtggcagcaacaacaggtcgcccactcccaggttcagctggtacagtctggagctgagatgacgacgcgtcgggcctcgagtagaagtcctcgtgacgaaggtccttcgtcggttacctacccttacaactagtggtactgtaggttgggtcgccgacgacggtccctaggacgtagggcttagtaggtaggagtagggagtacggagtcgacggtcgtaccttataagttacggtaacaacctaacctaaaacgttagtacgacgaacgaaaccgaaccctccggtaagggaccgaagtacgtaaccgaccaacgttaccgaaacccgaacgaacgaaccaacctacctacccgaacggaccggaccgaacccgtaccgtaaccgtaacgtaccggaaccgtacgggaacggtacccgtacggtaccgaacggtaccgttaccggtaacggaacccggttaacccgaaccccgggttacgttaacgttttaaccggtttaacgtaggttaacgggaacggtaaggtaacgggttagggttaaaacccgggtttaaagttttaacggtttaaccggttaccggtttaccccggttttacccgtttacggtttaacggtaaaccggtttacccggggtaacccggggtaaccccggaacccggggttaacccgttaaccccgggg

SEQ ID NO: 197378 - DNA, 716 bp, Homo sapiens
  misc_feature: GYAE6OF01CX4CC.39.81.H04.1.454.CMB.1.raw
  modified_base (511)..(511): a, c, t, g, unknown or other
  misc_feature (511)..(511): n is a, c, g, or t
  modified_base (518)..(518): a, c, t, g, unknown or other
  misc_feature (518)..(518): n is a, c, g, or t
tcagtcgcactagtcacgaccggtgctcgatttagtagtgtagattcgcggggacccaaaaaccacacccctccttgggagaatccctagatcacagctcctcaccatggactggacctggagcattcctttcttggtggcagcaacaacaggtcgcccactcccaggttcagctaggtacagtctggagctggagatgacggaacgccgtggggcctacgaggtgaacggtcctccgtgcgtaaggctttacgtacgggtttaacctaacccttttaccaaacgttagttcgggtaattccgtaaggttcgggtcggaccgtacggaaccggtccccgttagggaacgaagggggtcctttagggagggttagggacgtaggggtactggggtaactcgaggtaccgtactttacgaacgttggtaactaccgaaactaaacgtatcgacgaacgtaacgacccgtacggaggacctaaggcgtaccacgataccgacacgacacgacanacacganaccgacgcagtaactgaccgaggtacgagctaggcgtactgacgaacgccgtacggacgttcggtacttacgtgacggtacacggtagacgggttacgggtaaattttacggttaggttaccgtgggtttaacccctttcgtttaacggtacccggttaacggtaccgggacccgtaccggggtaacgttaccccggg

SEQ ID NO: 197379 - DNA, 785 bp, Homo sapiens
  misc_feature: GYAE6OF01EQYKE.39.81.H04.1.454.CMB.1.raw
  modified_base (188)..(188): a, c, t, g, unknown or other
  misc_feature (188)..(188): n is a, c, g, or t
  modified_base (391)..(391): a, c, t, g, unknown or other
  misc_feature (391)..(391): n is a, c, g, or t
tcagtcgcactagtcacgaccggtgctcgatttagtagtgtagattcgcggggacccaaaaaccacacccctccttgggagaatcccctagatcacagctcctcaccagtggactggacctggagcattcccttttcgtggtggcagcaaacacgagtcgcccactcccgaggttcagtcgtaggtanacgtcgtggacgtcgtaggaggtagtacgaacggacgcccggtggggacccttaggacggtacggtaacggtcctccgtaggacgtacgtctttacgtacgttacctacgttaaccattacgtggtactcgtaggtttcggagccgacgtcccgaccgtaggaacggtaggtccgttaggaacgggtggtaagtacggggtanacgggtactacggacgtcgtaaccgttagtaggacctaacgtaaactaacgtaacctgtaccgtacgaaacccgttaaccggacccgtacggggaaccgaacgtaaccggactaaccccgttaaagacccgtaaccacgaaaacccgacgtaaccgaactaaccgaccgtaaccgaaccgacggtaccctacgtacgaaggaccggacgtaacggcgtacgacggtagacgtatacggacgaacggtaccggtaacggtacgtaggttaaccgtcggaacgggttagacggaacggtagttaaacgggtaagtttaagttagttacgacggtttacgtaccgttacgtacgtaacggtcgggtacccggtaacggtacccgttaccgtacccgg

SEQ ID NO: 197380 - DNA, 595 bp, Homo sapiens
  misc_feature: GYAE6OF01ARQWJ.39.81.H04.1.454.CMB.1.raw
  modified_base (350)..(350): a, c, t, g, unknown or other
  misc_feature (350)..(350): n is a, c, g, or t
tcagtcgcactagtcacgaccggtgctcgatttagtagtgtagattcgcgggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaggtcttctgttacacctttaccactatggtatctagttgggtgcgacgaggcccctggacaaggggcttaggagtggatgggatggatcagcgacttacgaatggtacacacaaactntgcacagaacctccgagggcagacgtcaccatacgaccacgacgacacactccacgagccgacggtcctaacatacggacctagggacggacgaccgtagagtacgtaccgacgaacgaccgacgggccgttagtaacttacgtgggtcgaggagagtagggtacgggtaaaattcgtttaggaccgttcggttacccttcgtttacgaccggttacggcgggaacccgtagggtacccttcggg

SEQ ID NO: 197381 - DNA, 717 bp, Homo sapiens
  misc_feature: GYAE6OF01DS9TS.39.81.H04.1.454.CMB.1.raw
  modified_base (124)..(124): a, c, t, g, unknown or other
  misc_feature (124)..(124): n is a, c, g, or t
  modified_base (266)..(266): a, c, t, g, unknown or other
  misc_feature (266)..(266): n is a, c, g, or t
tcagtcgcactagtcacgaccggtgctcgatttagtagtgtagattcgcggggacccaaaaaccacacccctccttgggagaatcccctagatcacagctcctcaccatggactggacctggancatccttttcttggtggcagcaacaacaggtgcccactcccaggttcagctggtacagtctggagctgagatgacgaagccgtggggcctcgagtgaaggtcctacgtgacaggtcttacgtcgtactaccttaccaacgtntggtatcgtagttcggcgacgacgaccggcccgtagaacgtacgggtcttggaggtggagtgggattcgggactcgtacggtcgtacgttaaccgagttcggaccaacgaactaaactagtcgacaacgtaaccgaccgtaccgacgggactaacggtacgtacaaccgtacgtaacggaaccctaacgaacgtaacacgtaccgtaccgaaccgacgtacccgaacgtaccgtaacgacggtcggaaccgtggtaacggaccgtcggtaacgcgtaactaccggtacggaaccggtaccgtaccggtaccgttaaggttacctttaggaggtacggaacggtaacggtaggtacgggttaacggggtaaatttacggtttacgtaccgttcgttaacccgtttcgttacgtacgggttaccggaccggggtacccgtacgggtctacccg

SEQ ID NO: 197382 - DNA, 865 bp, Homo sapiens
  misc_feature: GYAE6OF01E0SKW.39.81.H04.1.454.CMB.1.raw
  modified_base (204)..(204): a, c, t, g, unknown or other
  misc_feature (204)..(204): n is a, c, g, or t
  modified_base (735)..(735): a, c, t, g, unknown or other
  misc_feature (735)..(735): n is a, c, g, or t
tcagtcgcactagtcacgaccggtgctcgatttagtagtgtagattcgcggggacccaaaaaccacacccctccttgggagaactcccctagatcacagcctccctcaccatggactggacctggagcattccttttctggtggcagcaacaacgaggtgacccactaccctaggttccaggtctaggtacagtcgtggggacnctaggtagagtacggaaccggtaacggcccggtacggggccttacgaggtaggtaacggtccttccgtacgagacggttcctttacggtcgtttaacccctaccgtttacctaacggttagttacgttacgttagtcgggttacgggtcgtaccggaccggtaccgggtccccgtaagggaacgtacgggtacgttacggtagggtaaggtcgggtagggtcgttagggtacgtacggaccgtacggtacctaacggtacttacgggactaaaacctaacgtaacgaacgtaccgaacgtaaccgaacgtacccggaccgggaacggacgaccgtaccgaactaccgaaggttaccaaccgaacgtacgaaccgtaaccgaaccgtaccgaacggtccgacccgggtaaacctaaccgaccggttaacgaccgggtactaggggaccggtacgtacgtaagcgttaacggtcccgtaacgggaaccgtaccgggccggttaacgttcccggttaggttaccgtacgggtanaccggggtaagtaaccgggttaggtaacggttaaccgtttcggttaacgtaccgttttccgggttacgtttacggtacccggtttacggacggtaacccggggacccggttaacgcccggttaacccggg

SEQ ID NO: 197383 - DNA, 736 bp, Homo sapiens
  misc_feature: GYAE6OF01C0I0A.39.81.H04.1.454.CMB.1.raw
  modified_base (163)..(163): a, c, t, g, unknown or other
  misc_feature (163)..(163): n is a, c, g, or t
  modified_base (275)..(275): a, c, t, g, unknown or other
  misc_feature (275)..(275): n is a, c, g, or t
  modified_base (284)..(284): a, c, t, g, unknown or other
  misc_feature (284)..(284): n is a, c, g, or t
  modified_base (330)..(330): a, c, t, g, unknown or other
  misc_feature (330)..(330): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcacttcctttttcttgggtggcagacaaacaacaggtcncccactcccgaggttcagcgtggtacagtcgtggagctgagatgacgacgccggtggggcctcgagtgacggtctcctgcgagtcttcgtcgttaacctaccttaccaagtntgtacttgnggttggcgacgacgcgtcccgtggaacgaggtcgtgaggtggtagngggactggatgagcgtacttaacgaaggttcgaactaacctaactaaagtactcggaaaccaaaccgttaaaccgaaacccgtcgggacggaaccgaggtaccctacccgaacaacgacgaaccaagactaaccacacaccgaacgacgtaccgacgtaccaacgcgttaggaccgtaggacggaccgtctacggtagtacgtaccgtaacgggaccgaacgggtccccggtagtttacgtaaccggtttagtacggtaccggacggtaagggtaacggttaacggggttaaggtttaaaccgttttcggttacgtttacccgttaccgggtttaaccccgtttaggtttaaccggccggttttaaccgggaccggtacccgggtaaccggttacccggtcccggg

SEQ ID NO: 197384 - DNA, 696 bp, Homo sapiens
  misc_feature: GYAE6OF01ADHVD.39.81.H04.1.454.CMB.1.raw
  modified_base (378)..(378): a, c, t, g, unknown or other
  misc_feature (378)..(378): n is a, c, g, or t
  modified_base (567)..(567): a, c, t, g, unknown or other
  misc_feature (567)..(567): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacgaggtcgcccactcccaggttcagctggtacagtcgtggagctgagatgacgaagccgtggggcctcgagtagaaggtcctctgacgagtcttcgtcggttactacccttaccaactatggtatcgtaggttgggtcgcgacgacggtcccgtaggacgaggtcgtgaggtggagtgggataggactcgacggcgtacttaacgagtcggtacaacaacaaacttntcgacacgaaccgtacccgtacggaggacaaggtacgtaccacctagaccgtaccacgacaccgactacgacccgaaggacgaccgaccggtaccagtacgtacggaccgtaggaggtaccgacgtaggaacgtccgtacggacggtaacccgaccgggtacgggttaccgtttaacgttacttccggnggtaccggagggtaacgacgggttacgggttaaacggttaagttttacggttaccggtacttcccggtttacctttagttacgggaccgtttacggggaccgggacccgttaaccgggtccggtacccg

SEQ ID NO: 197385 - DNA, 666 bp, Homo sapiens
  misc_feature: GYAE6OF01DFGIR.39.81.H04.1.454.CMB.1.raw
  modified_base (159)..(159): a, c, t, g, unknown or other
  misc_feature (159)..(159): n is a, c, g, or t
  modified_base (281)..(281): a, c, t, g, unknown or other
  misc_feature (281)..(281): n is a, c, g, or t
  modified_base (288)..(288): a, c, t, g, unknown or other
  misc_feature (288)..(288): n is a, c, g, or t
  modified_base (354)..(354): a, c, t, g, unknown or other
  misc_feature (354)..(354): n is a, c, g, or t
  modified_base (392)..(392): a, c, t, g, unknown or other
  misc_feature (392)..(392): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcattccttttctggtggcagacaacaacaggtcncccactccaggttcagctggtacagtcgtggagtctgagtatgaacgaacgccgtcgggcctgagtagacggttctccgtgacgaaggtcttcgtagttacctaccttacaatatgtatcgnggttggnacgtacgacgcccgtaggaacgtaggtcgtgtaggtggaggtggagtgtactggacgtcgtactanagtcgacaactaactaatgtacgacacgaacgtacccnggagtcgacgtaacgaccaacgtacgccgaactacgaaccgtacaaccctaccgtaccggaaccggtaccgaaccgtaacccggtctaaacgacggtacggaacctagggaccgacccgtagtacgacgtacgtcaaggtccgacgcgtcgttaatacgtctagtacggacgtaagtcgaacggttaggttaacgtttcgttagtacccgtcggtttaacctacggttacggaccgttacgggtacggtaacccgtaagggttcccgttccggg

SEQ ID NO: 197386 - DNA, 768 bp, Homo sapiens
  misc_feature: GYAE6OF01BSK3J.39.81.H04.1.454.CMB.1.raw
  modified_base (383)..(383): a, c, t, g, unknown or other
  misc_feature (383)..(383): n is a, c, g, or t
tcagtcgcactagtcacgaccggtgctcgatttagtagtgtagattcgcggggacccaaaaaccacaccccctcttgggagaatcccctagatcacagctcctcaccatggactggacctggagcattccttttcttggtggcagcaacaacgaggtcgcccactcccgaggttcagcgtcggtaaccagttcgtggaggtctggagtagtcggaaccgaaggtccgtcggggaccctgtaggtacggtaacggtctccgtagacgtacgtcgttacgttcggtaaccttaaccttaccaattacgtcggttactacggttagttcgggtacgccggacgtaccggtacccgtacggtaacggtaggtcgttcggaggtaggnggtggagtggacgcgagcgtagtactagtcggtaccaacgtaactaactagcgtaacacgtaacctaacggcgtaacggacgaacgtccgtaactaccacgtaaccgaaccgaaccgaacgtaacgacctaccgtaaccgacggtaccgacgacccggtacacgtagtcccggacgcggaaccggtacgacggtagactacgaccgtacgaccgtaccgtacggtacgttagttacgtaacgtcgtacggacgaacgggacgttaacggtaaacgttaacggtttacggttacggttacggtttacccggtttcctaaaccggttttacgtccgggtaacgggtaccccgggtaacccggtacgggttaccccggttaacccggg

SEQ ID NO: 197387 - DNA, 666 bp, Homo sapiens
  misc_feature: GYAE6OF01C2IL6.39.81.H04.1.454.CMB.1.raw
  modified_base (272)..(272): a, c, t, g, unknown or other
  misc_feature (272)..(272): n is a, c, g, or t
  modified_base (323)..(323): a, c, t, g, unknown or other
  misc_feature (323)..(323): n is a, c, g, or t
  modified_base (395)..(395): a, c, t, g, unknown or other
  misc_feature (395)..(395): n is a, c, g, or t
tcagtcgcactagtcacgaccggtgctcgatttagtagtgtagattcgcggggcacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagctggggcctcagtgaaggtctcctgcaaggcttctggttacacctttacaatatgtatcaggttggngcgacacggcccgtggacgaaggcgtttggagtgggagtgggatggatacnggtcgcttaagatcggtcaacgaacaaacgtatgaccataacgaccctcgaggcagtatcacatcgaaccanacgaacacactaccgagacgaccacggacctaacacgtacgacccgtaggacggacgccgttagacgtacgttcgtaacggaaccgaccggaaccgggttccggttagttacgtttaccggtggtacggtacggtaaacggagggtaacggttaacgggggttaaaagtttagtttttacgggtaaccgtttaccgggtttaaccccgttcgttttacggtaacccgtttacgggtaaccgggggaccccggtaaccggggtaaaccccgg

SEQ ID NO: 197388 - DNA, 754 bp, Homo sapiens
  misc_feature: GYAE6OF01B81PZ.39.81.H04.1.454.CMB.1.raw
  modified_base (545)..(545): a, c, t, g, unknown or other
  misc_feature (545)..(545): n is a, c, g, or t
  modified_base (707)..(707): a, c, t, g, unknown or other
  misc_feature (707)..(707): n is a, c, g, or t
tcagtcgcactagtcacgaccggtgctcgatttagtagtgtagattcgcggggacccaaaaaccacacccctccttgggagaatcccctagatcaacagctcctcaccatggactggacctggagcatccttttcttggtggcagcaacaacaggtgcccactcccaggttcagtctggtacagtctggagctgagagtgacgaacgccgtggggctcgagtgaaggtctctgacgaaggtcttcgtcggttaactaccctttaacacgtagtggttaattcgtaggttagggtgacgacgacggccccggtaggaaccgtaagggcgtttaggagttagggaggtaggtagttaggacgtcgacggtccgtaacgttaacgaacgtaggtacaacgaaaccgtaaacgttataccggacaaccgtaaacgaacccgtacggaacgggtacgaacggtaacgtaacccaaaccgaacgcgaaacccgaacgaagaccccgaactaactacccggaaccgtaacggacccgtaacggaacccgtanaacggtacgacccggtaaggacggacgcgtaagtacgtagtacccggtacgaacgaaccgggtaccccggtgtttaaacgttcgtaacggttggaaccgtaccggaaggagtaacgggtacgggttaaacttagtttacgtacggttccgttaaccccgttnttaaccggtacttacggaccgggtaaccgaacgggtacccggttacg

SEQ ID NO: 197389 - DNA, 837 bp, Homo sapiens
  misc_feature: GYAE6OF01D6YR8.39.81.H04.1.454.CMB.1.raw
  modified_base (190)..(190): a, c, t, g, unknown or other
  misc_feature (190)..(190): n is a, c, g, or t
tcagtcgcactagtcacgaccggtgctcgatttagtagtgtagattcgcggggacccaaaaaccacacccctccttgggagaatcccctagatcacagctcctcaccatggactggacctggagctattccttttctggtggcagacaacaacaggtcgacccactcccgaggttccagcgtacggtacngtcgtggagctagagtataggacgaacgccgtcggggcctacgaggtaggacggttcctccgtacgacgtaggtcttccggttacggttaacctaacccgtttaacgaacgtttagtaggttacttcggtagggtttgggtcgaccggaccggacccggtcccgtaggaaccgggtaacgggtcttaggggtaacgggtggtaaggtaggggtacgtaggggtactaccggtacgtacggtacctttaaacggacggttacggtaacaaacctaaacgtaaacgttacgaccggaaccaaccggtaaaccgtaacccgccgggaacgtaccggaaggtaccgttaacgacccgaacgtacgaacccgtaagaaccgaaccctaaccgtccaacccggtaacgacgacccgtacccgtaaccaacggtacgtaccggtaccgtagggttaccggacggttaccgaggaacgtacggtaaccgtaacgggacccggtacggtaccggttccggttacggtttaacgtcggagttaccgggagtaacgggtacggtaaccgggttaagggtttactttacgggttacggtaccggttaccggtccgttacgtacggtacgacgggtaccggacggttacgtacgtcccgg

SEQ ID NO: 197390 - DNA, 657 bp, Homo sapiens
  misc_feature: GYAE6OF01DNNVP.39.81.H04.1.454.CMB.1.raw
  modified_base (121)..(121): a, c, t, g, unknown or other
  misc_feature (121)..(121): n is a, c, g, or t
  modified_base (262)..(262): a, c, t, g, unknown or other
  misc_feature (262)..(262): n is a, c, g, or t
  modified_base (389)..(389): a, c, t, g, unknown or other
  misc_feature (389)..(389): n is a, c, g, or t
  modified_base (541)..(541): a, c, t, g, unknown or other
  misc_feature (541)..(541): n is a, c, g, or t
  modified_base (564)..(564): a, c, t, g, unknown or other
  misc_feature (564)..(564): n is a, c, g, or t
tcagtcgcactagtcacgaccggtgctcgatttagtagtgtagattcgcggggacccaaaaccacaccctccttgggagaatccctagatcacagctcctcaccatggactggacctggancattcctttctggtggcagcaacaacaggtcgcccactcccaggttcagtctggtacagtctgagctgagatgacgaagcctgggcctcagtgaaggtcctcctgacaacggtcttcgtaggttaccacctttacaacgtntaggtatcgtagttggtgacgacgacgcccgtaggaccgtaaggtccttaggtacggtaggaaggtcgggtaagtggacttcgaggcctacttaacgtaaacgttggaccaacgtaacaaaaccgtntacgactacgaagaaacccgtcggacggaccaaggtacgtccaacgtacttcgaaccgacgtaacaccgaactaccgacccaacgcgaaccgacccgtaccttaacgacgtaccggaccgtagacgggcaccgtagacgtactctaggaccncgaacggtccgtatacgttaacncgtagaccagtacgcggtaaaggttagtactttacggacgttccgttacctcgttacgtaaccgtcggtacggtacccgtacggtaccgtacg

SEQ ID NO: 197391 - DNA, 810 bp, Homo sapiens
  misc_feature: GYAE6OF01B9XQ0.39.81.H04.1.454.CMB.1.raw
  modified_base (159)..(159): a, c, t, g, unknown or other
  misc_feature (159)..(159): n is a, c, g, or t
tcagtcgcactagtcacgaccggtgctcgatttagtagtgtagattcgcggggacccaaaaccacacccctccttgggagaatcccctagatcacagctcctcaccatggactggacctggagcattccttttcgttggtggcagacaacaacaggtcncccactccgaggttcagcgtaggtacagtcgtggagtctagagatacggaacggaggtccggtgggtccctagaggtacggtaacggttcctccgtaggacggtaacgttccgtttacgtacggtttaaccctaaccgtttttaaccaagttacgttacggtacttacggttgggttcgggcgaccggaacgtcccggtcccgtaaggaccgggaggttcgttaggtgggtaggtaggtaggtagtccggtatacggagtccgtactaagtacgtcgaacaactaactaactgacgacaccggaaactacccgacggagtaccgagtaccgtaccaactacgaacgaccagaaaccgtccaactacgaccgacggacgtacccgtaccgaaccgtaacgccggttaacggaccggtagggaaccggtccgtacgggtaactaaaccgtacgtaaccgggtaacccggaacgaccccgggttaaccggttaccgtttaagtaaccggttaggtcggtaaccgggtaggtaaccggtagggtaacggtttaaacgggttacttacgggttttacgacgttttacccggttaccgtttacgaccgttaccgggttacgggaacccgggtaacgtacccggggtaccttaccggg

SEQ ID NO: 197392 - DNA, 856 bp, Homo sapiens
  misc_feature: GYAE6OF01BJ18G.39.81.H04.1.454.CMB.1.raw
tcagtcgcactagtcacgaccggtgctcgatttagtagtgtagattcgcgggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctgagtgaacggtctccttacgaaggtcttcgtaggttacctacctttaaccaacttagtggttaactcgtaaggttgggtacgccgtaacgacggccccttaggaacgaacggggtcttaggaggtagggtagtcggggagttacgggatccgaggtccgtaacgtttacgaagttcgggtaccaaacgtaacctaaaacgtttagaacgacccgaaacgtaacgtaaccctacgggacgggaactacggaaccgttaccacccgtaagtaacccgtaacccgaaacgtaccggaaccctaacctaacgtaacccccgaaaccggtaccgggacccgacccgggtaaccctaaccggtaacgtaaccgggtaccgtaacggggaacggtaccggtacccgtacggtaacgtaaaccgttaccgtaacggtaaccgggaaacccgtacccgggtaccggttaacgttaaccgtttacgttacggtaaggaccgtaaggtaacgggttaacggttaccggggttaaaacgtttagtttacgggttaaacccgttccggttaaccccgttttcgttacggttaaccgttaccggtaccgggtaacccggtaacccgggttaaaccccggttggttaaacccccgg

SEQ ID NO: 197393 - DNA, 783 bp, Homo sapiens
  misc_feature: GYAE6OF01AXONF.39.81.H04.1.454.CMB.1.raw
  modified_base (196)..(196): a, c, t, g, unknown or other
  misc_feature (196)..(196): n is a, c, g, or t
  modified_base (222)..(222): a, c, t, g, unknown or other
  misc_feature (222)..(222): n is a, c, g, or t
  modified_base (225)..(225): a, c, t, g, unknown or other
  misc_feature (225)..(225): n is a, c, g, or t
  modified_base (651)..(651): a, c, t, g, unknown or other
  misc_feature (651)..(651): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcattccttttcttggtggcacgacaaacaacaggtcgcccacctcccaggttcagctggtacagtctgganctgagtatgacgacgccgtgggcctnagngagtctcctgcgaaggtccttcgtacggttacctacctttaaccaattagtcggttactcgtaggttgggtgaccgacgaccggccccgtaggacgtaagggtcgttggagtagggagtagggagtggtaactcgagtacgttacgttaacgtaggttcggaacaacgtaaaacctaaactagtaccgaaccaacgaactaaaccccggtaccggaaggggtacctaaacgggtaaccctaccgaaacccgttacgtaaacggaaacccaaccggaaccgaacccttacgaaccgttaacccgaaccgggtacaaccccggtacccggtaccctaacggtaacggtacccggtacgaacgggtacgaaccgtcgtaaggacttacgtaccgacggaccgaccggtacggtacgtacgtagttaccngtaccgagtaggtaagttaccgggtaaggtttaacgtttcgtttacggaccgtttacccggttacccgtttagtttaccggaaccggtttaccgggaaccgggttccggtaaaccccgggttcccgtaccgg

SEQ ID NO: 197394 - DNA, 967 bp, Homo sapiens
  misc_feature: GYAE6OF01EKDX5.39.81.H04.1.454.CMB.1.raw
  modified_base (161)..(161): a, c, t, g, unknown or other
  misc_feature (161)..(161): n is a, c, g, or t
  modified_base (391)..(391): a, c, t, g, unknown or other
  misc_feature (391)..(391): n is a, c, g, or t
tcagtcgcactagtcacgaccggtgctcgatttagtagtgtagattcgcgggacccaaaaaccacacccctccttgggagaatcccctagatcacagcctcctcaccatgactggactggagcacgttccttttcgttggtggcagacaacaacgaggtcnccccgactacccgtaggtacagtctaggttaccagttcgtaggacgtcgtgagtagtcgaacgaacgtccggtcgggcctacgtagtacggaaccgttcgtccgtgactaacggtcctttacgttaccggttaaccttaaccgtttaacgaacgttagtttcggttactacggtagtttcgggtaccgacggaaccgtacggcccggtacgaacggtacggtagttaggngttaggacggtgggagttacggactacgagacggttaaccacgtaggtcgaaacctacttaaaaccggacttagaccgtaagtaaaccccaacgggaaaccgttaccggaacgtccgtaaaaaccgggcttaaaacccgccggttaacaaaccgaaccgttaaccgaacgttaacccccgtaacgaaccgtaacccgaacgggttaaccgacccgggaccgtttaacccggaacgttaacgggtaaccccgttaaagggtccgggtaaaccggtaccgttaccgaaaggttacccgaaccgggtttaccggaaccggaaccgttaacccggggtaacccgttaccggttaaaccgggtttacttaacgggttacggaccggttaaagggaacccgggtttaagggtaacccggttttaaaagggttaccctttttaagggttacccgggttaaccgggtttttaacccggttttaaccccgggttacgggttttaaacccggttaccccgggttaagggtttacccccggggaaaacccggttaaacccggggtttccccgtttaaacccccgggg

SEQ ID NO: 197395 - DNA, 130 bp, Homo sapiens
  misc_feature: GYAE6OF01CZPIH.39.81.H04.1.454.CMB.1.raw
  modified_base (113)..(130): a, c, t, g, unknown or other
  misc_feature (113)..(130): n is a, c, g, or t
tcagtcgcactagtcacgaccggtgctcgatttagtagtgtagattcgcggggcacccaaaaaaccacacccctccttggggagaatcccctagatcacagctcctcaccatnnnnnnnnnnnnnnnnnn

SEQ ID NO: 197396 - DNA, 828 bp, Homo sapiens
  misc_feature: GYAE6OF01BVPAG.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcattccttttcttgggtggcagcaaacaacaggtcgcccactcccgaggttcagctggtacagtcgtggagctggagagtcgaacgaacgccgtcggggccctagaggtaggaacgtcctctgacgaacggtcttcgtacgttaacctacccttaacaacttagtggttactcgtagggttgggttcgccgtacgaccgggtcccgtacgggaacggtacgggtcgttaggtaggtgggtaaggtgggaagtcgggtaaccgtacgacgtaccgtaaccgtttaacgtacgttacggtaaccgtaaacctaaacgtaaaaccgtagttaaccgaacctaaaccggtaaccgtaacccgtaaccggacggaacgtaacgtaaccgtaccgtaccgtaactaaccggaaccaaacgtaacccgaaccgtaaccgtaacccaaccgaaccggacccgtaacccgaaccccggtaaccgtaaccgtaacgggtaacggtaccggttaacggaaccggtaaccggtaacgcggtaacgtaacgttacggaacgacccggtaaaccggtccggaaccgttacggttacttacggtacgtacggtaggaagtacgggtaacgggttaaacggttaagtttacgttacgttacggttccgttacccgtttagtacgtacggtacgtacgggacgtacccggtccggttaccg

SEQ ID NO: 197397 - DNA, 745 bp, Homo sapiens
  misc_feature: GYAE6OF01ALPO3.39.81.H04.1.454.CMB.1.raw
  modified_base (379)..(379): a, c, t, g, unknown or other
  misc_feature (379)..(379): n is a, c, g, or t
  modified_base (458)..(458): a, c, t, g, unknown or other
  misc_feature (458)..(458): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagacaacaacagggtcgcccactcccgaggttcagctggtacgagtcgtggagctagagtatggacgaacgccgtgggcctacgaggtggtaacgtctccgtgacgtacggtcctttcgtcgttaacctaacctttaccaacgttcgtaggtcttacgtagggtttcgggacgaccgacggtaccgcccgtaaggacgtaagggtcgtagaacggtcggagttacgggagtggaacngtacgtccggtacttaacggaagtcggtacaaccgtaactaactgtccgaactaccgaacgtacccgcggaaggtaccngtaacgactacccgtagaacaccgtaacgacgaaccaccgaactaccgacgacgtacgacccgactacgacgtaccggacgtacggtacggtcgtacggacgtaacggtacgttccgacggtaaccgtaaccggtacccggacgtttaccggttaaggttaccgtacgggtaggaaccggaggtaacgtacggttaaagggttacgtttacgttaggaccgttagggttaccccgtgttacccgtaccgggtaggacccgggtaccgtacgggttaccggtacccgg

SEQ ID NO: 197398 - DNA, 953 bp, Homo sapiens
  misc_feature: GYAE6OF01BQT3E.39.81.H04.1.454.CMB.1.raw
  modified_base (159)..(159): a, c, t, g, unknown or other
  misc_feature (159)..(159): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcgttggtggcagcaacaacgaggtcncccactcccaggttcagcgtgtacagtcgtaggacgcgtagagtagtagaaccgaacgccggtcggggtccctacgtaggtacggtaaggtcccttccgtaggaccgtaagggtcccttttaccgttaccgggtttaaccttaccccttttaaaccgaacgttacggttacggttaacgttaccggttaacgggtttacgggggttacgacccggtaaccggtaccccggggtaccccccggttaaggggaaaccgggtaaaccggggttacgtttaacggggtacggggtttaaccgggtacgggttacggggggtaattacggggtaacgttaacgggtaacggttaacccggttaaccggtttaaccgtaacgggttaaccgggtaaccctaaaccgtaaaaccccgtttaaaaccgtaacggttaaccgacctaaaccggtaaccggtaaaccccgttaccggggaaccgggtacgtaagtaaccggtccaaacctaccggtaccaacccgaacgtaacgaacccgaacctacgtaacccgacggtaaccgtacccggaaccgtaaccgtaacgtacgtacgggaaccgttagggaaccgtacgtacgggaactacggtagtaaccgtaccgaacggtaccggtaaccggtcgttaggtaacctttaggtccgggagtaacgtagggtaacgtacgggttaacgttaacgttacggttacgtacccggtacgttacccgtttgtaacggttccgtagggttacccggacggttacccggtcgggttaccc

SEQ ID NO: 197399 - DNA, 824 bp, Homo sapiens
  misc_feature: GYAE6OF01AR71G.39.81.H04.1.454.CMB.1.raw
  modified_base (162)..(162): a, c, t, g, unknown or other
  misc_feature (162)..(162): n is a, c, g, or t
tcagtcgcactagtcacgaccggtgctcgatttagtagtgtagattcgcggggacccaaaaaccacaccctccttggagaatccctagatcacagctcctcaccatggactggacctggagcacttccttttcgttgggtggcaagcaaacaacgagggtcnccacctcccgaggttcagctggtactgtcgtggacgctgaagagtacgaacgaacgccggtagggtcctacgagtgacggttctccgtgacgtacggttcttcgttacgttaaccttaccgttactaacgttacgttggttactacggttacgggttgggtcgacgacgtacccggtcccgagggacgtaagggtccttggaggtggtaggtgggtacgtggacttcggacgtacgtcttaacggtactacggtaaaccactaaataaaccgtacacggaacaccggaacctacggtacgagggacaaacgtccgaactacacggaccaacgacgaaccgtacaacgtaccgtaacgacggaaccgtccgaaccggtaacccgtaacgaccggtaacgggaccgtacggtaacgggaccgtaacggaccgtaacgtacgtaaccgtaacggaccggtaacccggttaccggtacgtttaaccgttagttacggtacggtaccgtaagggtacggggtaacgttaacgggttaacggttaaacgtttacgggtttacggttaaccggttttccggtaacccgtttttaccggaaacgggtttaccggtaccggggttaacccgggtaaccggggtaaaccccgggtttacccggtacccgggg

SEQ ID NO: 197400 - DNA, 723 bp, Homo sapiens
  misc_feature: GYAE6OF01CQZZC.39.81.H04.1.454.CMB.1.raw
  modified_base (258)..(258): a, c, t, g, unknown or other
  misc_feature (258)..(258): n is a, c, g, or t
  modified_base (364)..(364): a, c, t, g, unknown or other
  misc_feature (364)..(364): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtgggcctcagtgaagtctcctgacaggtcttctgttaccactttaccaatntggtatcgtagtggtgcgacgacggcccgtaggacgaaggtcttggaggtggagtgggatggagtcacgacgtacttaacaagttcggtacaacgaactaaacgtntacgacacgaacgtaacccgtccggaagggtacaacggtacgtaaccaccgtaagtacgaacccgaaacgaacgacctaacgaccgtaccgaaccgggaaccgaccgaaacccggtcctaaacgacgttacggaccgtaagggaacggaccgtccgtaggaacgacttacgtacggaaccgacggtacccgggtcgttagttactttaccggtagttacccggtaaggaagggtaacgttacggggttaacgggttaaagttttaaggtttccgtaacgggtttcccgttaacccgttttcggtttacgtaccggttaacgggtcccgggtaacccggtacgggttaacccgttccggg

SEQ ID NO: 197401 - DNA, 807 bp, Homo sapiens
  misc_feature: GYAE6OF01ECK98.39.81.H04.1.454.CMB.1.raw
  modified_base (192)..(192): a, c, t, g, unknown or other
  misc_feature (192)..(192): n is a, c, g, or t
  modified_base (262)..(262): a, c, t, g, unknown or other
  misc_feature (262)..(262): n is a, c, g, or t
tcagtcgcactagtcacgaccggtgctcgatttagtagtgtagattcgcggggacccaaaaccacacccctccttgggagaatcccctagatcacagctcctcaccatggactggacctggagcatccttttctggtgcagcaacaacaggtgcccactcccaggttcagctggtacagtctggagctgagntgacgagtccgtgggcctgagtagaggtctccgtgacgaggtcttcgtacgttaccacctttacaacttntggtatcgaggttggcgtcgacaccggtcccgtaggacgacggtcttaggagtcggtagtcggagtggacttcgacgtcgtaccttaagtacgtcggtactaacgaacaaacttagaccgtacaacgaacggtaaccccgtacgaacgggtacgaacgtaccgtaacctacccgaacgttaccgaaccgaaaccgacggaacccaacctaaccctaaccccggaagaccggacccggtaacccggtaaccgtaacccgtacggttacccgggttaccgtacgggttaaccgggacgttaacccggtaggtaacgtaccggtaaccggtccggaacccgtaacgggtaacccgggttaccggtttaagtttaccggtttaacgcggttacgggtaacgtaaccgggagggtttaacccgggtaaacggggtttaacgtttaccggttttacggttaccggtttaacccggttaccccgtttaggtttacccggtacggttacccggtaccggggtaccggtaaacccgggttcccgttaacccggg

SEQ ID NO: 197402 - DNA, 742 bp, Homo sapiens
  misc_feature: GYAE6OF01D8EQX.39.81.H04.1.454.CMB.1.raw
  modified_base (215)..(215): a, c, t, g, unknown or other
  misc_feature (215)..(215): n is a, c, g, or t
  modified_base (273)..(273): a, c, t, g, unknown or other
  misc_feature (273)..(273): n is a, c, g, or t
  modified_base (297)..(297): a, c, t, g, unknown or other
  misc_feature (297)..(297): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtcgcccactcccaggttcagctggtacagttctggagctgagatgacgagccgtgggcctnagtgaacggttctaccgtgacaaggtccttcgtggtttaccaccttttaccaaacttntggtatctaggttgggtgacgacncggcccgtagacgaaggtcgttgaggttggagtagggtagtggtatcgaggtccgtaccttaagaacgttcggtaaccaacgtaaacctaaacgtacacggaccaacacgtaaccctacccggagggcctaaaggacttaccaaccgtataccgaacccgaacgaacgaccaacaacgtacccaacggaccacccggtaaccgacctaaacgtacgtaccgggtaacctggaaacgggtccgtacgtacggacgtaactccgtacgaaccgtaccggtaaccggttccttaaggttacgttttacgcgggttcgggacgaacggggtaagttaaggtaacgggtttaaagtttcgtttaggtacggtttcccgttaacccgtttgttaaccggtaccggttaacgggttcccggggaacccgtacccggggttaccgtacccggg

SEQ ID NO: 197403 - DNA, 624 bp, Homo sapiens
  misc_feature: GYAE6OF01BH8J0.39.81.H04.1.454.CMB.1.raw
  modified_base (461)..(461): a, c, t, g, unknown or other
  misc_feature (461)..(461): n is a, c, g, or t
  modified_base (504)..(504): a, c, t, g, unknown or other
  misc_feature (504)..(504): n is a, c, g, or t
  modified_base (511)..(511): a, c, t, g, unknown or other
  misc_feature (511)..(511): n is a, c, g, or t
  modified_base (539)..(539): a, c, t, g, unknown or other
  misc_feature (539)..(539): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactccaggttcagctggtacagtctgggacgctagagatgaccgaagccgtgggcctcgagtgaagtctctgcacggcttctcggttacctacctttaccacgtatggtactcgtaggttcggtgaccggacgacggtaccccgtaggaaccgtaacggggtctggagtaggagtagggtagtggatcgacggacgtctaacgtagttacggtaccaaacaacgtaaactatcggacgaacctaacggaaccccttccggagggacctagaacgtcgacctacgacgacaacagaccactancccgacgacgaccgacgacctacaagcggactggaggacgtanggactanacgtagcgacggacgtcgttgtacgttnacggtcagacgtagttcgaaaggttacttgttacgacgttcggttaccctgttacgtcgtacggaccgacgaccgggtactccgg

SEQ ID NO: 197404 - DNA, 993 bp, Homo sapiens
  misc_feature: GYAE6OF01AQND5.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctgggagcacgttccttttcgttggtggcagaccaaacaacgtagggtcgacccctacgtaccccgtaggttacaggtcgtggtaaccaggttccgtaggacgtctaggaagtacgtacggaacggaaccggccggttacggggtaccttacgaggtaggtaacggttcctacgtggacgtaacgggtctttacgttaccggttaacctaccgtttaaccaagttacgttaggtactacggttaggtttacgggtacgaccggtaacgaccggtacccgtaggaaccgtaaggggtccttagggtacggtacggtaagggtggggtaacgttacgggtacgtacggttaaacgggtccgttaaccgtttaaacggtaacgggttaccgggttaaacctaaacccggtaaaaacctttaacgtaacggttacgaaaacccggttaacgtaaaacccgtaaaccccggtaaccgggtaacgggacggaaacgggtaaccacccgtaacgtacggtaaaaccgtaacccgaaacgtacgtaaacccgtaacccgtacgtaacccggaaacgtaacccgggaaccgaacccggtaaccgttaacgacggtaccggaacgttacgggaacggtacgaccgttacggaacgtacgttacaacggtaccggaaccgttacgggtaaccggtttacggttaaaccgttacgttaccgggtacggtaaccgggtaacgggtaaggtaaacggggttaaacggtttaaccggtttaacggtttaacggttacgggttacccgttaaacccggtttcggttaaccgtttaccggggtacccggttaaggggtaaccccgttaaaccgggtacccgggttaacccgg

SEQ ID NO: 197405 - DNA, 838 bp, Homo sapiens
  misc_feature: GYAE6OF01D9SNU.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtcgcccactcccaggttcagctgtacagtctggagctgagatgacgagccgtggggcctcgagtgaaggtctcctgacgaggtcttcgttcggttacctaccctttaccaacgttagttaggtatcgtaggtttgggtcgacgacgacggccccgtaggacgaagggtcttggaggtgggtacgtaggggtagtaggtacgttcgacggaccgttcttaacgtaagttacggtacccaaccgtaaacctaaacttcgtacgacctaacgtaaccgtaacccgtacccggaacgggcaacggtacgtacccaaccgtacgtaccgaaacccaacgaaccgaacctaacgtaaccgtacccgaacggtaacgcccggtaacccggtaccctaagtaacgggtacccggtacccgtagggtaaccgggaccgtaccgtacggaacgttaccgttaccgggaaccggtaacccggaacccgggtacccgggtaaccgggtttatttaaccggttcggtacggttacgggaccgggaaacggttaacgggttaacggggttaaacgggttaaaacgttttttcggtttaacggtacccggtttaacccgtttacccgtttcgttaaccgggttacccgttacggggtacccggggtaacccggttaaccgggtaccccgttacccggg

SEQ ID NO: 197406 - DNA, 802 bp, Homo sapiens
  misc_feature: GYAE6OF01DD8T1.39.81.H04.1.454.CMB.1.raw
  modified_base (368)..(368): a, c, t, g, unknown or other
  misc_feature (368)..(368): n is a, c, g, or t
  modified_base (655)..(655): a, c, t, g, unknown or other
  misc_feature (655)..(655): n is a, c, g, or t
tcagtcgcactagtcacgaccggtgctcgatttagtagtgtagattcgcgggacccaaaaccacacccctccttgggagaatcccctagatcacagctcctcaccatggactggacctggagcattccttttcttggtggcagcaacaacaggtcgcccactcccaggttcagctggtacagtctggagcgtgaagactagacggaacgtccgtacggggcctcgaaggtaggtaacggtcctaccgttggacgtaaacggtcctttacggtacggttaaccttaaccctttaacaacgttagtacggttatacgtaggtttgggacacgacgaccggtcccgtaggaaccgaacgggtctaggtagnggtagtaggtacgtagagtacgagtactacggtaactaggtcgtacaacaacgtaactacgagaacctaacgacgtaacccgtacggaggtaacgacggtaacgtaaccaacgtacgaaccggaacccaaaggaacctaaacgacgtaccaacccgaacggacgtaccggacggtaccctaagttacggaccgtaccggagacgggaccgtacgtaacggtaacgtaacgttacggacgggtaaaacctcccgggtaacccggttaccggtttaagttaaccgggtntttaacgggacggaaccgggtaaagtacgggtaaacggttaaacgggtaaacttttcgggtttaaaccggcggtttacccgggtttaacctacgggttaacgtaaccgggaccggtacgggaacccggtaccgggtaccctaccggg

SEQ ID NO: 197407 - DNA, 841 bp, Homo sapiens
  misc_feature: GYAE6OF01BK7CN.39.81.H04.1.454.CMB.1.raw
tcagtcgcactagtcacgaccggtgctcgatttagtagtgtagattcgcggggacccaaaaaaccacacccctccttgggagaatcccctagatcacagctcctcaccatggactggacctggagcattcctttttcttggtggcagcaaacaacaggtcgcccactcccaggttcagtcgtggtactagtcgtggagtcgtgagatgaacggaacgtccggtggggtaccctcgtaggtagaacggttcctccgtgacgtaacggttctttaccgttacggtttacctacctttaaccaacgttagtaggtacttacggtaggttcgggcgacggaccggaccggtcccggtaaggtaaccggtaagggtcgtttaggaacggttgggacgggtagggtagtcggtactcggacggtccgtactttaaacgacgttcggtaaccaaacgtaaccgaaaagttccgacgtaaccaacgtaaaccgtaaccccgcggaacgggtacgtaacggacgttaccccgaagtaaccgttaccggaaacccaacgtaccaaccgaaccgtaacctaacccgaaccggaccgaccgtacccggtacccttaacgacggttaccggacgtacgggaacggccgtacgaggaacgttacgcgtacggtaacgaaccggtacggttacgtacgtttacttacggtacggtaccggtaaggacggttacggtaaacgggttaaacgggttaagtttacgttttaacccggccggttttaccggttacccgttacgtttaagggtacccggtacggttaaccggggacccggttacgggtaacccggttcccg

SEQ ID NO: 197408 - DNA, 771 bp, Homo sapiens
  misc_feature: GYAE6OF01DZFTF.39.81.H04.1.454.CMB.1.raw
  modified_base (400)..(400): a, c, t, g, unknown or other
  misc_feature (400)..(400): n is a, c, g, or t
  modified_base (517)..(517): a, c, t, g, unknown or other
  misc_feature (517)..(517): n is a, c, g, or t
  modified_base (581)..(581): a, c, t, g, unknown or other
  misc_feature (581)..(581): n is a, c, g, or t
tcagtcgcactagtcacgaccggtgctcgatttagtagtgtagattcgcggggacccaaaaaccacacccctccttgggagaatccctagatcacagctcctcaccactggactggacctggagctacttccttttcttggtggcagccaaacgaacgaggtcgcccactcccgaggttcacgctaggtacacgtctggacgctgacgagtcgaacgaacgccgtggggcctacgaggtagaacggtcctccgtacgacgtaacggtctttcgtcggttaacctaaccttttaaccaacgttagtaggtactacgtaggtttcgggtcgtaacgaccgtaccgtcccgtagggaacgtaaggtctaggacggtaggtaacggtgggagtaggactacggngacgtacttacaagtcgaacctaacgaaacgtaacgttacgcgaactaacgaaccgtaacctaccggagggaccaaggacgtacaccgtagtaccgaacaacgtaacacaactaccncgaacgcgaacgtaccgctaaactgaccgaaccgtgaacggtcgtacgaggtaactaacccggngaacgggaacaaccggacccgggttattacggttattaccggttggtacgacggttaaacgaacgggtaaaggttaccgggttaaaagttttacggttaccgtaacgtttacccgggtaaccctttttggaacggtacccggttaaaccggggtcccgggtaaacccgtaacgggttccccgtacccggg

SEQ ID NO: 197409 - DNA, 677 bp, Homo sapiens
  misc_feature: GYAE6OF01ECXH8.39.81.H04.1.454.CMB.1.raw
  modified_base (363)..(363): a, c, t, g, unknown or other
  misc_feature (363)..(363): n is a, c, g, or t
  modified_base (375)..(375): a, c, t, g, unknown or other
  misc_feature (375)..(375): n is a, c, g, or t
  modified_base (434)..(434): a, c, t, g, unknown or other
  misc_feature (434)..(434): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcattcctttttcttggtggcagcaaacaacgaggtcgcccactcccaggttcagtctggtacagtctggagctagagactgacgacgccgtggggcctgagtaggaacggtcctccgtgacgtaggtcttcgtacgttacctaccttaacaagttagtgtactgtaggttggacgacgacgacggcccgtaggaacgtaggcttagaggtagagtaggtagtggatcgacgctactanagtgacaacaanaactgacacgaacaccgaacctcggaaggacaacggataccaagtacgtcgaacccaanacgtaaccactaacaccgaacggacaccggtaccgactaactaggacccgagtaggacgacgtctacggatcgtacgaagaccggacgtaccggttacgttaagttacgttcgtagggacgtaagacggtagttaacgggtaaggtttaaagtttccgtttaacgggacctttaccggttaccggtttataaccgggttcgacccggggttacggaccggtaacccgggtcccgttaacccgg

SEQ ID NO: 197410 - DNA, 822 bp, Homo sapiens
  misc_feature: GYAE6OF01DGL3K.39.81.H04.1.454.CMB.1.raw
  modified_base (107)..(107): a, c, t, g, unknown or other
  misc_feature (107)..(107): n is a, c, g, or t
  modified_base (573)..(573): a, c, t, g, unknown or other
  misc_feature (573)..(573): n is a, c, g, or t
  modified_base (662)..(662): a, c, t, g, unknown or other
  misc_feature (662)..(662): n is a, c, g, or t
tcagtcgcactagtcacgaccggtgctcgatttagtagtgtagattcgcggggacccaaaaaccacacccctcttgggagaatcccctagatcacagctcctcacanggactggacctggagcattccttttcgtgggtcgcagcaaaccaacgaggtcgaccccactacccctagggttccaaggccttagggtactgttcgcggagcgtgacgatcggaccgacggtccgtcggggccctatacggtacggaacggtcctccgaggtaccgaaggtcctttaccgtacggttaaccttacccttttaaacgaccttaggttacggtactcgtaggtttcggggaatccggaaccgtaccgcccgtagggaacggtaacggtcgtggggtagtaggggtagtaggtacggttacggacctaggaccgggtccttaagtaacggtaagggttacccacgaaaaccttaaacggaaccttaaggccgaacccaaaggttaaacccgaccgttacgggacgggaacttaccggtaacgaacccgtaccaacggaacccaaaccggcgtttaaaanacccccggaatttacccggaaccgaaccggacgacccgacggtttaaacccaagtacccgagggtaactacgggaaggaaccgtttacncggtaaaccgtgtcccgaagacccgtacgtaccgggtcgttacggttaactaccggtaggtcgaaggtaacggaggtttaccggaaagtttacgtacgtttacggacgttaccgttcctaggttaccttacggcggtacggacgttccgggtcctaccgg

SEQ ID NO: 197411 - DNA, 809 bp, Homo sapiens
  misc_feature: GYAE6OF01BFZZX.39.81.H04.1.454.CMB.1.raw
tcagtcgcactagtcacgaccggtgctcgatttagtagtgtagattcgcggggacccaaaaaccacacccctcttgggagaatccctagatcacagctcctcaccatggactgggacctgggagctagttccttttcgttggtcgggcagacaaacgaacagggtcacccacctcccgaggttcagctaggtacagttcgtgggagctagagtagtagacgaacgccggtgggcctacgaggtacggaacggttcctacgtcgacgacgtcgttacgtacgttacctaacccgttacacgttggtagttactacgtaggtcggtacgaccgtacggacggtcccgaggtaacgtagggtcgtaggacggttggaacgtgggtaattcgggtacgtacggtaccggacgtttaaccgtaacgtacggttacgtaaccggaaacctaaactaaaaccgttcggaacgtaacccgaacgtaaccgggttaaacccacggaccgggtttacgaaacggtaccgaacctaaacgtaacgtccgaaacctaaacggaacgtaaccctaaccgaacgtaacccggaacgaccgtacggtacccgtaacgtacgtaccggttaacggacggtcggtaacgaaccgtacgtacgtacgtacgtacggtacgacggacgtacggtacgtactcgttagcgtacggtagacggtacggtagttacggtaacgttaggttacgggtaccttggttaacccgttggtaccgtttaacgggtacgggtaaccggtaccggttaaccggtaccgggttaacccg

SEQ ID NO: 197412 - DNA, 1037 bp, Homo sapiens
  misc_feature: GYAE6OF01CBF3F.39.81.H04.1.454.CMB.1.raw
tcagtcgcactagtcacgaccggtgctcgatttagtagtgtagattcgcggggaacccaaaaaccacacccctccgttgggagaactcccctagatcacagctcctcaccatggacgtcggaccgtggagctactttccgtttttcgtttgggtcggcgagacaaaccaacgtacggtccgcccacctacccgacggttcgacgtcgtacggtacgtacgtcgtggagtcgtaggagtagtaggaacggacggccggtaaaaaaaaaaacgggccgtacgtaggtacggtacggtccgtccgtcgtacgtacggttcgttccgttacgttaccttaaccttaacctaacgttagttagttacgttacgttaggttcgggtcggaccggaaccgtaccggtacccggttacggaacggtaacggtacggttacggtacgggtagggtagggtagggtaggtacggtacggtacggtacggtccggtacgtttaacgtaacggttaccggtaacgtaaccgtaaaccgtaaacgtaacgtacgtaaccgaaccggaaccgtaaccccggtaaccggtaacgggtaccggtaacggtaaccgtaaccgtaaccgtaaccgtaaccgaaccgtaaccgaaccggaacctaaaccgtaccgacccggaaaccggaaccggtttcccgaaaccccgggttaaccttaacgggggaacccgttacgggaaccccgggttagggggaaacccgtttccgggtaaacgtcgggttaaacggtacccgtaacgggttaaaccgacccgggtaaacgggttccccgggtttaaggtcccgttttaacgttaccgggggtggaaccggtaacggggtaaacggtaccggggttaaacccggtttaaagggttaaacccgggtttttaatttccccggggtttaacggttcccccgtttttaaggttaaccgtttaacccgggggtaacccgggttacggggtaacccggggttaaccgttccccggggttaaccggtttaacccccggg

SEQ ID NO: 197413 - DNA, 759 bp, Homo sapiens
  misc_feature: GYAE6OF01B2I1E.39.81.H04.1.454.CMB.1.raw
  modified_base (639)..(639): a, c, t, g, unknown or other
  misc_feature (639)..(639): n is a, c, g, or t
tcagtcgcactagtcacgaccggtgctcgatttagtagtgtagattcgcggggacccaaaaaccacaccccgtccttgggagaatcccctagatcacagctcctcaccatggactggacctggagcatccttttcttggtggcagcaacaacgaggtgcccactcccaggttcagctggtacagtctggagctgagatgacgagccgtggggcctcagtgaggtcctcgtgcgagtccttcgtacggttacctaccctttaacctaactagtcgttatcgtaggtttcgggtacgaccgtacgaccggcccgtaggaacgacgggtcgttcggaaggtgggagtggggtagtagggactaccggacggtcccggttacttaacgtaagttcgggtaccaacgtaaacctaaaacttgacgtacgaaccgtaaaccgtaaccccgtccggaagggaccgtaacggtaccgtaccgaaaccgtacgtaccgaacccaacgacgaacctaaccctaccgaacccgagacccggtaccgacccgtaacccttacgaacgttccgggaccgttaggaacgggtctaccgagtaacgtcttacggacggaaccggtaccgacgggtctttaggttaactttcggngacggagtaaggcgttaacgggtaaggttaacgttttggtaccggtacgttccgggtttacccttagttacggtaaccggtttacgggaccggtaacccgggtacggtaccccgttacgg

SEQ ID NO: 197414 - DNA, 812 bp, Homo sapiens
  misc_feature: GYAE6OF01BOUK0.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcattcccttttcttggtggcagcaacaacaggtcgcccacctcccaggttcagtcctggtacagtctggagctgagtataggaaccgaacgccgtcggggccctcgagtcgaacggtcctcgtgacgtaacgtccttacgttacggttacctaaccttttaccaacgttagtacggtacttcgtaggttagggtacgaccgtacggacccgggtaccccgtagggaaccgtaacggggtcgttacggtaggtggtaggtaggggacgttaggtaccgtacgacggtaccgtacgttaacgtaaggttacggtacaaaccctaacgtaaaacgttctacgaaccgtaaccgaaccggtaaccctacggaacgggactaacggacccgtacaaccgtacgtaccggaacccaacgaaccgtaccaccgtaacctaccgtaaccggacgtaccggtaccccggtaacctaaccggacgtaccgggaccgtacggtacggaccgtacgtaacgacgtaactccggtacggaaccgacccggtacggtacccgttagttaccgttacggtacggtacggacggtaacggtacggtacggttaacggggttaacttacggtttaccgtacggtttaccgtaccgttacgttacggtacgtcgggtaccggtacggtacccgggtacgtacccgg

SEQ ID NO: 197415 - DNA, 727 bp, Homo sapiens
  misc_feature: GYAE6OF01DRS13.39.81.H04.1.454.CMB.1.raw
  modified_base (125)..(125): a, c, t, g, unknown or other
  misc_feature (125)..(125): n is a, c, g, or t
tcagtcgcactagtcacgaccggtgctcgatttagtagtgtagattcgcggggacccaaaaaaccacacccctccttgggagaatcccctagatcacagctcctcaccatggactggacctggancattccttttctggtggcagcaacaacaggtcgcccactcccaggttcagctggtacagtctggagctgagatgacgaagccgtggggcctcaggtgaaggtctcctgcagtcttcgtgttacctaccttacaactagtgtatcgtaggttggtgacgaccgcggcccgtaggacgagggtcttggaggtgggagtagggactggatcgaggtcgtacttaacagtcggtaacaaccaaactaacgtatcgacgaacctaacggaaccctacggagggacaacggaacctacaacctagccgaaaccacgtaacgaacctaacctacgaccccaacggacgtaacccgaacccggtacctaaagtacggtacccgggaacgtaacggacgggtacctacggtaacgagtacgttacgacgaaaccggtaccggtaccggtacgttaggttaacttacgggtcgtacgtaacgggaaggtttacggaacgggttaacgggttaatttacgtttacggtaccggttttaccgtaaccctttcgggttaacggtaccggttaccgggggacgggtaacccggtaccgggtttaccccggtacggg

SEQ ID NO: 197416 - DNA, 804 bp, Homo sapiens
  misc_feature: GYAE6OF01A2YGP.39.81.H04.1.454.CMB.1.raw
  modified_base (597)..(597): a, c, t, g, unknown or other
  misc_feature (597)..(597): n is a, c, g, or t
tcagtcgcactagtcacgaccggtgctcgatttagtagtgtagattcgcggggacccgaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaacgtctcgtgcaacggtcttctcggttacctacctttaaccaacgtatggttactcgtaggttgggtcgtcggacgacggtccccgtaggaccgaagggtccttaggacggttggtaggtacggggacgttgggtactccggaggccgttaccgttaacgaaacgttccggtacctaaaccgtaaactaaaaccgttacgtcgaacccaaccgtaaacggtaacccctaccggaacgggtaccgtaagggacgtaacccaaccgtacgtaccgaaacctacgaaccgaccgtaaccacgtacccgaaacgggtccgacccggtaacgtacccgtacgaacgtaccggaacccgtaggaaccggtacgtcccgtanaccggtacttaccgaacgacccggaaggtacccgggtcgtttaaggttaacttccggtaggtacggacgggtaaggttacgggaaaccgggttacgggtttaaaagtttcggtttaaccggttacggtcccgtttaacccgtttgttaccggtaaccgtacccggggtaccgggttacccggtaacccggggttaaccggttcccgg

SEQ ID NO: 197417 - DNA, 888 bp, Homo sapiens
  misc_feature: GYAE6OF01DN2ST.39.81.H04.1.454.CMB.1.raw
tcagtcgcactagtcacgaccggtgctcgatttagtagtgtagattcgcggggcacccaaaaaaccacacccctccttgggagaatcccctagatcacagctcctcaccatggactggacctggagccattccttttcttggtggcagacaacaacaggtcgcccacctcccgtaggttaccagtccgtaggtaacagttcgtcgggacgtactggaacgtcgtagggaaccggaacggccggtcgggggcccttcgaggtaggaacggttcctccgtagacgaacggttcttaccgttacggtttaaccctaaccgtttacctaacgttaacgttcggttattaccggtaagggtttcgggtcgaccggaacccgtaccgggcccgttaagggaccggtaaggtccgttggggtaaggtagggtaggtacggggtagtacggtaacgtacggtaccggtacttaaccgtttaacgacggtttacgaaacccgaaacttaaccgtaaaactcgtacgaacccgaaacgtaacccgtaacccgaccggacggacgtaaccgaacgtacccgaactagaaccaaccgtaccgaacacaaccgaccgtaaccgaccggacgacccggaccggtaacccgtacgtaacggtaccggtaacggtacgggaaccggacggtaccgtagtaacgtcccaacggttccgaacccgaccgtacccggggttacctttacggttaaccgttaggtaccggtaacggtaccgtaaggggtaccggtaaggttaaaccgggtttaagttttacggttacggtacccggttaccggtttaccctttacggttaaccgttacggtaaccgggaccgggttaacccggtaccgggttacccgg

SEQ ID NO: 197418 - DNA, 935 bp, Homo sapiens
  misc_feature: GYAE6OF01BM48F.39.81.H04.1.454.CMB.1.raw
  modified_base (277)..(277): a, c, t, g, unknown or other
  misc_feature (277)..(277): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctgggcctcagtgaaggtctcctgacaaggcttctggttacctacctttaccaactatggtatcgagttgggngcgacacggccctggacaaggtcttggagtggatgggatggactcgagaccggtacttaacgagttcggtaccaaacaaaccgtaaaactacgtacgtaaccgaacgtaaaccggtaaaccccgttaacccggaaacgggggaccgtaaacgtaacgggttaacccaaaaccccgtaacgttaaccggaaacccccgaaacgtaaaccggaaacccaaacccgtaaacccgttaaccccggaaaccgggtaaaccggtaaccccggaaaccccgggttaaacccccgttaaacggtaaacggtttaacccggggtaaaaccccgtttaacggggaaaccggggtaacccggtacccggtttaagggaaaccgttaaccgttaacccgggttaacggaaacccggtaacccgggtaacccgggttaaccccggtttaaggttaaaccgtttaaccgttcgggtaacgtaaccgggaaacggtaaacggtaaacgggttaaacccggggttaaaagttttaaccgtttttacgggaaacccggtttaccgggtttaacccccgttttaacggtttttaaccgggtaaaccggtttaaccccggggttaacgggggtaaccccgggttaaacccggggtaaacccccgggtttaacccggg

SEQ ID NO: 197419 - DNA, 901 bp, Homo sapiens
  misc_feature: GYAE6OF01A4GSL.39.81.H04.1.454.CMB.1.raw
tcagtcgcactagtcacgaccggtgctcgatttagtagtgtagattcgcggggacccaaaaaaccacaccccgtccttgggagaatcccctagatcacagctcctcaccatggactggacctggagcatcctttctggtggcagcaacaacaggtcgcccactcccaggttcacgccggtacagtcgtggacgctggacgatggacgaacgccgtcggggcctcgaggtcgaacggtcctcgtgaccgtaggtccttcgttacggttacctaccctttaccaacgttacgtaggtacgtccgtaggtttcgggtacgaccggaccgaccggtccccgtagggaaccgaacgggtccttagggacggtacgggtaacgtggggaagttcggtaactaccggacggtaccggtactttaacgtaacgtcggtaacaaccgtaaactaaaccgttacgtaccgaaccgaaccgtaaccgtaacccgtacggacgggacgtaacggtacgtaccgaaccgtacgtaccgaaccaacgtacaacctaccgactacccgaaacggcgtaccccgtaacccgggtacctaaccgtggtaaccggtaaccgttagggaacggtaccgtcccgtaggacgtaaccgttaccggtacggaacccggtaacccggtaccgggttaccgttagtttaaccgttacgggtacgtaacgggtaaccggtaagggttaacccggttaaagggggttaaacccggtttaaattttaaccgggttttaacccggtaacccggttttacccggttaaccccgtttttagggtttaaccgaaaccccggggttttacggggaccccgggggttaacccggtaaacccggggtttaaccccgttcggttaaaccccccggg

SEQ ID NO: 197420 - DNA, 848 bp, Homo sapiens
  misc_feature: GYAE6OF01BR02N.39.81.H04.1.454.CMB.1.raw
  modified_base (361)..(361): a, c, t, g, unknown or other
  misc_feature (361)..(361): n is a, c, g, or t
  modified_base (439)..(439): a, c, t, g, unknown or other
  misc_feature (439)..(439): n is a, c, g, or t
  modified_base (512)..(512): a, c, t, g, unknown or other
  misc_feature (512)..(512): n is a, c, g, or t
tcagtcgcactagtcacgaccggtgctcgatttagtagtgtagattcgcggggcccctagatcacagctcctcaccatggactggacctggagcacttccttttctgggtggcagcaacaacgaggtcgcccactcccgaggttcagctgggtacagtcgtaggagctaggagatacgaacggaaggtcccggtaggggtcctagtaagggtacggaacggttccttccgtcgacgtaacgggttcctttacgttacggttaaccttaaccctttaacctaacgttaggtacggttacgtacggtagggttggtcgaccgacgtaccgggtccgaggaacggtaacggtcgtaggtagggnggtacgggtagggtagtaggtacgtcggaacggtcgtacgtttaacgagttacgtaacaaccgtaaactaacggttancgaaccgtagtaaccgtacccgacggaggacgaacgttacgacctaacgacgtacgaaccctagaacgtaacncgtacaccgaacgtacgaccgaccggtaacgtacgacgtacggacgacggtaacggacgaccggtacggaactacgttccgtacggaacccggacggttaccgggttacgttacggtacgtttacgggtacggtaggtaaccggtagggaaacggttacggggttaacgtttaaagtttacggttaacggtccggtttacccgtaacgttttaccggtaccggtaaccggttacggggtaccccggttaaccggtaccccgggttaccgttaccgggtaccccttaacccggttacccgtacccgttaccgtaccggttaccccgtaaacccgggg

SEQ ID NO: 197421 - DNA, 675 bp, Homo sapiens
  misc_feature: GYAE6OF01DIBKS.39.81.H04.1.454.CMB.1.raw
tcagtcgcactagtcacgaccggtgctcgatttagtagtgtagattcgcgggacccaaaaaccacacccctccttgggagaatcccctagatcaccagctcctcaccatggactggacctggagcatcctttctggtggcagcaacacaggtgcccactcccaggttcagctggtacattctggagctgagatgacgaagcctggggcctcagtgaaggtctcctgcaaggcttctggttaccaccttttaccaactatcggtatcaggttgggtgcgacgacggcccctggacgaagggcttagaggtggagtgggatgggattcgagcggtacttacaagttcgggtacacaactaaaactatcgacgaacacgtaaccctccgacgggactaaggacgtaccaccgatacgaaccacacgtacacactcccgaaccggagaccgaccggtccctaacgacgttcggaacccgtggaacggacgccgttaggaactacgtccgtaggaacccgacggtaccggtaccgttagttaccgttacgtggtcgaccggtaaggaaggtaacggttacggggttaaattacggtttttaggacccgtttcgggttaacccctttggttacgtaccgttacgggttaccggggaccctaccgggggtcccttaccgggg

SEQ ID NO: 197422 - DNA, 854 bp, Homo sapiens
  misc_feature: GYAE6OF01BTWV9.39.81.H04.1.454.CMB.1.raw
  modified_base (158)..(158): a, c, t, g, unknown or other
  misc_feature (158)..(158): n is a, c, g, or t
  modified_base (482)..(482): a, c, t, g, unknown or other
  misc_feature (482)..(482): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtcncccactcccaggttcagctggtacagtcgtggagctaggagagtcgaacggaacgccgtcggggtcctcgaggtaggtaacggtccttccgtaggacgtaacggttcctttaccggttaccgggtttaacccttaacccttttaaccaacgttagttacggttactacgttagggttggggtaccaccggaaccgtaccgggtccccgtaggaaccgtaacggggtccttaggtacgggtaggtacggtaggggtacgtaggtacgtcggacggtaccgttacgttaacgaacgttcggaacctaaacgtaaacctaagttacncgtaaccaccggaacgtaacccgacggacggtaacgaacgtacgtaccaacgtacgtaaccgaacgaactaccggaacaccgtaccgaaccgtaacggacgtaccccgtaacggtacccgtactaacggggtactaccgggaaggaacggccgtaacgtaagtccgtaacgtcccgggaaggtcccaaccgggttccggtagttaccggtttaatcgggtacgtaccggaagtacggtaaggttaaccgggttaaagggttaaagtttttccggtaacgggttaaccgtttacccggttaacccgtttgggttaaacccgttaccggggtaccgggtacgggtaacccggtacccgggttccccgttacggg

SEQ ID NO: 197423 - DNA, 844 bp, Homo sapiens
  misc_feature: GYAE6OF01CHQL6.39.81.H04.1.454.CMB.1.raw
  modified_base (152)..(152): a, c, t, g, unknown or other
  misc_feature (152)..(152): n is a, c, g, or t
  modified_base (424)..(424): a, c, t, g, unknown or other
  misc_feature (424)..(424): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttctggtggcagcaacaacnggtcgcccactcccgaggttcagcgtggtacagtctgggagctggagatggacgaacgccgtgggcctgagtaggacgtcctccgtgacgtagtcttacgtcgtaacctacctttaaccaacgttagtaggtactcggtaagggttcgggtcgacgaccggacggtcccgtaggacgtaagggtcgttaggaggtaggtaaggtacggtagtacggtacgtaccgacggtaccgttacgtaaacgtagtcggaacgtaacctaactaacgtntaccgaaccgtaactaaccggtaacccgtcggaacggtagacggactacgaaccgaacgtacgaacccaaggtaaccgacaaccgtacgtaacccgaacggtacgaacccgtacccggtaacctaacggtacggtaccggtacggtaacgggaaacggtacgtacccggtaaggtccgtaacgtaccggtaaccggaccgaacccgggtacccggtacgtttacggttaactttacgggtacggtacgggtaaccggtaaagggtaccggttaaacgggtaaaccgggtttaaacgtttacggttaaccggttaccggtttaacccggtttaacccgtttaccggttaaccggttaaccgggtaccgggttacccggggaaccccggttaaacccgggttaccccgggttaaccccgggg

SEQ ID NO: 197424 - DNA, 553 bp, Homo sapiens
  misc_feature: GYAE6OF02FX84N.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactatgcacagaacctcagggcagagtcaccatgaccacagacacatccacgagcaaacggcctaacatcggacctgaggacgcctgagatctagaccgacaccggccgtgtattacgtgtgcgagagtagtacggggaaattagtttagacgttcggttacccttcgtttacgaccgttacgtcgggggacccgtacggggtacccttacggg

SEQ ID NO: 197425 - DNA, 521 bp, Homo sapiens
  misc_feature: GYAE6OF02GVWZX.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactatgcacagaacctcagggcagagtcacatgaccacagacacatccacgagcacggcctacatcggacctgaggacgcctgagatctgacgacacggccgtgtattactgtgcgagagagtcgggaaatgtttagactggtacccttgttacgacttacgtgggcctagggaccctcggg

SEQ ID NO: 197426 - DNA, 584 bp, Homo sapiens
  misc_feature: GYAE6OF02IWNLW.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacaggcccctggacaagggcttgagtggatgggatgggatcagcgcttacaatggtcacacaaactatgcacagaacctccgagggcagagtcacatcgaccacagacacactacccgaacgagaccaccggacctaacgacgtacggaccctggaaggacgcctaggagacgtcgtaggaaccgacgaccggtccgtagtacttacgtggtcgacggaagacgagtaacggggtaattagtttcggaacttcggttaacccttgtttacgaccgttacggtggggaccctacggggtacccttcggg

SEQ ID NO: 197427 - DNA, 525 bp, Homo sapiens
  misc_feature: GYAE6OF02HI753.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctactgcaaggcttctggttacacctttaccaactatggtatcagttgggtgcgacaggcccctggacaagggcttgagtggatgggatggatcagcgcttacatggtcacacaaactatgcacagaacctcgagggcagagtcacatcgaccacagacacatccacgagcacggcctacatggacctggacggagccgtgagatctagaccgacacggccgtagtacttactgtgcgagagagtacgggtaattgtttgacttggtacccttgttgactacgtgggaccagggaccctcgg

SEQ ID NO: 197428 - DNA, 546 bp, Homo sapiens
  misc_feature: GYAE6OF02IZ66Y.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttggtgcgacaggcccctggacaagggcttgagtggatgggatggatcgagcgcttacaatggtcacacaaactatgcacagaacctcgagggcagacgtcaccatcgaccacagacacactccacgagcacggcctacatcggacctgaggagctgagatctgacgacaccggcgtgtattacgtgtgcgagagagtacgggtaaattagttttagacgttcggtaccctttcgtttacgtacgttacgtcgggggacctacggggtacccttcggg

SEQ ID NO: 197429 - DNA, 548 bp, Homo sapiens
  misc_feature: GYAE6OF02IPUJY.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcgagcgcttacaatggtcacacaaactatgcacagaacctccgagggcagagtcaccatcgaccacagacacactaccacgagcacggcctacatcggacctgaggagcctgagatctgacgacacggcgtgtacttactgtgcgagagagtacgggtaattagttttagacgttcggtacccttcgtttacgtaccgttacgtcggggtacccgtacgggtacccgtcggg

SEQ ID NO: 197430 - DNA, 521 bp, Homo sapiens
  misc_feature: GYAE6OF02JVHFQ.39.81.H04.1.454.CMB.1.raw
  modified_base (449)..(449): a, c, t, g, unknown or other
  misc_feature (449)..(449): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctctgcaaggcttctggttacacctttaccaactatggtatcagttggtgcgacaggcccctggacaagggcttgagtggatgggatggatcagcgctacaatggtcacacaaactatgcacagaacctcagggcagagtcaccatcgaccacagacacatccacgagcacggcctacatggacctgacggagcctagagatctgacgacacggccgtgtattacngtagcgagagagtcgggaaattagtttgactcggttaccctgttacgactacgtgggaccaggtaccctcgg

SEQ ID NO: 197431 - DNA, 528 bp, Homo sapiens
  misc_feature: GYAE6OF02GCIY4.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactatgcacagaacctccagggcagagtcaccatgaccacagacacatccacgagcacggcctacatcggacctgaggagcctgagatctgacgacacggccgtgtattactgtgcgagagagtacgggaaattagtttagacgttggtacccttgttcgacttacgtggggcctacgggaccctcggg

SEQ ID NO: 197432 - DNA, 585 bp, Homo sapiens
  misc_feature: GYAE6OF02HC8PU.39.81.H04.1.454.CMB.1.raw
  modified_base (378)..(378): a, c, t, g, unknown or other
  misc_feature (378)..(378): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtacacacaaatatgcacagaacctcgagggcagagtcacatgaccanagacacataccacgagccacggcctaacatcggacctggaaggacgcctagagtatcgtacgaccgacgaccgggtccgtagttaacttacgtggtggacgagaggtagtacggggtaaattagttttcggaaccgttacgggttaaccccttgtttacgaccgtttaccggtacgggggtaccctacggggtaacccgttccgggg

SEQ ID NO: 197433 - DNA, 553 bp, Homo sapiens
  misc_feature: GYAE6OF02H55AQ.39.81.H04.1.454.CMB.1.raw
  modified_base (431)..(431): a, c, t, g, unknown or other
  misc_feature (431)..(431): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttggtgcgacaggcccctggacaagggcttgagtggatgggatggatcagcgcttaacaagtggtacacaacaaactatgcacagaacctcaggcagagtcacatcgaccacagacacactccacgagccacgcctacagtcggacctggaggacgcctgagncgtgaaccgacgacggccgtagtagttactgtgcgagagagtacgggtaaattgttttacgacgttacggttacccttgtttacgaccgttacggtcggggacctaccggggacccttcggg

SEQ ID NO: 197434 - DNA, 653 bp, Homo sapiens
  misc_feature: GYAE6OF02IV1V8.39.81.H04.1.454.CMB.1.raw
  modified_base (387)..(387): a, c, t, g, unknown or other
  misc_feature (387)..(387): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacacggcccctggacaagggcttgagtggatgggatgggatcgagcgcttacaatggtacacaacaaactatgacaacagaacctcgagggcagacgtcacatcgaccanaagacacactcccacgacgcaccggacctaacgacgtcggaccctaggacggacgcccgtaggaacgtagtaccgtaggaacccgtaccgaccgggtcccgttaggtaacgtttaaccgtgggtacgacggaaggtaggtaacggttaacgggggtaaacttttaacggtttttacggaaccgtttccgggttaacccctttggttttaccggtaaccggtttaccggtacgggggtacccgtaacgggggtaacccccttcgggg

SEQ ID NO: 197435 - DNA, 528 bp, Homo sapiens
  misc_feature: GYAE6OF02FP2QS.39.81.H04.1.454.CMB.1.raw
tcagtcgcactagtcacgaccggtgctcgatttagtagtgtagattcgcgggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttggtgcgacaggcccctggacaagggcttgagtggatggggatggatcagcgcttacaatggtcacacaaactatgcacagaacctcagggcagagtcaccatgaccacagacacatccacgagcacggcctacatcggacctgaggagcctgagatctgacgacacggccgtgtattactgtgcgagagagtacggggaatagtttagacgttggtacccttgtttacgacttacgtggggtcccagggtaccctcggg

SEQ ID NO: 197436 - DNA, 573 bp, Homo sapiens
  misc_feature: GYAE6OF02GYR3C.39.81.H04.1.454.CMB.1.raw
  modified_base (343)..(343): a, c, t, g, unknown or other
  misc_feature (343)..(343): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactntgcacagaacctcagggcagagtcaccatcgaccacagacacatccacgagcacggcctacatcggacctgacggacgcctagagatcgtgaccgacgaccgggccgtagtacttacgtgtcgacggagagtaggtacggggtaaattagttttacggacgttacggttaccccttagttttacgaccgttaccgtacgggggtacccgtacggggtaccccttacgggg

SEQ ID NO: 197437 - DNA, 546 bp, Homo sapiens
  misc_feature: GYAE6OF02JBJCY.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactatgcacagaacctccagggcagagtcaccatcgaccacagacacatccacgagcacggcctacatggacctagaggacgccgtgagatctcgacgacacggccgtgtacttactgtgcgagagtagtacggggtaagtattttagacgttcggtacccttacgtttacgtacgtacgtggggaccgtacgggtacccgtacggg

SEQ ID NO: 197438 - DNA, 521 bp, Homo sapiens
  misc_feature: GYAE6OF02IXY2J.39.81.H04.1.454.CMB.1.raw
  modified_base (477)..(477): a, c, t, g, unknown or other
  misc_feature (477)..(477): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactatgcacagaacctcagggcagagtcaccatcgaccacagacacatccacgagcacggcctacatcggacctggaggacgcctgagatctgacgacgacggccgtgtattacgtgtgcgagagagtacgggaattntttgactggtacccttgttcgactacgtgggccagggacctcgg

SEQ ID NO: 197439 - DNA, 528 bp, Homo sapiens
  misc_feature: GYAE6OF02F05QC.39.81.H04.1.454.CMB.1.raw
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactatgcacagaacctccagggcagagtcaccatgaccacagacacatccacgacgcacggcctacatcggacctagacggagcctgagatcgtgacgacacggccgtgttatactgtgcgagagagtacgggaaattagtttagacgttggtaccctctttcggactacgtcgggccagggtacccg

SEQ ID NO: 197440 - DNA, 520 bp, Homo sapiens
  misc_feature: GYAE6OF02G1SYF.39.81.H04.1.454.CMB.1.raw
  modified_base (490)..(490): a, c, t, g, unknown or other
  misc_feature (490)..(490): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactatgcacagaacctccagggcagagtcacatgaccacagacacatccacgagcacggcctacatggacctgaggagcctgagatctgacgacacggccgtgtattactgtgcgagagagtacggggaattgtttagactggtacccttntttagactacgtggggccagggaccctcgg

SEQ ID NO: 197441 - DNA, 545 bp, Homo sapiens
  misc_feature: GYAE6OF02JCDEY.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttggtgcgacaggcccctggacaagggcttgagtggatgggatggatcagcgcttacaatggtcacacaactatgcacagaacctccgagggcagacgtcacatcgaccacagacacatccacgagcacgcctacatggacctgaggagcctagagatcgtgacgacgacggccgtagtacttacgtgtgacgagagagtacggggaaattgtttagacgttacggtacccttcgtttacgacgttaccgtggggaccgtacggggtacccttcggg

SEQ ID NO: 197442 - DNA, 535 bp, Homo sapiens
  misc_feature: GYAE6OF02I1HG3.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatggggatgggatcagcgcttacaatggtcacacaaactatgacacagaacctcagggcagagtcacatgaccacagacacactccacgagcacgcctaacatcggacctgaggacgcctagagatctagacgacacggcgtgtattactgtgacgagagagtacgggaattagtttcggactcggtacccgttctttacgacgtacgtgggacctacgggtaccctcgg

SEQ ID NO: 197443 - DNA, 541 bp, Homo sapiens
  misc_feature: GYAE6OF02F3QDS.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactatgcacagaacctccagggcagagtcaccatgaccacagacacatccacgagcacggcctaacatcggacctggacggagccgtgagatctgacgacgacggccgtgtattacgtgtcgcgagagagtacggggaattagtttagacgtacggttacccttgtttcgacgttacgtcggggacctagggtacccgtcgg

SEQ ID NO: 197444 - DNA, 542 bp, Homo sapiens
  misc_feature: GYAE6OF02IOT57.39.81.H04.1.454.CMB.1.raw
  modified_base (441)..(441): a, c, t, g, unknown or other
  misc_feature (441)..(441): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatggggatgggatcgagcgcttacaatggtcacacaaactatgcacaagacctccagggcagagtcaaccatacgaccaacgagaacacactccaacgagacaccggcctacatggacctgaggagcctgagatcngacgacgacggcctgtacttacgtgtgcgagagagtacgggaatagtttgacgtggtacccttgtttgaccgtacgtcggggaccgacgggtaaccctcgg

SEQ ID NO: 197445 - DNA, 555 bp, Homo sapiens
  misc_feature: GYAE6OF02JBFB4.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcgagcgcttacaatggtcacacaaactatgcacagaacctccagggcagagtcaccatgaccacagacacatccacgagcacggcctacatggacctgaggacgcctgagactctgaccgacgaccggccgtgtacttactggtcgcgagagagtacgggtaaattgttttagacgttcggttaccccttgttttacggaccttaccggtcgggggaccctacggggtaccccttcggg

SEQ ID NO: 197446 - DNA, 537 bp, Homo sapiens
  misc_feature: GYAE6OF02IAV8C.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacactttaccaactatggtatcagttgggtgcgacaggcccctggacaagggcttgagtggatgggatggatcgagcgcttacaatggtcacacaaactatgcacagaacctcagggcagagtcaacatgaccacagacacatccacgagcacggcctacatggactgagagctgagatctgacgacacgccgtgtattactgtgcgagagagtacggggtaatagtttagacgtcggttacccgtcgtttacgtacttacgttacggggaccgtacgggtacccgttaccggg

SEQ ID NO: 197447 - DNA, 550 bp, Homo sapiens
  misc_feature: GYAE6OF02GUS94.39.81.H04.1.454.CMB.1.raw
  modified_base (438)..(438): a, c, t, g, unknown or other
  misc_feature (438)..(438): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcgagcgcttacaatggtcacacaaactatgcacagaacctcagggcagagtcaccatagaccacacgacacactccacgacgacacggcctacagtcggacctgacggacgcctggagatcngacgacgacggccgtgtacttactgtgacgagagagtacggggtaaattcgtttagacgttacggttacccttgtttacgacttacggtacggggactacgggaccctcggg

SEQ ID NO: 197448 - DNA, 545 bp, Homo sapiens
  misc_feature: GYAE6OF02F31T6.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactatgcacagaacctccagggcagagtcacatgaccacagacacatccacgagcacggcctacatcggacctggacggagcctgagatcgtcgaacgacgacggccgtagtacttactgtcgcgagagagtacggggaaattagtttgacgttcggttacccttgtttacgacttacgtcggggaccctaggggaccccttcggg

SEQ ID NO: 197449 - DNA, 607 bp, Homo sapiens
  misc_feature: GYAE6OF02HE649.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacaccttttaccaactatggtatcagttgggtgcgacaggcccctggacaaggggcttggagtggagtggggatggatcagcgcttacatggtcacaacaaactatgcacacgaacctccgagggcagagtcaaccatcgaaccacagaccacactaccaacgacgaccgaaccggacctaacacgtacggacctaggaacgggacgccgtaggagactccgtaggaaccgaccgaccgggtccgttagttaactttacgtgtcggacgagagagtacggggtaaatttagtttacgtacgttcggttaccctttcgtttacgtaccgttacgtcgggggacccgtacggggtaacccgtcggg

SEQ ID NO: 197450 - DNA, 572 bp, Homo sapiens
  misc_feature: GYAE6OF02I5BAZ.39.81.H04.1.454.CMB.1.raw
  modified_base (412)..(412): a, c, t, g, unknown or other
  misc_feature (412)..(412): n is a, c, g, or t
  modified_base (435)..(435): a, c, t, g, unknown or other
  misc_feature (435)..(435): n is a, c, g, or t
tcagtcgcactagtcacgaccggtgctcgatttagtagtgtagattcgcggggcacccaaaaccaacaacccctccttcgggagaatccctagatcacagctcctcaccatggactggacctggagcatccttttcttggtggtcagcaacaacaggtgcccactcccaggttcagctggtacagtctggagctgagatgacgaagcctggggcctcagtgaaggtctcctgcaggcttctggttacacctttacaactatggtatctagttgggtgtcgactaggcccctggacaagggcttgacgtggatgggatggatgagcgctttacaactggtcacacaactatgcacacgacctccagggcagacgtcaccatgaccacacgacacactcacgagcacgcctacngtacgactagagcgctgacatcngacgacgacggccgtgtaacttcgtgtcgacgtagaggagttaaccgggggaaatttacgttttaggaaccgtttcggttaaccccgttgtttcggaaccttaccggtcgggggttaccgaaccggggtaaccccgg

SEQ ID NO: 197451 - DNA, 521 bp, Homo sapiens
  misc_feature: GYAE6OF02FZ48X.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggtgcagctggtgcagtccgggactgaggtgaagaagcctggggcctcagtgaaggtctcctgcaaggcttctggaatcaccctcaccgacgtctatatgcactggttgcgacaggccccctggacaagggcttgagtggatgggatggatcaacggtaacagtggtctcgacaaattatgcacagaagtttcagggcagggtcacatgaccagggacacgtccatcaatacagctacatggaactgagcaggctgagatctgacgacacggccgtgtattattgtgcgagacgatgagtctcttctacgtagtggttcgggattaagtaattggtcgtaccctggggtaacccg

SEQ ID NO: 197452 - DNA, 552 bp, Homo sapiens
  misc_feature: GYAE6OF02JCMCI.39.81.H04.1.454.CMB.1.raw
  modified_base (401)..(401): a, c, t, g, unknown or other
  misc_feature (401)..(401): n is a, c, g, or t
  modified_base (411)..(411): a, c, t, g, unknown or other
  misc_feature (411)..(411): n is a, c, g, or t
  modified_base (429)..(429): a, c, t, g, unknown or other
  misc_feature (429)..(429): n is a, c, g, or t
  modified_base (436)..(436): a, c, t, g, unknown or other
  misc_feature (436)..(436): n is a, c, g, or t
  modified_base (442)..(442): a, c, t, g, unknown or other
  misc_feature (442)..(442): n is a, c, g, or t
  modified_base (466)..(466): a, c, t, g, unknown or other
  misc_feature (466)..(466): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctctgcaaggcttctggtacacctttaccaactatggtatcagttggtgcgacaggcccctggacaagggcttggagtggatgggatggatcgagcgacttacgaatggtacacaacgaaactatgacaacagaacctcgaagggcagagtcaccatgaaccacagacacatcacgancacgcctacngtacggacctggacggancctaganaatcgngacgactacggctagttattacgngtgacgtagacgtaggtcgggtaaattgtttagacgtacggtacccttgtttacgactaccgtggggaccctagggtacccctggg

SEQ ID NO: 197453 - DNA, 547 bp, Homo sapiens
  misc_feature: GYAE6OF02GA23Z.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactatgcacagaacctccgagggcagagtcacatcgaccacagacacatccacgagcacggcctacatcggacctggaggacgccgtgagatcgtgacgacgacggccgtgtattactgtgcgagagagtacggggtaaattgtttagacgttcggttacccttcgtttacgtacgttacggtcggggaccgtacgggtaccctcggg

SEQ ID NO: 197454 - DNA, 517 bp, Homo sapiens
  misc_feature: GYAE6OF02G8G4G.39.81.H04.1.454.CMB.1.raw
  modified_base (459)..(459): a, c, t, g, unknown or other
  misc_feature (459)..(459): n is a, c, g, or t
tcagtcgcactagtcacgaccggtgctcgatttagtagtgtagattcgcggggcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactatgcacagaacctcagggcagagtcaccatgaccacagacacatccacgagcacggcctacatggacctgaggagcctgagatctgacgacacggccgtgtattactgtgcgagagagtacggggtaaattagtttgacttgtacctnttcgactacgtcgggccgtagggaccctggtccaccggtcctccgtcacgtcctaccg

SEQ ID NO: 197455 - DNA, 594 bp, Homo sapiens
  misc_feature: GYAE6OF02I181O.39.81.H04.1.454.CMB.1.raw
  modified_base (393)..(393): a, c, t, g, unknown or other
  misc_feature (393)..(393): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcgagtgaaggtctcctgcaaggcttcgtggttacacctttaccaactatggtatcgtaggttggtgcgacaggccccgtggacaagggcttgagtggatgggatggatcgagcgcttaacaagtggtacacaacaaactagtgacacaagaacctccgagggcagacgtcacatgaccanagacacactaccacgaacgcacggacctacgatcggacctggaaggacgctagagatacgtgaaccggtacaccggccgttagttacgttacgtggtgaccgagaggtacgtacgggtaaacttgtttaacgaggttaccggtacctttacgttacgtaaccgttacggttccggggacccgtaggggtaacccttacggg

SEQ ID NO: 197456 - DNA, 578 bp, Homo sapiens
  misc_feature: GYAE6OF02GKDIN.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacaccttttaccaactatggtatcagttgggtgcgacaggcccctggacaagggcttgagtggatgggatggatcagcgcttacaatggtcacacaaactatgcacacgaacctccgagggcagatcaccatcgaccacagacacactccacgagcacggcctacacgtcggacctggaaggacgcctaggatactcgtacgaccgaaccgaccggtccgttagtaacttacgtgcgacggagaggtaggtacgggtaaatttggtttacgacgttaccggttaccttgtttacgtacgttaccgggtcgggaccgtaccgggtaccgttaccgg

SEQ ID NO: 197457 - DNA, 563 bp, Homo sapiens
  misc_feature: GYAE6OF02IIZN6.39.81.H04.1.454.CMB.1.raw
tcagtcgcactagtcacgaccggtgctcgatttagtagtgtagattcgcgggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcgagcgcttacaatggtcacacaaactatgacacagaacctcaggcagagtcaccatgaccacagacacataccacgagacacggacctacatcgactgaggagcctgagatctgacgacgacggtccgtagtacgttacgtgtcggacgagagacgtacggggtaaattagttttacgacgttacggttacccttacgtttacgaccgttacgtcggggaccgtacggggtaacccgttaccggg

SEQ ID NO: 197458 - DNA, 612 bp, Homo sapiens
  misc_feature: GYAE6OF02I73CS.39.81.H04.1.454.CMB.1.raw
  modified_base (348)..(348): a, c, t, g, unknown or other
  misc_feature (348)..(348): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttggtgcgacaggcccctggacaagggcttggagtggatgggatggatcgagcgcttacaagtggtcacacaatatgacanagaacctcgaggcagactacacatacgaccacagacacactccaacgagaccgacggcctaacactcggacctggaacgggacgccgtaggacgatcgtagaccgaccgaccgggtccgttagttacgtttaacgtggtacggaccgtaggaaggtacggttacggggtaaatttgttttaacggacgtttaccgggttaccctttgttttacggtaccgtttaaccggtacgggggtcccttaaccgggggacccttacgggg

SEQ ID NO: 197459 - DNA, 545 bp, Homo sapiens
  misc_feature: GYAE6OF02GYDZQ.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactatgcacagaacctccagggcagagtcaccatgaccacagacacatccacgagcacggcctacatcggacctgaggagcctgagatctgacgacgaccggccgtgtattacgtgtgcgagagagtacggggtaaattagttttgacgttcggttacccttctttacggacttacgtcggggacccgtacggggtacccctcggg

SEQ ID NO: 197460 - DNA, 582 bp, Homo sapiens
  misc_feature: GYAE6OF02H425A.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttggagtggagtgggatggatcgagcgcttacagtggcacacaactatgacacagacctcgaggacagagtcacatacgacaacacgacacataccacgacgcgacggcctaacacgtcggaaccgtaggaaggacgccgtagaacgactacgacgaccgacgtccggtacgtacgttactgtacggcgacgagaggtacgggtaagttagttggttacgtacggtacccgtttacgttagttaccgtacgtcgggtaccggacgggtacccgtacggtacccgg

SEQ ID NO: 197461 - DNA, 543 bp, Homo sapiens
  misc_feature: GYAE6OF02FPXAG.39.81.H04.1.454.CMB.1.raw
  modified_base (431)..(431): a, c, t, g, unknown or other
  misc_feature (431)..(431): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacaccttttaccaactatggtatcagttgggtgcgacaggcccctggacaagggcttgagtggatgggatggatcagcgcttacaatggtcacacaaactatgcacagaacctcgagggcagagtcacatcgaccacagacacatccacgagcacgcctacatcggacctgaggagccgtgagatcgngaccgacgaccggccgttagtacttacgtggtgcgagagagtacgggtaattagtttgacgttcggttacccttgtttcgacgttacggtcggggccgtagggacccgtcgg

SEQ ID NO: 197462 - DNA, 542 bp, Homo sapiens
  misc_feature: GYAE6OF02I2ATY.39.81.H04.1.454.CMB.1.raw
  modified_base (393)..(393): a, c, t, g, unknown or other
  misc_feature (393)..(393): n is a, c, g, or t
  modified_base (417)..(417): a, c, t, g, unknown or other
  misc_feature (417)..(417): n is a, c, g, or t
tcagtcgcactagtcacgaccggtgctcgatttagtagtgtagattcgcggggcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactatgcacagaacctccagggcagactcaccatcgaccacagacacatccacgagcacgctacatagactgagagctgagatcngacgacacggccgtgtatacgtgngcgagagagtacgggaaattagtttcgtaactcggttaccctcgtttacgtacgttacggtcgggaccgtaacgggtaacccgttgggtacctaccggttcctcccgtcgaccgtccctaccccg

SEQ ID NO: 197463 - DNA, 562 bp, Homo sapiens
  misc_feature: GYAE6OF02JGF7I.39.81.H04.1.454.CMB.1.raw
  modified_base (343)..(343): a, c, t, g, unknown or other
  misc_feature (343)..(343): n is a, c, g, or t
  modified_base (430)..(430): a, c, t, g, unknown or other
  misc_feature (430)..(430): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactntgcacagaacctcgagggcagagtcaccatcgaccacagaccacactccacgacgcacggcctacatcggacctgacggagcctganatcctagacgaccacggccgttagtacttaacgtggtacgacggagagtagtacggggaaatttgttttacgacgttccggtacccttcgtttagaccgttaccgtggggaccctacggggaacccctcggg

SEQ ID NO: 197464 - DNA, 540 bp, Homo sapiens
  misc_feature: GYAE6OF02GNMYG.39.81.H04.1.454.CMB.1.raw
  modified_base (346)..(346): a, c, t, g, unknown or other
  misc_feature (346)..(346): n is a, c, g, or t
  modified_base (433)..(433): a, c, t, g, unknown or other
  misc_feature (433)..(433): n is a, c, g, or t
tcagtcgcactagtcacgaccggtgctcgatttagtagtgtagattcgcggggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactatgcacagaacctccagggcagagtcaccatgaccacagacacatccacgagcacggcctanatggacctgacggagcctgagatctgacgacacggccgtgtattactgtgcgagagagtacgggaaatagtttgactggtacccttntttcgtactacgtgggccgacgggtacccgtggtccaccgtctcctcacgcctaccaccgaacgggcccagtccggtccttccccgtcggcctacccgtcctacccg

SEQ ID NO: 197465 - DNA, 539 bp, Homo sapiens
  misc_feature: GYAE6OF02F5JK5.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactatgcacagaacctcagggcagagtcaccatgaccacagacacactccacgagcacggcctacatggacctgaggagcctgagatctgacgacgacggccgtgtattactgtgcgagagagtacggggtaaattagtttagacgttcggttacccttcgtttacgacttacggtggggaccctacgggacccttcggg

SEQ ID NO: 197466 - DNA, 542 bp, Homo sapiens
  misc_feature: GYAE6OF02HTF4M.39.81.H04.1.454.CMB.1.raw
  modified_base (342)..(342): a, c, t, g, unknown or other
  misc_feature (342)..(342): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttggtgcgacaggcccctggacaagggcttgagtggatgggatggatcagcgcttacaatggtcacacaaactntgcacagaacctccagggcagagtcaccatgacccacagacacatccacgagcacggcctacatcggacctggaggacgcctagagatcgtgaaccgacaccggccgtgtacttactgtgcgagagagtacgggaaattgttttgacgttaggttacccttgtttacgacgttacgtcggggcctacgggacccttcggg

SEQ ID NO: 197467 - DNA, 556 bp, Homo sapiens
  misc_feature: GYAE6OF02I92X3.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcgagcgcttacaatggtcacacaaactatgcacgagaacctcgagggcagagtcaaccatcgaccacagacacactccaagacgcacggctacatcggacctgacgagccgtagagatctagacgacgacggccgtgtattacgtgtcgacgagagagtacggggaaattacgtttagacgttacggtacccttcgtttacgaccgttaacgtcggggaccgtacggggacccttacggg

SEQ ID NO: 197468 - DNA, 562 bp, Homo sapiens
  misc_feature: GYAE6OF02G1IW4.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcgagcgcttacaatggtcacacaaactatgacacacgaacctcgagggacagagtcaacatcgaccacacgacacactccacgacgcacggcctacgagtacggacctggaacggacgtccgtagacgatcgtagaccgacgaccggtcgtagttacttacgtgtgacgagacgagtacgggtaattgtttagacgttcggttaccttgttacgaccgttagtacgggacctacgggtaccctcgg

SEQ ID NO: 197469 - DNA, 547 bp, Homo sapiens
  misc_feature: GYAE6OF02HQGQR.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacactttaccaactatggtatcagttgggtgcgacaggcccctggacaagggcttgagtggatggggatgggatcgagcgcttacaagtggtcacacaaactatgcacagaacctccagggcagagtcaccatgaccacagacacatccacgagcacggcctacatcggactgaggagcctgacgatctgaccgacacggccgtgtattacgtgtgcgagagagtacggggaaattgttttgacgttcggttacccttgttttacggacgttacgttcgggggacctaggggaccccttacggg

SEQ ID NO: 197470 - DNA, 535 bp, Homo sapiens
  misc_feature: GYAE6OF02GNSJF.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactatgcacagaacctccagggcagagtcaccatgaccacagacacatccacgagcacggcctacatcggacctgaggagcctgagatctgacgacgacggccgtagtacttacgtgtcgcgagagagtacggggaattgtttagacttcggtacccttgttacgtacttacgtggggacctacgggaccctcggg

SEQ ID NO: 197471 - DNA, 618 bp, Homo sapiens
  misc_feature: GYAE6OF02HVAK1.39.81.H04.1.454.CMB.1.raw
  modified_base (344)..(344): a, c, t, g, unknown or other
  misc_feature (344)..(344): n is a, c, g, or t
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttggtgcgacaggcccctggacaagggcttgagtggagtgggatggatcagcgcttacaatggtcacacaaactntgcacagaacctcaggcagagtcaccatacgaccaacagacacactaccacgagcacggcctacacgtcggacctgacggacgccgtagacgactcgtacgaaccgacgaaccgggtccgtagttaactttaacgtcggttacgcggaaggacggaaggttacggggtaaattttaacggtttttacggaaccgtttaccgggttaaccccgtttacgttttacggtaccgtttaaccggttcggggggtacccgtaacgggggtaacccccgg

SEQ ID NO: 197472 - DNA, 550 bp, Homo sapiens
  misc_feature: GYAE6OF02IJ7SU.39.81.H04.1.454.CMB.1.raw
  modified_base (439)..(439): a, c, t, g, unknown or other
  misc_feature (439)..(439): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatggggatggatcagcgcttacaatggtcacacaaactatgcacagaacctccaggcagagtcaccatgaccacagacacactccacgagacacggcctacatcggacctggaggagcctgagatctgacgacncggcgtgtattactgtgcgagagagtacgggaaattgtttacgacgttcggttaacccttcgtttacggaaccttaacggtcgggggtaccctacggggtaccccgtcggg

SEQ ID NO: 197473 - DNA, 552 bp, Homo sapiens
  misc_feature: GYAE6OF02FRG2O.39.81.H04.1.454.CMB.1.raw
  modified_base (386)..(386): a, c, t, g, unknown or other
  misc_feature (386)..(386): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaactatgcacagaacctcagggcagagtcacatcgaccacagacacacnccacgagcacgcctacactggacctggacggacgcctagagatcgtagacgacgacggccgtagtacttactgtgcgagagagtacggggaaattagttttagacgttacggttacccgttcgtttacgtacttaccggtcggggaccgtacgggacccgttacgg

SEQ ID NO: 197474 - DNA, 527 bp, Homo sapiens
  misc_feature: GYAE6OF02FYBIQ.39.81.H04.1.454.CMB.1.raw
  modified_base (429)..(429): a, c, t, g, unknown or other
  misc_feature (429)..(429): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacaacaaactatgacacagaacctccagggcagacgtcaacatgaccacagacacatccacgagcacgcctacatcggacctgagagctgagatcngacgacacggcgtgtacttacgtgtgcgagagagtacgggaattgtttagacttggtacccttagttacgactacgtcgggtacacgggaccttacgg

SEQ ID NO: 197475 - DNA, 533 bp, Homo sapiens
  misc_feature: GYAE6OF02JG8H4.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactatgcacagaacctccagggcagagtcacatcgaccacagacacactccacgagcacggcctacatggacctgaggagcctgagatctgaccgacacggccgtagtacttacgtgtcgcgagagaggtacgggaaattgtttagacttggtacccttgtttacgacttacgtggggcctagggaccctcggg

SEQ ID NO: 197476 - DNA, 555 bp, Homo sapiens
  misc_feature: GYAE6OF02JDBDZ.39.81.H04.1.454.CMB.1.raw
  modified_base (383)..(383): a, c, t, g, unknown or other
  misc_feature (383)..(383): n is a, c, g, or t
  modified_base (426)..(426): a, c, t, g, unknown or other
  misc_feature (426)..(426): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatgggatcagcgcttacgaatggtcacacaaactatgacacagaacctccagggcagagtcaaccatgaccanagacacatccagagcacggctacatggactgaggagcctaganatctacgacgacacggccgtagtacttacgtcgtgccggaagagagtacggggaaattagtttacggaacgttcggttaacccttgtttacgacttacggtcggggacctaacggggtacccttacggg

SEQ ID NO: 197477 - DNA, 580 bp, Homo sapiens
  misc_feature: GYAE6OF02H7819.39.81.H04.1.454.CMB.1.raw
  modified_base (420)..(420): a, c, t, g, unknown or other
  misc_feature (420)..(420): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggaactgagatgacgaagcctggggcctcagtgaaggtctcctgcaaggcttctggttacacctttacaactatggtatcagttgggtgcgacaggcccctggacaagggcttgagtggatgggatggatcgagcgcttacaagttcggtacacaacaaactatcgacaacacgaacctcgagggcagacgtaccacatacgaccacagacacactccacgacgccacggcctanacgtcggactggacggacgccgtagagactcacgacgacgacggtcctagtacttacgtgtcgacgagagagtacgggtaatttagtttcgacgttcggtaccctttcgtttacgaccgttacggtccggggtaccgtacgggttaccccgtggtacccg

SEQ ID NO: 197478 - DNA, 545 bp, Homo sapiens
  misc_feature: GYAE6OF02JI5T4.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactatgcacagaacctccaggcagagtcacatgaccacagacacatccacgagcacggcctacagtcggacctggacggacgcctagagactctgacgacgacggccgtgtacttacgtgtcgacgagagtagtacggggaattagtttagacgtcgttacccttgtttacgacgttacgtcggggaccctagggtacccttcggg

SEQ ID NO: 197479 - DNA, 575 bp, Homo sapiens
  misc_feature: GYAE6OF02GE1A6.39.81.H04.1.454.CMB.1.raw
  modified_base (344)..(344): a, c, t, g, unknown or other
  misc_feature (344)..(344): n is a, c, g, or t
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcgagcgctacaatggtcacacaaactntgcacagaacctcagggcagagtcaccatcgaccacagacacataccacgagcacggcctacatcggacctgaggacgccgtgagatcgtacgaccgacgaccgggtcgttagtactttacgtggtagacgaggacgaggtacgggggtaaatttacgttttaggaccgtttcgggttaaccccttgttttacggaaccgttacggtacgggggtacccaggggtaacccg

SEQ ID NO: 197480 - DNA, 563 bp, Homo sapiens
  misc_feature: GYAE6OF02JBEY2.39.81.H04.1.454.CMB.1.raw
  modified_base (438)..(438): a, c, t, g, unknown or other
  misc_feature (438)..(438): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcaggttgggtgcgacgacggcccctggacaagggcttgagtggatgggatggatcgagcgcttacaatggtcacacaactatgcacagaacctccagggcagagtcacatcgaccacagaccacactaccacgacgcacggcctacagtcggacctggaggacgccgtgacgntcgtagacgacgacggccgtgtacgttacgtgtagcgagaggagtacggggtaattgtttacgacgttacggttacccttcgtttacgacgttacgtcggggtacccgtagggtaccccggtcgg

SEQ ID NO: 197481 - DNA, 544 bp, Homo sapiens
  misc_feature: GYAE6OF02H25NL.39.81.H04.1.454.CMB.1.raw
  modified_base (380)..(380): a, c, t, g, unknown or other
  misc_feature (380)..(380): n is a, c, g, or t
  modified_base (426)..(426): a, c, t, g, unknown or other
  misc_feature (426)..(426): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctgggggcctcagtgaaggtctcctgcaaggcttctggttacaccttttaccaactatggtatcagttgggtgcgacaggcccctggacaagggcttgagtggatgggatggatcagcgcttacatggtcacacaaactatgcacagaacctcagggcagagtcaccatcgaccanagacacataccacgagcacgccacatggactgaggacgcctgagancgtgacgacacggcgtgtattactgtgcgagagagtacgggtaattacgtttagacgttcggttacccttcgtttacgtacgtaccgtacggggtccgtaacgggtacccgttacggg

SEQ ID NO: 197482 - DNA, 552 bp, Homo sapiens
  misc_feature: GYAE6OF02I754U.39.81.H04.1.454.CMB.1.raw
  modified_base (425)..(425): a, c, t, g, unknown or other
  misc_feature (425)..(425): n is a, c, g, or t
  modified_base (456)..(456): a, c, t, g, unknown or other
  misc_feature (456)..(456): n is a, c, g, or t
tcagtcgcactagtcacgaccggtgctcgatttagtagtgtagattcgcggggacccaaaaaccaacacccctccttgggagaatccctagatcaacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacaccttttaccaactatggtatcagttgggtgcgacacggcccctggacaaggggcttgagtggatgggatgggatcgagcgcttacaatggtacacacaaactatgcacagaacctcagggcagagtacacatcgaccacagacacatccaacgagcacggcctacatggacctgagancctgacgatctgacgacacggctgtattcgngtcgcgagagagtacgggaattagtttcgaacttcggtaacccttcgttttacggacgttaccggtggggtacccgtaaggggtaccccttacggg

SEQ ID NO: 197483 - DNA, 607 bp, Homo sapiens
  misc_feature: GYAE6OF02F55AB.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacacggcccctggacaagggcttggaggtggagtggggatgggatcgagcgtcttacaagtcggtacacaacaaactatgacacacgaaccctccgagggcaagagtacaccatacgaccacagacacactaccgagacgcaccggcctaacacgtacggacctggaacggacgccgtagacgatcgaggaccgaccgacgggccgtagttacttacgtgtacgcgaaggaggtacggtacggggtaaatttacggttttagaccgttacggttaccctttgtttacggtacgttacggtcggggtaccgtacggggtacccgttacggg

SEQ ID NO: 197484 - DNA, 592 bp, Homo sapiens
  misc_feature: GYAE6OF02HC2S5.39.81.H04.1.454.CMB.1.raw
  modified_base (346)..(346): a, c, t, g, unknown or other
  misc_feature (346)..(346): n is a, c, g, or t
  modified_base (403)..(403): a, c, t, g, unknown or other
  misc_feature (403)..(403): n is a, c, g, or t
  modified_base (437)..(437): a, c, t, g, unknown or other
  misc_feature (437)..(437): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatctaggttgggtgcgacaggcccctggacaagggcttgagtggagtggatggatcagcgcttacagtggtacacaacaactntgacacagacctcgaggcagacgtcacatacgaccactagacacgataccaacgacncacggacctacacgtacggacctaggacggtacnccgtagagactcgtacgaccgacgtacgggaccgttagttacttaccgtggtacgacgtaagagtacgtaggggtaaattgtttacggacgttaccgggttacccttagtttacgaccgttacggtcggggtacccacggggttacccctacggg

SEQ ID NO: 197485 - DNA, 605 bp, Homo sapiens
  misc_feature: GYAE6OF02I5JNF.39.81.H04.1.454.CMB.1.raw
  modified_base (348)..(348): a, c, t, g, unknown or other
  misc_feature (348)..(348): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacacggcccctggacaagggcttggagtggagtgggatggatcgagcgcttacaatggtacacacaaactntgcacagaacctcgagggcagagtcacatacgaccacacgacacactccacgagcacggacctacagtacggaccgtggacggagccgtaggagatcgtacgacgaccgaccgggtaccgttagttaacttaccgttggtacggacggaggacgtaggttaacggggtaaagtttacgttttaggaaccgttcggttacccgtttacgtttcgtaccgttaccggtacggggacccggtacggggtaacccttcggg

SEQ ID NO: 197486 - DNA, 539 bp, Homo sapiens
  misc_feature: GYAE6OF02F8FP7.39.81.H04.1.454.CMB.1.raw
  modified_base (455)..(455): a, c, t, g, unknown or other
  misc_feature (455)..(455): n is a, c, g, or t
  modified_base (459)..(459): a, c, t, g, unknown or other
  misc_feature (459)..(459): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactatgcacagaacctcagggcagagtcaccatcgaccacagacacatccacgagcacggcctacatcggacctgacggagcctgagactcgtagacgacgacggcgtgtattacngtgngagagagtagggaattgtttagacgttacggtacccttagttacgtactaccggtcggggaccctacgggtaccctcggg

SEQ ID NO: 197487 - DNA, 618 bp, Homo sapiens
  misc_feature: GYAE6OF02H5DG8.39.81.H04.1.454.CMB.1.raw
  modified_base (186)..(186): a, c, t, g, unknown or other
  misc_feature (186)..(186): n is a, c, g, or t
  modified_base (396)..(396): a, c, t, g, unknown or other
  misc_feature (396)..(396): n is a, c, g, or t
  modified_base (586)..(586): a, c, t, g, unknown or other
  misc_feature (586)..(586): n is a, c, g, or t
  modified_base (593)..(593): a, c, t, g, unknown or other
  misc_feature (593)..(593): n is a, c, g, or t
  modified_base (605)..(605): a, c, t, g, unknown or other
  misc_feature (605)..(605): n is a, c, g, or t
tcagtcgcactagtcacgaccggtgctcgatttagtagtgtagattcgcggggcccctagatcacagctcctcaccatggactggacctggagcattccttttcttggtggcagcaaacaacaggtgcccactcccaggttcagctggtacagtctggagctgagatgacgaagccgtggggcctnagtgaaggtctctgcaaggcttcgtgttacacctttaccaactatggtatcgaggttggtgcgacacggccctggacaagggcttgaggtggatggatggatcagcgacttaagaagtcggtacaaccaactaaactatggaaccaacgaacgtaaccctccgaaggggacaacggacgtaccaacctatacgaaccaacgtagaaccanaacctaccgaagacgacctacggtacctaacgatacgggacctagggaacgggactaccgtaggaactacgtacgtcggaacgacgacgggtccgtagttaactactggtgacgtaagtacgagttaacgggtaattacgttgaccttcggtaccttgtttacgacgtcggtcggacgtaacgggtcccnggtaccncgtacctccganaccgtcctaaccg

SEQ ID NO: 197488 - DNA, 517 bp, Homo sapiens
  misc_feature: GYAE6OF02FFF4J.39.81.H04.1.454.CMB.1.raw
  modified_base (448)..(448): a, c, t, g, unknown or other
  misc_feature (448)..(448): n is a, c, g, or t
  modified_base (487)..(487): a, c, t, g, unknown or other
  misc_feature (487)..(487): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacaccttttaccaactatggtatcagttggtgcgacaggcccctggacaagggcttgagtggatgggatggatcagcgcttacaatggtcacacaaactatgcacagaacctcagggcagagtcaccatgaccacagacacatccacgagcacggcctacatggacctgagagcctgagatctgacgacacggccgtgtattacngtgcgagagagtacgggaattagtttgactggtaccctntttcgacttacgtgggcccagggaccctgg

SEQ ID NO: 197489 - DNA, 563 bp, Homo sapiens
  misc_feature: GYAE6OF02GIAU2.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcgagcgcttaacatggtcaacgacaaactatgcacagaacctccagggcagagtcaccatcgaccacagacacactccacgacgacgacgcctacatcggaccgtgaggagcctgagatctgacgacgacggccgtagtacttacgtgtgcgagagagtacggggtaaatagttttaggtacgttacggttaccctttcgtttacgtacgttacggttcggggtacccgacgggtacccgtaccggg

SEQ ID NO: 197490 - DNA, 631 bp, Homo sapiens
  misc_feature: GYAE6OF02IDKZG.39.81.H04.1.454.CMB.1.raw
  modified_base (396)..(396): a, c, t, g, unknown or other
  misc_feature (396)..(396): n is a, c, g, or t
  modified_base (403)..(403): a, c, t, g, unknown or other
  misc_feature (403)..(403): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacaccttttaccaactatggtatctaggttgggtgcgacgacggccccctggacgaagggcttgaggtggagtgggatggatcgagcgcttaacaagtggtacacgaacaaactatcgacacagaaccctcgaggcagacgtcacatgaccanacgacanactcgaacgagacctacggaccctaagacgtcgggacctggaacggacgacccgtaggagtactcgtacgaaccgacgaaccgggtcccgtaagttacgtttaaccgtggtagacggacgaggtacgtaacggggttaaattaagtttacggtaacgtaccggttaaccctttgtttacggaaccgtttaacggaccggggtacccgtacgggtaaccccgttacggg

SEQ ID NO: 197491 - DNA, 672 bp, Homo sapiens
  misc_feature: GYAE6OF02JEE8Y.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacacggccctggacaagggcttgagtggatgggatggatcagcgcttacaatggtcacaacaaactatgacacacgaaccctcgagggcagacgtacaccatcgaaccacaacgacaactactacccgacgacgaccgaccggtcctaacagttacggacctggaacggacgtaccgtaggaagtacgtcgtacggaaccggtaaccgaccgggtacccgttagttaacctttaccgttggtaccgggtacgaagggtaaggtaccggttaacggggtaaacttttacggtttttaccggacggtttaacccggttaccccgtttacgttttacggtaacccgtttaccgggtacgggggtaccccggtaaccggggtaaccccgtttaccgggg

SEQ ID NO: 197492 - DNA, 536 bp, Homo sapiens
  misc_feature: GYAE6OF02HCOJG.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcgagcgcttacaatggtcacacaaactatgcacagaacctcagggcagagtcaccatgaccacagacacatccagagcacggcctacatcggacctgacggagcctgagatctgacgacgacggccgtagtacttacgtgtgacgagagagtacgggaattgtttagacgttcggttacccttgtttacgacgtacgtggggacctacgggtaccctcgg

SEQ ID NO: 197493 - DNA, 536 bp, Homo sapiens
  misc_feature: GYAE6OF02F8R3C.39.81.H04.1.454.CMB.1.raw
  modified_base (430)..(430): a, c, t, g, unknown or other
  misc_feature (430)..(430): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttggtgcgacaggcccctggacaagggcttgagtggatgggatggatcgagcgcttacaatggtcacacaaactatgcacagaacctccagggcagagtcacatgaccacagacacatccacgagcacgcctacatcggacctggagagccgtagagatcgngacgacgacggccgtagtacttacgtgtgcgagagagtacgggtaaattgtttagacgttcggtacccttgtttagacctacgtggggaccctagggaccctcggg

SEQ ID NO: 197494 - DNA, 559 bp, Homo sapiens
  misc_feature: GYAE6OF02GJSIY.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacaggcccctggacaagggcttgagtggatgggatggatcagcgcttacaatggtcacacaaactatgcacagaacctcagggcagagtcacatgaccacagacacatccacgacgcaacggcctaacatacggaccctggacggagcccgtagagatcgtaggaaccgacgaccgggtccgttagtattaccgtgtcggacgaggagagtacggggaaattagttttagacgttggtacccttgtttacgacgttacgtggggacctacgggacccttcggg

SEQ ID NO: 197495 - DNA, 576 bp, Homo sapiens
  misc_feature: GYAE6OF02IDNVL.39.81.H04.1.454.CMB.1.raw
  modified_base (339)..(339): a, c, t, g, unknown or other
  misc_feature (339)..(339): n is a, c, g, or t
tcagtcgcactagtcacgaccggtgctcgatttagtagtgtagattcgcggggacccaaaaaccacacccctccttgggagaatccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttggtgcgacaggccctggacaagggcttgagtggatgggatggatcgagcgcttacaatggcacacaaactngcacagaacctccagggcagagtcaccagtcgaaccacagacacactaccacgagcaacggcctacagtcggaccctaggacgacgccgtagagtactacgtagacgacgaccgggccgtagtacgttacgttggtcgccgaaggacgacgtacgggtaattagttttacgacgttacggtacccgttagtttacggacttaccgtacggggcccgtaacgggtacccgttaccggg

SEQ ID NO: 197496 - DNA, 601 bp, Homo sapiens
  misc_feature: GYAE6OF02H32S6.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaatatggtatcagttgggtgcgacacggcccctggacaagggcttggagtggatggggagtgggatcgaggcgcttacaattggtacaacacaaactatcgacaacacgaaccctccgagggacaagacgtcgaaccagtacgaccaacgacgacacactacccgacgacgccgaccggactacagtcggaccgtaggaggacgctagagactcgtgacgaccgacggccgttagtactttacgtggtgcgagagacggtagggtaaagttagtttacgtacgttcggttacccttacgtttacgtacgttacggtcgggggtacctaccgggaacccgttaccggg

SEQ ID NO: 197497 - DNA, 765 bp, Homo sapiens
  misc_feature: GYAE6OF02HO9XI.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagcgtggtacagtcgtggagctgagatgacgaagccgtggggcctcgagtgaaggtctcctgacgaggtcttcgtggttacctacctttaaccaacttagtaggtatcgtaggtttgggtcgaccgacgaccggccccgtagggaacgaacgggtcttaggaggtaggtaggtgggagtgggtatacgacggtcgtacttaacgaagttcggtaccaacgaactaaactgtacgaccaacgaacgtaaccctaccggaacggggtacaaggtaacgtaccaaccgtagtaaccgacccgtaacgaacgaaccaacgactacccgaacggacgacccgaaccggtacctaacgtacgtaccgggaccgtaggaacgggacgtaccgtaggaacgtacgtaccgtacggaacccgaccggtacccgggtaccgttacggttaactttacggttaggtacggacggtaacggaaggtacgggttaacggggttaaatttaacggttttacggtaaccgttacccgggtttaccctttacggtttacgtaccggttaaccgggtaccggggaaccgtaccggggtacccgttaccggg

SEQ ID NO: 197498 - DNA, 560 bp, Homo sapiens
  misc_feature: GYAE6OF02IO0D7.39.81.H04.1.454.CMB.1.raw
  modified_base (346)..(346): a, c, t, g, unknown or other
  misc_feature (346)..(346): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatgggatcgagcgcttacaatggtcacgacaaactntgcacagacctcgaggcagagtcaccatcgaccacagacacactaccacgagcacggcctacatcggacctgaacggagcctagagatcgtagaccgacgaccgggtccgtagtacttacgtagtgacgagagacgtacgggaaattcgtttagacgttacggttacccttgtttcgacgttacgtcggggtacctacggggtaacccttcggg

SEQ ID NO: 197499 - DNA, 752 bp, Homo sapiens
  misc_feature: GYAE6OF02GEKFL.39.81.H04.1.454.CMB.1.raw
  modified_base (342)..(342): a, c, t, g, unknown or other
  misc_feature (342)..(342): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacagggcttgagtgagtgggatggatcagcgcttacatggtcacgacaaactnagcacagaacctcgagggcagagtcacagtcgaaccacagacacactaccacgacgccgaaccggccctaacacgtacggacccgtggaacggtacgacccgttaggaacgtacgttccgtacgggaacccggaaccgtacccgggggtacccgtttaagggtttaaccgtttaaccgggttacgggttacgggtacccgggtaagggtaaccgggttaacgggtttaaccgggggggtaaaaacttttttaacgggtttttttaacgggaaaccccgggttttaacccggggtttaaaccccccgtttttaccggttttacccggggttaaccccggttttaacccgggtttacgggggggtaaccccccgggtaacggggggtttaaacccccccgtttacccggggg

SEQ ID NO: 197500 - DNA, 588 bp, Homo sapiens
  misc_feature: GYAE6OF02HC55D.39.81.H04.1.454.CMB.1.raw
tcagtcgcactagtcacgaccggtgctcgatttagtagtgtagattcgcggggcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtacacacaaactatgcacagacctcagggcagagtcacatcgaccacagacacatccacgagcacggcctacatcggacctgagggagcctggagactctaggaaccgacgaccggccgtgttacttacgtggtcgacggagaagtaaggtacgggggtaaaatttcgttttaggaaccgttcgggttaacccctttcgtttacggtaaccgttacggttcgggggacccgtaacggggtaaccccttgggtaccctaccggttcctcccgtctaccgcccttacccg

SEQ ID NO: 197501 - DNA, 549 bp, Homo sapiens
  misc_feature: GYAE6OF02IO91Q.39.81.H04.1.454.CMB.1.raw
  modified_base (346)..(346): a, c, t, g, unknown or other
  misc_feature (346)..(346): n is a, c, g, or t
tcagtcgcactagtcacgaccggtgctcgatttagtagtgtagattcgcgggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatgggatcgagcgcttacaatggtcacacaaactntgcacagaacctccagggcagacgtcaccatgaccacagacacataccacgacgacgacggcctacatcggacctggaggacgcctagagatcgtagacgacacgggcctagtacttacgtgtacgcgagagagtacggggtaattgtttagacgtcggtacccttgttcgacgttacgtcggggacctacgggaccctcggg

SEQ ID NO: 197502 - DNA, 643 bp, Homo sapiens
  misc_feature: GYAE6OF02HD78W.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacgaagggcttgagtggatgggatggatcgagcgcttacaagtggtacacacaaactatgacacacgaacctccgagggcagacgtacaccatacgaaccacaagacacactaccaacgacgaccgacggcctaacgacgtacggaccgtaggaacgggacgaccgtaggacgtaacgtcgtacggaaccgaccgaaccgggtccgttacggttaactttaccgtggttacggacggaaggaggtacggtaaggggtaaatttaggtttacgtacggttacccggttacccgtttcgtttacggtaccgttaaccgggttcggggtacccgtaaccggggtacccgttaccggg

SEQ ID NO: 197503 - DNA, 648 bp, Homo sapiens
  misc_feature: GYAE6OF02I4QYT.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacaggcccctggacaagggcttggagtggatgggatgggatcgagcgcttacaatggtcacacaaactatgacacacgaacctccgaaggggcaaggactccaccatcgaacccaacagaaccacactaccaacgacgaccgaccggaccctaacaacgtacggaaccgtaggacggacgccgtaggaacgtactacgtacggaaccgaccgaccgggtaccgttacgttacgttaccgttcggtacggcggtaaggaacggacggttacgggggttaaattaaggttttacggtaacgttaccgggttaccccgtttagtttacgtacgttaccggtaccggggtaccggtaccggggtacccgttacggg

SEQ ID NO: 197504 - DNA, 608 bp, Homo sapiens
  misc_feature: GYAE6OF02IRKHJ.39.81.H04.1.454.CMB.1.raw
tcagtcgcactagtcacgaccggtgctcgatttagtagtgtagattcgcgggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaaacctggggcctcagtgaaggtctcctgcaaggcttctggttacacctttacaactatggtatcagttgggtgcgacacggcccctggacaagggcttgagtggatgggatggatcgagcgcttacaagtggtcacacaaactatgcacagaacctcagggcagacgtcaccatcgaaccacacgacacactaccaacgacgccaccggcctaacacgtacggacctggaacgggacgccgtagacgtactcgacggaacgaccgaaccgggtccgtagttacttacgtggttacgcgaaggagagtacggggtaaatttaggtttacggtacgttacgggttaccctttacgtttacgtaccttacgggtccgggacccgtaacggggtacccctgggtaccccg

SEQ ID NO: 197505 - DNA, 712 bp, Homo sapiens
  misc_feature: GYAE6OF02JZJJS.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctccgtgcaaggcttctggttaccacctttaccaatatcggtatcagttgggtgcgacaggcccctggacaagggcttggagtggatgggatggatcgagcgtcttacgaatggtaccacgaacaaactatgactaacgaacgaaccctccgaaggggcaacggagtaccaaccgtatacggaacccaacgaacgtaaccaacgaactacccgaacggaacgaccgaaccggtaccctaacgacgtaccgggaacccgtaggaacgggacgtacccgtaacggaacgtacctaccggtacgaaccggaaccgaccgggtaccgttaggttaaccttacgttacggtacggacgaagggtaaggtacgttaacgggggttaaattacggttttacggaacggtttaccgggttaccccgtttacggtttacggtaaccggttaccgggttaccggggtacccggttaaccggggtaccccgtttaccggg

SEQ ID NO: 197506 - DNA, 595 bp, Homo sapiens
  misc_feature: GYAE6OF02HN2EF.39.81.H04.1.454.CMB.1.raw
  modified_base (259)..(259): a, c, t, g, unknown or other
  misc_feature (259)..(259): n is a, c, g, or t
  modified_base (341)..(341): a, c, t, g, unknown or other
  misc_feature (341)..(341): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactntggtatcagttggtgcgacaggcccctggacaagggcttgagtggagtgggatggatcagcgcttacatgtcacacaaactntgcacagaacctccgaggcagagtcaaccatcgaccacgagacacactaccaacgacgccgacggcctaacgagtacggaccgtggacggagcccgtaggagactcgacgaccgaccgaccggccgttacgttaattaccgtgtcgacgacggagtacgtacggggtaaacttagttttacgacgttaccggttaccctttcgtttacgtaccgttaccggttccggggaccgtaccgggtacccgttaccggg

SEQ ID NO: 197507 - DNA, 550 bp, Homo sapiens
  misc_feature: GYAE6OF02GBTNA.39.81.H04.1.454.CMB.1.raw
  modified_base (342)..(342): a, c, t, g, unknown or other
  misc_feature (342)..(342): n is a, c, g, or t
tcagtcgcactagtcacgaccggtgctcgatttagtagtgtagattcgcgggacccaaaaaccacacccctccttgggagaatcccctagatcacagctcctcaccatggactggacctggagcatccttttcttggtggcagcaacaacaggtgcccactcccaggttcagctggtacattctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactntgacacacgaacctccagggcagagtacaccatcgaccacagacacactaccacgacgcacgacctacactcggacctggaggacgcctgagatcagacgacacggccgtagtacttacgtgtacgcgagagagtacggggtaaattgtttagacgttcggtacccttcgtttacgacgttaccgtgggcccgacgggtaccctcggg

SEQ ID NO: 197508 - DNA, 525 bp, Homo sapiens
  misc_feature: GYAE6OF02HF8LS.39.81.H04.1.454.CMB.1.raw
  modified_base (325)..(325): a, c, t, g, unknown or other
  misc_feature (325)..(325): n is a, c, g, or t
  modified_base (372)..(372): a, c, t, g, unknown or other
  misc_feature (372)..(372): n is a, c, g, or t
  modified_base (378)..(378): a, c, t, g, unknown or other
  misc_feature (378)..(378): n is a, c, g, or t
  modified_base (380)..(380): a, c, t, g, unknown or other
  misc_feature (380)..(380): n is a, c, g, or t
  modified_base (391)..(391): a, c, t, g, unknown or other
  misc_feature (391)..(391): n is a, c, g, or t
  modified_base (404)..(404): a, c, t, g, unknown or other
  misc_feature (404)..(404): n is a, c, g, or t
  modified_base (409)..(409): a, c, t, g, unknown or other
  misc_feature (409)..(409): n is a, c, g, or t
  modified_base (413)..(413): a, c, t, g, unknown or other
  misc_feature (413)..(413): n is a, c, g, or t
  modified_base (426)..(426): a, c, t, g, unknown or other
  misc_feature (426)..(426): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggccctggacaaggcttgagtggagtgggatggatcagcgcttanaatggtcacgaacaaactatgcacagaacctcagggcagagtcacangaccananacacatcagancacgcacatgacngagcncgtnagatctgacgacncggctgtacttagtgtagcgagagagtacgggaattgttgaacgtcggttaccctgtttacgtaccgtaacgtcggggtacctacgggtaaccctcggg

SEQ ID NO: 197509 - DNA, 640 bp, Homo sapiens
  misc_feature: GYAE6OF02H3K2E.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaatatggtatcagttgggtgcgacacggcccctggacaagggtcttggagtggagtgggatggatcgagcgtcttaacaagtcggtacaacaacgaaaactatcgacaacagaacctcgaagggacaggagtccaaccagtcgaccaacacgacacactaccaacgagaccacggactacgacgtcggacctaggacggacgcgtaggaacgtacgtaccgtaggaccgaaccggaccgggtaccgttaggtaacgtttacgtggtacggcgtaaggtacggtaggtaacggggtaaattcggttttacggtacgttacggttacccgtttcgtttacggacgttaccggttacggggtacccgtaccgggtaacccggttacggg

SEQ ID NO: 197510 - DNA, 538 bp, Homo sapiens
  misc_feature: GYAE6OF02FWGCX.39.81.H04.1.454.CMB.1.raw
  modified_base (312)..(312): a, c, t, g, unknown or other
  misc_feature (312)..(312): n is a, c, g, or t
tcagtcgcactagtcacgaccggtgctcgatttagtagtgtagattcgcggggcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactntgcacagaacctcagggcagagtcaccatgaccacagacacatccaacgagcacggcctacatcggacctggaggagcctgagatctgacgacgacggccgtgtacttactgtgcgagagagtcgggaaattgtttgacgttcggtacccttgttcgacgttacgtcggggacctaacgggtaacccttgggtcctaccggtcctccgtacgacgtccctaacccg

SEQ ID NO: 197511 - DNA, 604 bp, Homo sapiens
  misc_feature: GYAE6OF02IIV3Q.39.81.H04.1.454.CMB.1.raw
  modified_base (443)..(443): a, c, t, g, unknown or other
  misc_feature (443)..(443): n is a, c, g, or t
  modified_base (450)..(450): a, c, t, g, unknown or other
  misc_feature (450)..(450): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttggtgcgacaggcccctggacaagggcttgagtggatggggatgggatcgaggcgcttaacaatggtacaacaacaaaactatgcaacagaacctccgaggcaagacgtcaaccatacgacccaacagaacacactaccacgacgacacggacctacatcggacctagaggacnccgtganactctagaaccgaacaccgggtcccgttaggttaattacgttcggtacgacggagaagaggtacggggtaaattagtttttacgacgttacggttacccttacgtttacgtaccgttaccgtacggggaccgtaccgggtaacccgttaccggg

SEQ ID NO: 197512 - DNA, 557 bp, Homo sapiens
  misc_feature: GYAE6OF02GCTWI.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactatgacacagaacctccagggcagagtcaccatgaccacagacacatccaacgagcacggcctacatcggacctgaggacgccgtgagatctgacgacgacggccgttgtacttacgtgtcgcgagaggtagtacggggtaattaagttttgaccgttcggttacccttcgtttacgaccgttacggttcgggacccgtacggggacccttacggg

SEQ ID NO: 197513 - DNA, 572 bp, Homo sapiens
  misc_feature: GYAE6OF02GFMUS.39.81.H04.1.454.CMB.1.raw
tcagtcgcactagtcacgaccggtgctcgatttagtagtgtagattcgcggggacccaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcaggttggtgcgacgacggcccctggacaagggcttggagtggatggggatggatcgagcgcttacaagtcggtacacaacaaactatcgacacacgaacctccgagggcagagtcaaccatcgaccacagacacactccaacgacgccacggcctacagtcggacctgacggacgctgagactcgtacgacgaacgaccggccgttagtacttacgtgtacgacgagtagagtacgggtaaattgtttacgacgttcggttacccttgttagaccgttacggtcggggaccgtacggtacccgtcgg

SEQ ID NO: 197514 - DNA, 704 bp, Homo sapiens
  misc_feature: GYAE6OF02JVAAQ.39.81.H04.1.454.CMB.1.raw
  modified_base (277)..(277): a, c, t, g, unknown or other
  misc_feature (277)..(277): n is a, c, g, or t
  modified_base (358)..(358): a, c, t, g, unknown or other
  misc_feature (358)..(358): n is a, c, g, or t
  modified_base (420)..(420): a, c, t, g, unknown or other
  misc_feature (420)..(420): n is a, c, g, or t
tcagtcgcactagtcacgaccggtgctcgatttagtagtgtagattcgcggggacccgaaaaaccaacacccctcccttcgggagaatccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttcgtggttacacctttacaactatggtatcagttggngcgacgacggcccgtggacgagggcttggagtggagtgggatggatcgagcgtcttacgagtcggtacaacaacgaaactntagacaacgaacgtaaaccctccgaagggccaacgagtaccaacccaagtccgaacccgaanacgaaccaacgaactacccgaacgacgacccgaaccggtaaaccctacgaacgtaccggtaacccgtaggaaacggtcgtaacccgtaggaacgtacttaccggtacgaaccggtaaccgtaccgggtaccgtttaagttaccgtttaacgtcggttacggaccggtaggtaacggtagggtaacggggtaaatttacggtttacggtaaccgttaccggttacccgttgtttacggtaccgttaaccggttcggggacccggttaccgggtacccgttacggg

SEQ ID NO: 197515 - DNA, 548 bp, Homo sapiens
  misc_feature: GYAE6OF02FPDBP.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatggggatggatcagcgcttacaatggtcacacaaactatgcacagaacctcagggcagagtcacatcgaccacagacacatccacgagcacggcctacatcggacctggaggacgcctgagatctgacgacgacggccgttagtacttacgtgtcgcgagagagtacgggaaattagtttgaacgttggtaacccttgtttacgaccgttacggtcggggacctaggggtaccccttacggg

SEQ ID NO: 197516 - DNA, 672 bp, Homo sapiens
  misc_feature: GYAE6OF02JBU5U.39.81.H04.1.454.CMB.1.raw
  modified_base (273)..(273): a, c, t, g, unknown or other
  misc_feature (273)..(273): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttggngcgacacggccctggacaagggcttgagtggagtgggatggatcgagcgacttacaatggtacacacaaactatgacaacagaacctccgagggcagacgtacaccatacgaaccacgacgacacactaccaacgacgaccgaaccggcctaacgacgtacggaccgtaggaacggacgacccgtaggaacgtactaccgtacggaaccggaaccgaccgggtacccggttacggttaacgtttaccgttacggttacggacggtaagggaaggtacggttaacgggggtaaactttaaggtttttacggaacggtttaccggttacccgttttacgttttacggtaccggtttaccgggttaccgggggtacccgtaacgggggtaccccgttacggg

SEQ ID NO: 197517 - DNA, 573 bp, Homo sapiens
  misc_feature: GYAE6OF02FZROM.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttggtgcgacaggcccctggacaaggggcttggagtggatgggatggatcgagcgcttacaatggtcacacaaactatgcacagaacctccagggcagagtcaccatcgaccacagacacatccacgagcacggcctacacgtcggacctggagacgccgtagagatccgtagaccgacgaccggccgtagttacttacgtgtcgacgagagagtacggggtaattacgtttaggtaacgttcggttaacccttcgttttacggacgttaccggtacggggacccgtacggggtacccttcgggg

SEQ ID NO: 197518 - DNA, 562 bp, Homo sapiens
  misc_feature: GYAE6OF02IGWPN.39.81.H04.1.454.CMB.1.raw
  modified_base (325)..(325): a, c, t, g, unknown or other
  misc_feature (325)..(325): n is a, c, g, or t
  modified_base (341)..(341): a, c, t, g, unknown or other
  misc_feature (341)..(341): n is a, c, g, or t
  modified_base (375)..(375): a, c, t, g, unknown or other
  misc_feature (375)..(375): n is a, c, g, or t
tcagtcgcactagtcacgaccggtgctcgatttagtagtgtagattcgcgggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgagcctggggcctcagtgaaggtctcctgcaaggcttctggttacacctttacaactatggtatcagttgggtgcgacacggccctggacaagggcttgagtggatgggatggatcagcgcttanatggtcacgacaactnagcacgagaacctcgaagggcaggatacacctancgaaccacagacacactccacgacgacaccggcctacagtcggacctgacggacgctagagactcgtagaccgacgacggccgtagtacttacgtgtacgacaggagtaggtacgggtaattgtttacgacgttcgtacccttgtttacgacgttaccggtggggaccgtacgggtacccgttacgg

SEQ ID NO: 197519 - DNA, 609 bp, Homo sapiens
  misc_feature: GYAE6OF02JGFY2.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttggtgcgacaggcccctggacaagggcttgagtggatgggatggatcagcgcttacaatggtcacacaaactatgcacacgaacctccgagggcagacgtacaccatcgaccacacgacacactcccaacgacgccgacggcctaacgagtacggaccgtaggaacggacgccgtagacgactccgtaggaaccgaccgaccgggtccgttaggttaactttaccgtggtacgacgagacggtacggtaacggggtaaatttcggtttaggacgttacggttacccttgtttacgtaccgttaccggtacggggtacccgtacggggtaccccgttcggg

SEQ ID NO: 197520 - DNA, 569 bp, Homo sapiens
  misc_feature: GYAE6OF02I9R7K.39.81.H04.1.454.CMB.1.raw
tcagtcgcactagtcacgaccggtgctcgatttagtagtgtagattcgcggggcccctagatcacagctcctcaccatggactggacctggagcatcctttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaactatgcacagaacctcagggcacgagtcaccatcgaaccacgacgacaacatcccaacgagcacggacctacaagtcgacctggacggacgcctagagactcgtagacgaccacggcgtagtactacgtgtcgcgagagagtacgggtaaattagtttcggacttcggtacccttcgtttagaccttacggtacggggaccctaaggggtaaccccttgggaccctacccgggttccaccgtaccgtacggtccctacccgg

SEQ ID NO: 197521 - DNA, 712 bp, Homo sapiens
  misc_feature: GYAE6OF02JM2KJ.39.81.H04.1.454.CMB.1.raw
  modified_base (336)..(336): a, c, t, g, unknown or other
  misc_feature (336)..(336): n is a, c, g, or t
tcagtcgcactagtcacgaccggtgctcgatttagtagtgtagattcgcggggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttggtgcgacaggcccctggacaagggcttgagtgatgggatggatcgagcgcttacaattggacacaacaaactatgacaacacgaacctccgaagggccaagacgtaccaccgatacgaccaanacgacacaactcccaagacgcaccggcctaacatacgggaccctaggaacgggacgtccctaggaacgtacgtccgtacggaaccggaaccgaccggggtccctacggttaacgtttaacgtacgggttcgaaccggtaacgtaagggtaaccgttaacgggggtaaaactttagtttttaacggaccgttttaacggtaacccctttcggtttaccgtaccgttaaccggttacggggacccgtaaccgggtaacccgtcggtaccgtaccgttcctaccgtacgtaccgtcccgttaccacccggaaccggtaccccgtaggttcccgttccggttacccccgtcggtaccccgtaccccgttaccctacccgg

SEQ ID NO: 197522 - DNA, 581 bp, Homo sapiens
  misc_feature: GYAE6OF02IEOJ6.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgctttacaagtggcacaacaaactatgcacagaacctcgaggcagagtcacatcgaccacagacacatccagagcacggctacatcggacctgaggacgccgtaggacgatacctgaaccgtacgaccgggaccgttgtaactttacgtgttaggccgaagacgagtacggggtaaaatttcgtttacggacgttcggtttaacccttcgtttacgacgttaccggttccgggggaccgtaccggggtacccgttaccggg

SEQ ID NO: 197523 - DNA, 552 bp, Homo sapiens
  misc_feature: GYAE6OF02GNXAA.39.81.H04.1.454.CMB.1.raw
  modified_base (463)..(463): a, c, t, g, unknown or other
  misc_feature (463)..(463): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcgagcgcttacaatggtcacacaaactatgcacagaacctcagggcagagtcaccatcgaccacagacacatccacgagcacggcctacatcggacctgaggacgcctggagatctagaccgacacgggtccgtagtaacttacgnggtgcgagagagtacgggaaattgtttagacgttcggttacccttgtttagaccgttacggtcggggacccgtacggggtaccctcggg

SEQ ID NO: 197524 - DNA, 608 bp, Homo sapiens
  misc_feature: GYAE6OF02HN0F4.39.81.H04.1.454.CMB.1.raw
  modified_base (406)..(406): a, c, t, g, unknown or other
  misc_feature (406)..(406): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacaccttttaccaactatggtatcgagttgggtgcgacacggcccctggacaagggcttgagtggatgggatggatcgagccgtacttacaagttcggtacacaacgtaaactatgacacagaaccctccgaagggcaggacgtacaacctatacgacccaanacgacacactaccacgacgcaccggacctacgagtacggaccgtggacggacgccgtagagatcgagacgacgaccggcgttgtactttacgtgtcgacggagaggaggtacgggtaaatttgtttacggaccgttacggttaccttcgtttacggtaccgttaccggtacggggtaccgtaccggggtaacccttaccggg

SEQ ID NO: 197525 - DNA, 528 bp, Homo sapiens
  misc_feature: GYAE6OF02H4D4G.39.81.H04.1.454.CMB.1.raw
  modified_base (384)..(384): a, c, t, g, unknown or other
  misc_feature (384)..(384): n is a, c, g, or t
  modified_base (454)..(454): a, c, t, g, unknown or other
  misc_feature (454)..(454): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggccctggacaagggcttgagtgatgggatggatcagcgcttacaatggtcacacaaactatgcacaagacctccagggcagagtcacatgaccatagacacanccacgacgcacggcctacatggacctgacggagcctgagatctacgacgacacggccgtagtacttacgngtgcgagacgagtcgggaattagtttgacgtcggttacctctttgacttacgtcgggtacacgggaacctcggg

SEQ ID NO: 197526 - DNA, 561 bp, Homo sapiens
  misc_feature: GYAE6OF02HKCBG.39.81.H04.1.454.CMB.1.raw
  modified_base (275)..(275): a, c, t, g, unknown or other
  misc_feature (275)..(275): n is a, c, g, or t
  modified_base (344)..(344): a, c, t, g, unknown or other
  misc_feature (344)..(344): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtncgacaggcccctggacaagggcttgagtggatgggatggatcagcgcttacaatggtacacacaaactntgacacacgaacctccgagggcaggagtcaccatcgaccacagacacactccacgagcacggcctacatcggacctgaggacgcgtagagatacgtggaccgaaccgaccggcccgtagtacttacgtcggtgcgaggtacgagtacggggtaattgtttagactcggttacccttcgtttacgacttaccggtcggggacctacgggtaccctcgg

SEQ ID NO: 197527 - DNA, 585 bp, Homo sapiens
  misc_feature: GYAE6OF02HV9LV.39.81.H04.1.454.CMB.1.raw
  modified_base (344)..(344): a, c, t, g, unknown or other
  misc_feature (344)..(344): n is a, c, g, or t
  modified_base (404)..(404): a, c, t, g, unknown or other
  misc_feature (404)..(404): n is a, c, g, or t
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactntgcacagacctcagggcagatcacatcgaccacagacacactccacgagcacggacctanacgtacggacctgggacgcgcgagacgacgtcgacggacgacggaccggtcgttagttacttacggtgcggtaacgaggtagtacggggttaacggtaagttttacgttacggtacggtttaccgttaccgtttcgttaccgtaccgttacgggccgggtacgggtacccggttacccggg

SEQ ID NO: 197528 - DNA, 544 bp, Homo sapiens
  misc_feature: GYAE6OF02F71NO.39.81.H04.1.454.CMB.1.raw
  modified_base (420)..(420): a, c, t, g, unknown or other
  misc_feature (420)..(420): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactatgcacagaacctccaagggcagagtcaccatcgaccacagacacatccacgagcacggcctacatcggacctggagngcctgagatcgtgaccgacacggtccgtagtattacgtgtgcgagagagtcggggtaaattgtttaggactcggttacccttgtttacgacttaccggtggggaccctacggggtaccctcggg

SEQ ID NO: 197529 - DNA, 655 bp, Homo sapiens
  misc_feature: GYAE6OF02GCMOA.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccagtttcagctggtacagtctggagctgagatgacgaagcctgggcctcagtgaaggtctcctgcaaggcttctggttacacctttacaactatggtatcagttggtgcgacaggcccctggacaagggcttgagtgatgggatggatcgagcgcttacaagtggtacacacaaactatgcacagaacctccgagggcagacgtaccaacatacgaccacacgacacgtactaccaacgacgaccgaaccggcctaacagtcgggaacctaggaacggaccgacgtgacgtactaccgtagaaccggaacgacccgggccgttaggtaacgttaacggtcgtacggccggaagtaacggtacggtaacgggggttaaaatttacggttttaaccggaaccggtttaccgggttaacccgtttccgtttaacggaaccggtttaaccgggtccggggtaaccccgggtaacggggtaacccccgttacgggg

SEQ ID NO: 197530 - DNA, 627 bp, Homo sapiens
  misc_feature: GYAE6OF02FFW7U.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatcctttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgtcttacaatggtcacacaaactatgcacacgaacctccgagggcagagtcaaccatcgaccacacgacacactccgacgacgccaccggcctacagtcgggacctggaacggacgtcccgtagacgtactccgtagaccgacgaccgggtacccgttagttaacgttacgtggttacggacgtaggaaggtacggtaacgggggtaaattttacgtttacggaaccgttaccggttaaccccttacgttttacggaacccgtttaaccgggtcgggggacccctaacgggggtaacccccttcgggg

SEQ ID NO: 197531 - DNA, 692 bp, Homo sapiens
  misc_feature: GYAE6OF02JNXKZ.39.81.H04.1.454.CMB.1.raw
  modified_base (258)..(258): a, c, t, g, unknown or other
  misc_feature (258)..(258): n is a, c, g, or t
  modified_base (689)..(692): a, c, t, g, unknown or other
  misc_feature (689)..(692): n is a, c, g, or t
tcagtcgcactagtcacgaccggtgctcgatttagtagtgtagattcgcggggacccaaaaccacacccctccttgggagaatccctagatcacagctcctcaccatggactggaccgtggagcactccttttctttggtggcgagacaacaacaggtcgcccacctcccgtacggttcgacgcgtcggtacgtagtcgtggagcgtgagagtagacgaacgccgtcgggccgtacgagtagtacggtcgtccgtcgnacgtacgtcttcgtacgttacctaccttacctaactagtacggttacgtacgtaggttagggtacggtaccgtaacgtaccggtacccgtacggaacggtaacgggtacgttaggtaggtaggtaggtaggtagtacggtacgtacgacgtacgtacttaacgtaacgtacggtacctaacgtaacgtaaacgtaacgtacgtaaccgtaaccgtaaccgtaacccgtaccggtaacggtacggtaacggtaacgtaacccgtaaccgtaacgtaaccgtaaaccgtaaaccgtaaaccgtaaaccgtaaaccgtaaccgtaacccgtaaaccggtaaccggtaacccggtaacccggtaacccgtaaaccggtaaccggttaaccgggtaaccgtaacggtaacggtaaccgtaaccggtacgtaaccgnnnn

SEQ ID NO: 197532 - DNA, 612 bp, Homo sapiens
  misc_feature: GYAE6OF02GYITV.39.81.H04.1.454.CMB.1.raw
  modified_base (322)..(322): a, c, t, g, unknown or other
  misc_feature (322)..(322): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttggtgcgacaggccctggacaaggctgagtggatgggatggatcagcgcttanaagtggtcacacaaactatgacacagacctcgagggcagacgtcaccatcgaccacgagacacactaccacgacgcgaccggtcctaacgagtacggacctaggaacggacgccgtaggacgactcgtacggaccgaccgaccgggtcccgtagtacgtttacgtggtacgacggtaagagtacggttacggggtaaatttggttttaacggacgttaccgggttaccccgtttgtttacggtaccgttaccggttacgggggtacccgtacggggtaacccgttccggg

SEQ ID NO: 197533 - DNA, 627 bp, Homo sapiens
  misc_feature: GYAE6OF02H8K91.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggctcagtgaaggtctctgcaaggcttctggttacaccttttaccaactatggtatcagttggtgcgacaggcccctggacaagggcttgagtggatgggatgggatcgagcgtcttacgaatgggtctacacaaactatcgacacagaacctccgagggacagacgtcaaccagtacgacccagagaccaacatacccaacgacgcaacggtcctaacacgtgggacctggaacgggacgccgtagagactcgtcggaacgaaccgtaccggccgttacggttaacgttactaggtacgacgaacgagacgttacggggtaaattcggtttttacggaacgttccggtttaacccgttcgttttacggaacccgtttacggttaccgggggtacctaccggggtaccctttaccgggg

SEQ ID NO: 197534 - DNA, 562 bp, Homo sapiens
  misc_feature: GYAE6OF02GIHKI.39.81.H04.1.454.CMB.1.raw
  modified_base (431)..(431): a, c, t, g, unknown or other
  misc_feature (431)..(431): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttggtgcgacaggcccctggacaagggcttgagtggatgggatggatcgagcgcttacaatggtcacacaaactatgcacagaacctcgaggcagagtcacatgaccacagacacactaccacgacgcacggcctacacgtacggacctggaggacgctgagntacgtcgacgacgaccggccgttagttaacgttacgtgtggacgagagagtacggggaattagtttagacgttcggtacccttcgtttacgtacgttacgtcggggtacccgacggggtacccgttaccgg

SEQ ID NO: 197535 - DNA, 601 bp, Homo sapiens
  misc_feature: GYAE6OF02JLLGS.39.81.H04.1.454.CMB.1.raw
  modified_base (299)..(299): a, c, t, g, unknown or other
  misc_feature (299)..(299): n is a, c, g, or t
tcagtcgcactagtcacgaccggtgctcgatttagtagtgtagattcgcggggcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttcgtggttacacctttaccaacttatggtatcagttgggtgcgacacggcccctggaccaagggcttgagtggatgggatggatcagcgctanaatggtcacacaaactatgcacagaacctcgagggcagacgtcaccatcgaaccagacgacacactcccaacgacgccaacgggccctacgacgtacggaccgtaggacggacgccgtacgagacgtctacggaacgaccgacggccgtacgttacgtacgtgtagcgaggacgtaggtacggggtaaattagtttacgacgttacgttaccttcgttacgtacgttccggtagggtaccgaacgggtaacccgtcggtaccgtacccggttccgtcccgtacgtaccggtccctaacccgg

SEQ ID NO: 197536 - DNA, 562 bp, Homo sapiens
  misc_feature: GYAE6OF02JG3L8.39.81.H04.1.454.CMB.1.raw
  modified_base (359)..(359): a, c, t, g, unknown or other
  misc_feature (359)..(359): n is a, c, g, or t
tcagtcgcactagtcacgaccggtgctcgatttagtagtgtagattcgcggggtgatcaggactcctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaacgcctcgtatacattgatggaaacacctacttgaattggttcagcagagccaggccaatctaccaaggcgacctaatttataggtttcaaccgggtactcgtgggtccccagacagatcagcgcagtggtacnggcacgtgaattcgacatagaaactcagcgagggtaggaggtacgtagaggtagtggtttaggggttatttacgtgacagttgactaaggacaacgacgtcgggcctaccgtacctcgtttacggaccgtagggaccagtacggtacggaaggtactacgaaacgtaacgtacgtaggtccgtacgaccgactacgtcttacg

SEQ ID NO: 197537 - DNA, 594 bp, Homo sapiens
  misc_feature: GYAE6OF02IZPBC.39.81.H04.1.454.CMB.1.raw
  modified_base (385)..(385): a, c, t, g, unknown or other
  misc_feature (385)..(385): n is a, c, g, or t
tcagtcgcactagtcacgaccggtgctcgatttagtagtgtagattcgcgggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttcgtggttacaccttttaccaaactatggtatcagttggtgcgacaggcccctggacaaggctgagtgagtggatggatcagcgcttacaagtggtcacaacaaactatgacacacgaacctccgagggcagagtcaacgatgaccanagacacataccacgagaccgacggcctaacgtacgaggaccctaggaacggacgacgttgaacgtagtaccttacggaaccgaacgaacgggcccgttagttacgttaactcggtagaccggagtaacggagtaacggggtaaattggtttagacgttcggtaccttcgtttacgacgttacgaggggtacccgagggtaccccgtagg

SEQ ID NO: 197538 - DNA, 628 bp, Homo sapiens
  misc_feature: GYAE6OF02GVFTI.39.81.H04.1.454.CMB.1.raw
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacacctttaccaactatgtatcaggttggtgcgacacggcccctggacgaggcttggagtggagtgggatggatcgagcgtcttacaagtggtcacaactaaactatcgacaacaacgaacctaccgagggacaggacgtacaacctagtacgaaccacgaacgaaccacaactaccgaacgacgaccgaccgacctacgacgtaccggaccgtaggaacggacgtaccgtagaacgtactcgtacgaccgaaccgtaccgggccgttagttacgttacgtggtcgacgagaacgtacggtaagggtaatttaggtttacgacgttaccgttacccttgtttacggaccgttacggtcgggtaacccgtacggtacccgtcgg

SEQ ID NO: 197539 - DNA, 643 bp, Homo sapiens
  misc_feature: GYAE6OF02HC7JD.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcgagttgggtgcgacacggcccctggacgaagggcttggagtggagtgggatggatcgagcgcttacaagtcggtacacaacaaactatcgacacaacgaaccctcgaacgggacaaggacgtacaccaagtacgaacccaacgagaacaaccactacccgaacggaacgaccgaaccgggtacctaaccgagtacggaacccgtaggacgggtacgcccgtaggaacgactaccgtacggaaccgaccgacgggcccgttaggttaccttacgttgtcggacgaggacgaggtacgggtaaatttgtttacgacggttacggttacccttggtttacgacgttacggtcggggtaccgtaacgggtcccgttacggg

SEQ ID NO: 197540 - DNA, 674 bp, Homo sapiens
  misc_feature: GYAE6OF02GAF6F.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcgagtgaaggtctcctgcaaggcttctggttacacctttacaactatggtatcagttgggtgcgacacggccctggacaagggtcttgagtggagtgggatggatcagcgtacttacaagtggtcaacaacaaactatcgacaacaacgaacctccgaagggcaaggacgtacaaccagtacgaacccacgaacgaacaacactacccaacgacgacgaccggacctaacgagtacgggaccgtaggacggacgccgtaggacgactacgtacggaccgaacgtaccggaccgttaggtaacgtttacgtaggttacggacggtaaggacggtaggttaacgggggttaaactttaaggttttacggaaccggtttaccgggttacccgtttaccgtttacggttaacccggttaccgggtaccgggggtaccccggtaacgggtaaccccggttaccggg

SEQ ID NO: 197541 - DNA, 595 bp, Homo sapiens
  misc_feature: GYAE6OF02GU2AT.39.81.H04.1.454.CMB.1.raw
  modified_base (333)..(333): a, c, t, g, unknown or other
  misc_feature (333)..(333): n is a, c, g, or t
  modified_base (356)..(356): a, c, t, g, unknown or other
  misc_feature (356)..(356): n is a, c, g, or t
  modified_base (449)..(449): a, c, t, g, unknown or other
  misc_feature (449)..(449): n is a, c, g, or t
  modified_base (497)..(497): a, c, t, g, unknown or other
  misc_feature (497)..(497): n is a, c, g, or t
tcagtcgcactagtcacgaccggtgctcgatttagtagtgtagattcgcggggacccgaaaaaccaacacccctcccttcgggagaatcccctagatcacagctcctcaccatggactggacctggagcatccttttcttggtggtcagcaacaacaggtgcccactcccaggttcagctggtacagtctggagctgagatgacgaagcctggggcctcgagtgaaggtctcctgcaaggcttcgtggttacacctttaccaactatggtatcgagttggtgcgacaggcccctggacaaggggtcttggagtggagtgggatggatcgagcncttacaatggtacacacaaactngacacacgacctccgaagggcaggacgtcaacctagtcgaaccacaagaccaacatccaacgacgctaccggctacgatggaccctggagacnccgttagagtactcgcgaaacgtcgacccgggtctaagttacttacgntaggtcgaggaactggtaacggggaaactttgtttagaccgttcggttacctctttcgggacttaaccggtggggtacccgacggtaccgttaccggg

SEQ ID NO: 197542 - DNA, 552 bp, Homo sapiens
  misc_feature: GYAE6OF02G9H7B.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcgagcgcttacaatggtcacacaaactatgacacacgaacctccagggcagagtcaccatcgaccacagacacactccaacgacgcgacggcctacactcggacctggaggacgccgtgagatcgtacgacgacgacggccgtagtacttacgtgtcgcgagagagtacgggtaattgtttagacgtcggttacccttgttacgacgttacgtcgggaccgtacgggaccctcggg

SEQ ID NO: 197543 - DNA, 748 bp, Homo sapiens
  misc_feature: GYAE6OF02ILOEE.39.81.H04.1.454.CMB.1.raw
  modified_base (348)..(348): a, c, t, g, unknown or other
  misc_feature (348)..(348): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatgggatcgagcgcttacgaatggtcacgacaaactangacacagaacctcagggcagagtcaccatacgaccacagacacatacccaacgacgaccgaacgaccctaacacgttacgggaacccttaggaacgggtacggaccccgttaggaacggtaacgttaccgtacgggtaacccgaaaccggtaaccggggtccccgtttaacgggttaaaccgttttaccgttaacgggtttacggtaccgggtaagggtaacgggaacgggtttaaccggggggtaaaacgttttaaacggtttttttacggaaacccggttttccggggtttaaaccccccttttaccggttttttaccggaacccggttttaaacccgggtttaccgggggggtaaccccggtaacccggggggttaaaccccccgtttacccggggg

SEQ ID NO: 197544 - DNA, 593 bp, Homo sapiens
  misc_feature: GYAE6OF02JCJPL.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggagtggggatggatcgaggcgcttacaatggtcacaacaaactatgacacagaaccctcgagggcagagtcaccatcgaccacagacacatccacgagcacggcctacagtcggacctggacggacgcctaggacgactcgtacgaaccgacgacgggtaccgttagttacttacgtggtacgacggagacggtagtacggggtaaattaggttttacggacgttacggttacccgtttcgttacgtaccgttacggtcggggtaaccgtacggggtaacccttccggg

SEQ ID NO: 197545 - DNA, 811 bp, Homo sapiens
  misc_feature: GYAE6OF02ISELY.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttggtgcgacaggcccctggacaagggcttgagtggagtgggatggatcgagcgcttacgaatggtacacgaactaaactatcgcacgacgaacctccgagggcagacgtcaccatcgaaccacacgacacctacgtacccaagacgacgaacccggtcctaacggtacgtaccggacgtacgggaacggtcgacccgtaggaacgtacgtaccgtacgggaaccggtaacccggtacccggggtcccggtttaagtttaaccggtttaaccggttaccggggttaacgggtaaacccggggtaaggggaaaccggggtttaacccgggggttaaaccgggggggttttaaaaactttttacgggttttttaaaccccgggttaaacccgggggttttacccccgggttttaaacccccgttttttacccggggtttttaacccgggttaaacccggttttaaccccgggggggttacccggggggttaaacccccggggttaaacccccggggggttaacccccggtttttaaccccgggggg

SEQ ID NO: 197546 - DNA, 611 bp, Homo sapiens
  misc_feature: GYAE6OF02IQZDB.39.81.H04.1.454.CMB.1.raw
  modified_base (323)..(323): a, c, t, g, unknown or other
  misc_feature (323)..(323): n is a, c, g, or t
tcagtcgcactagtcacgaccggtgctcgatttagtagtgtagattcgcggggcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatctaggttggtgcgacacggcccctggacaagggtcttggagtggatgggatggatcgagcgtcttacaagtggtacacgaacaactatnacacagacctacgaggacagactacacatcgaaccaacacgaaccacacgtacccaacgacgccgaaccggacctaacacgtacgggaccgtaggacggacgcctaggacgtacttcgacgacgaccgacggtccgttagtacttcgtgtggacgtaagagtacgtagggtaaatttaggtttacgacgttcggtacctttcgttacgacgttcggtacggggaccgtaaccgggtaacccgtaggttaccctaccgttcctacccgtcgtaccgtccctaaccccgg

SEQ ID NO: 197547 - DNA, 554 bp, Homo sapiens
  misc_feature: GYAE6OF02FJCHS.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttggtgcgacaggcccctggacaagggcttgagtggatgggatggatcagcgcttacaatggtcacacaaactatgcacagaacctcagggcagagtcaccatgaccacagacacatccacgacgcacgcctacatcggacctgacggacgcctgatactctagacgacacgggccgttagtacttacgtgtagcgtagagagtacggggaaattaggttttacgacgttcggttacccttgtttacgaccgttacggtcggggaccgtacggggaccccttcggg

SEQ ID NO: 197548 - DNA, 556 bp, Homo sapiens
  misc_feature: GYAE6OF02HNWWT.39.81.H04.1.454.CMB.1.raw
  modified_base (280)..(280): a, c, t, g, unknown or other
  misc_feature (280)..(280): n is a, c, g, or t
  modified_base (373)..(373): a, c, t, g, unknown or other
  misc_feature (373)..(373): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacnggccctggacaagggctgagtggatgggatggatcgagcgcttacatggtcacacaaactatgcacacgaacctcgaggcagacgtcaaccancgaccacagacacactccaacgacgcaccggcctaacagtacgggacctggaacggagtaccgtgagtatctgaccgaacgccgggtctgtattactggtcgcgagagagtacgggtaatgtttacgacgttcggtacccttcgttagaccgttacgtcggggacctacgggtaccctacggg

SEQ ID NO: 197549 - DNA, 687 bp, Homo sapiens
  misc_feature: GYAE6OF02G83DB.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacacggcccctggacgaagggcttggagtggagtggggatggatcgaggcgtactttacaagtggtacacaacaaaactatgacaacaacgaaccctccgagggcaggacgtcaaccatacgaaccacacgaaccacactaccaacgacgaccgaccggacctaacgacgtacggacctagggaacggacgtcccgtaggaacgtactccgtacggaaccggaaccggtaccgggtacccggttagtttaaccgtttaccggttggtacggacgggtaagggtacggtagggtttaacggggttaaatttacggtttttacggaccggtttaccgggttacccctttacggttttacgtaaccggttaccggggtacggggtaccccggaacggggtaaccccgttcggg

SEQ ID NO: 197550 - DNA, 583 bp, Homo sapiens
  misc_feature: GYAE6OF02HZRJL.39.81.H04.1.454.CMB.1.raw
  modified_base (365)..(365): a, c, t, g, unknown or other
  misc_feature (365)..(365): n is a, c, g, or t
  modified_base (397)..(397): a, c, t, g, unknown or other
  misc_feature (397)..(397): n is a, c, g, or t
tcagtcgcactagtcacgaccggtgctcgatttagtagtgtagattcgcgggggacccaaaaaaccacacccctccttgggagaatcccctagatcacagctcctcaccatggactggacctggagcatccttttcttggtggcgagcgaacaacgaggtgcccactcccaggttcagctggtacaagtctggagctgagatgacgaagcctggggcctcagtgaaggtctcctgccaaaggcttctcggttactaccgtttaccaactatggtatcgagttgggtgcgacgacggcccctggacgaagggtcttgacgtggagtgggagtggatccgagcgcttacagtggtacacacaaactntgacacgagaacctcgaggcagacgtcaccanacgaccacacgacacactccgacgacgccacggccctaacagtacggacctaggacggacgccgtagacgactccgagaccgacgaccggccgtagtactacgtagtcgacgagagacgtacgggaaattgtttacgacgttcggtaccttgttacgacgttacgtcgggacctacgggacctcgg

SEQ ID NO: 197551 - DNA, 658 bp, Homo sapiens
  misc_feature: GYAE6OF02IDDUY.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatgggatcaggcgcttacaagtggtcacacaaactatgcacagaacctcaggcagatcaccatacgaccacagacacataccacgagcacggcctaacgacgtgggaaccctaggaacgggacgacccgtaggacgaacgttccgtacggaccggtaacgacccgggtccggttagtttaacgtttacgttcggtacggccggaaggtacggtaacggttaacgggggtaaaatttacggtttttaacggaaccggtttaccgggtttaacccctttacgttttacggtaaccggttaaccgggttcgggggtaaccccggtaacgggggtaaccccgttacccgggg

SEQ ID NO: 197552 - DNA, 624 bp, Homo sapiens
  misc_feature: GYAE6OF02IMUUG.39.81.H04.1.454.CMB.1.raw
  modified_base (261)..(261): a, c, t, g, unknown or other
  misc_feature (261)..(261): n is a, c, g, or t
  modified_base (328)..(328): a, c, t, g, unknown or other
  misc_feature (328)..(328): n is a, c, g, or t
  modified_base (347)..(347): a, c, t, g, unknown or other
  misc_feature (347)..(347): n is a, c, g, or t
tcagtcgcactagtcacgaccggtgctcgatttagtagtgtagattcgcgggggacccgaaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactntggtatcagttggtgcgacaggcccctggacaagggcttgagtggatgggatggatcgagcgcttanaagtggtcaacacaaactngcacagaacctcaggcagacgtcacatcgaccacagacacgactaccgaacgagcaccggcctacgagtacggacctaggaacggagcccgtagacgtactccgtaggaaccgaaccgtacgggtaccgtaggttaacttaaccgtggttacgccggaagtacggtacgtacgggggtaaaacttggtttttaacggaacgtttccggtaaccccgtttaggtttaccggaaccgttaccggtacgggggtaccctaacgggggtacccttacgggg

SEQ ID NO: 197553 - DNA, 629 bp, Homo sapiens
  misc_feature: GYAE6OF02IJT95.39.81.H04.1.454.CMB.1.raw
  modified_base (346)..(346): a, c, t, g, unknown or other
  misc_feature (346)..(346): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatggggatgggatcgagcgcttacaatggcacacaaatangcacagaacctcgagggcagagtcacatcgaccacagacacactacccgaacgacgacgacggacctacacgtcggaaccgtggaacggacgccgtaggaacgtacgtccgtaggaaccgaaccggaccgggtccggttagttacgtttacgtggtggaccggaaggtaagacgggtaacgggtaaatttaggtttttaacgacggtttaccggttaccctttacggtttacgtaaccgttaccgggtacggggtacccgtaccggggtaacccgttaccggg

SEQ ID NO: 197554 - DNA, 614 bp, Homo sapiens
  misc_feature: GYAE6OF02G0MQX.39.81.H04.1.454.CMB.1.raw
  modified_base (336)..(336): a, c, t, g, unknown or other
  misc_feature (336)..(336): n is a, c, g, or t
  modified_base (356)..(356): a, c, t, g, unknown or other
  misc_feature (356)..(356): n is a, c, g, or t
  modified_base (362)..(362): a, c, t, g, unknown or other
  misc_feature (362)..(362): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggtcttctggttacacctttaccaactatggtatctaggttggtgcgacacggcccctggacgaagggcttggaggtggagtgggatggatcgagcgtacttanaagtggtcaacaacaaactntgacanaacgaacctcgaggcagagtcacatcgaccacagacacactccaacgacgccgaaccggcctaacgacgtacggacctaggacggacgccgtagacgtactcgtaggaccgaaccggccggtaccgttagtacgtttacgtggtcgacggagagtacggttagggtaaatttggtttacgtacgttcggttaaccctttgttacgtaaccggttacggtaccggggtacccggtaagggtacccgttacggg

SEQ ID NO: 197555 - DNA, 631 bp, Homo sapiens
  misc_feature: GYAE6OF02IH9VI.39.81.H04.1.454.CMB.1.raw
  modified_base (123)..(123): a, c, t, g, unknown or other
  misc_feature (123)..(123): n is a, c, g, or t
  modified_base (191)..(191): a, c, t, g, unknown or other
  misc_feature (191)..(191): n is a, c, g, or t
  modified_base (222)..(222): a, c, t, g, unknown or other
  misc_feature (222)..(222): n is a, c, g, or t
  modified_base (415)..(415): a, c, t, g, unknown or other
  misc_feature (415)..(415): n is a, c, g, or t
  modified_base (479)..(479): a, c, t, g, unknown or other
  misc_feature (479)..(479): n is a, c, g, or t
tcagtcgcactagtcacgaccggtgctcgatttagtagtgtagattcgcggggacccaaaaccacacccctccttgggagaatcccctagatcacagctcctcaccatggactggacctggancatccttttcttggtgcagcaacaacaggtgcccactcccaggttcagctggtacagtctggagctgngatgacgaagcctgggcctcagtgagtctcngcagcttctgttactacctttaccatactagtatcagttggtagcgtacgaggccccctaggacaacgggtcttggagttaggagtaggggatcggaactcgtacggctcgtttaacaagttcggtacaacaactaaaacttgcgacacaacggaaccctccgaggacagtaacgtcaacccagtcgacccanacgtaacactacgacccagacgaccgacgtaacctacgagtcggtaacgttcggaggttaaccnccgtagaacgtacgtacgtacgaccgaacgtcggtacccgttagttaccgtcgtaggccgtgaagtcgaagttacgggtaatttggtttacgacgttacggtttaacctgtttacgaacttacgggtcggtaacccctggggacccttcggg

SEQ ID NO: 197556 - DNA, 565 bp, Homo sapiens
  misc_feature: GYAE6OF02GOXCD.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatggggatgggatcgagcgcttacaatggtcacacaaactatgacacagaacctcaagggcaagagtacaccatcgaccacagacacatccacgagcacggcctaacacgtcggacctgaggacgccgtagagatcgtagacgacgaccggccgtagttattactgtgacgagagagtacgggaaattgtttagacgttcggttacccttgtttacggaccgttacggtacggggacccgtacgggtaccccgttacggg

SEQ ID NO: 197557 - DNA, 574 bp, Homo sapiens
  misc_feature: GYAE6OF02H2B0A.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggagtgggatgggatcgagcgcttacaatggtcaacacaaactatcgacacaagaacctccgagggcagacgtcaccatgaccacagacacactccaacgagcacggcctacgatcggacctggacggacgcctgacgtactcgtagaccgacgaccggaccgttgttaacttacgttggtcgcggagagaggtacgggtaaattggttttgacgttcggttacccttgtttacgacgttacgtcgggggtacctacggggtaccctcggg

SEQ ID NO: 197558 - DNA, 658 bp, Homo sapiens
  misc_feature: GYAE6OF02GSDYP.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgctacatggcacacaactatgacacagaacctcgagggcagagtcaccatcgaccacgacgacacactccacgacgaccacggacctacgagtacggacctaggacgggacgccgtagacgtactacgtacggaaccggaaccgtaccgggtaccgttaggttaacgtttaccgttcggttacggaaccggtaagtacgggtaacggttaaccgggggtaaaattttaacggttttacggaaccgtttaccgggtttaaccccgtttacggttttacggtaaccggtttaaccggtaccggggggtacccgtaaccgggggtacccccgttaccgggg

SEQ ID NO: 197559 - DNA, 581 bp, Homo sapiens
  misc_feature: GYAE6OF02HM56Z.39.81.H04.1.454.CMB.1.raw
  modified_base (345)..(345): a, c, t, g, unknown or other
  misc_feature (345)..(345): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacaccttttaccaactatggtatcagttgggtgcgacaggcccctggacaagggcttgagtggatgggatgggatcgagcgcttacaatggtcacacaaatntgacacagaacctcgagggcagacgtcaccatcgaccacagaccacactacccaacgacgacacggcctaacactacggacctaggacggagcctagagatctagacgacgacggaccgtagtacgttacgtgtgaccgaagagacgtacggggtaaattacgttttagacgttacggttacccgttcgtttacgacgttaccggtacggggtaccgtacgggtacccgttacggg

SEQ ID NO: 197560 - DNA, 684 bp, Homo sapiens
  misc_feature: GYAE6OF02H8XUZ.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacaccttttaccaatatggtatcagttgggtgcgacacggcccctggacaagggcttgaggttggatgggatggatcgagcgcttaacaagttggcaacaacaaactatgacacaagaaccctcgagggcaggagtcaaccatcgaccaacacgaacacactccaacgacgaccgacggacctacaacgtacggacccgtaggaacgggacgaccgtacgtaacgacgtaccgtacggaaacccgaacgtacccgggtacccgttaaggttaactttaaccgtggtacggaccggtaaggtaacggtaacggttaaccgggggtaaatttaacgttttacggtaaccgtttaccggtttaaccccttttcggtttaacgtaaccggttaaccgggttacccgggggtacccgtaaccgggggttaacccccgttaccgggg

SEQ ID NO: 197561 - DNA, 616 bp, Homo sapiens
  misc_feature: GYAE6OF02FQQEB.39.81.H04.1.454.CMB.1.raw
  modified_base (407)..(407): a, c, t, g, unknown or other
  misc_feature (407)..(407): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggccctggacaagggcttgagtggatgggatggatcagcgcttacaattggtacacacaaactatgcacagaacctcgagggcagacgtcacatcgaccacagacacactccacgagcacggcctanacgtgacctggaacggacgccgtaggagtactccgtacggaaccggaccgaccggtcccggttagttaaccgtttacgtcggtcgaccggaaggtaggtacggttaacggggtaaatttgttttacggaccgtttacgggttaaccccttggttttacggtacgttaaccgggtacgggggtacccgtaacggggtaccccgttacggg

SEQ ID NO: 197562 - DNA, 599 bp, Homo sapiens
  misc_feature: GYAE6OF02H2U1M.39.81.H04.1.454.CMB.1.raw
  modified_base (324)..(324): a, c, t, g, unknown or other
  misc_feature (324)..(324): n is a, c, g, or t
  modified_base (405)..(405): a, c, t, g, unknown or other
  misc_feature (405)..(405): n is a, c, g, or t
  modified_base (483)..(483): a, c, t, g, unknown or other
  misc_feature (483)..(483): n is a, c, g, or t
tcagtcgcactagtcacgaccggtgctcgatttagtagtgtagattcgcgggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttggtgcgacacggcccctggacaagggtcttgagtggatgggatggatcagcgnttacaagtggtcacgacaaactatgcacagaacctccagggcagagtacaccatacgaccacgagacacactccaacgacncgacggcctacacgtggacctggaggcgacctggagtactcgtacgaccgaactacgggccgttagttaactttacgnggttagccggtaagagtaacggttacgggggtaaatttacgtttttacgaacggtttcggttaaccccgtttgtttacgaccgttaaccggtcgggggtacccacggggtaacccg

SEQ ID NO: 197563 - DNA, 577 bp, Homo sapiens
  misc_feature: GYAE6OF02H7MIA.39.81.H04.1.454.CMB.1.raw
  modified_base (323)..(323): a, c, t, g, unknown or other
  misc_feature (323)..(323): n is a, c, g, or t
  modified_base (342)..(342): a, c, t, g, unknown or other
  misc_feature (342)..(342): n is a, c, g, or t
  modified_base (372)..(372): a, c, t, g, unknown or other
  misc_feature (372)..(372): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcgagtgaaggtctcctgcgaaggcttctggttacaccttttaccaatatggtatcagttgggtgcgacaggcccctggacaaggcttgagtggatggatggatcgagcgntacatggtacacacaaatntgcacagaacctcgaggcagacgtcactangaccaagagacacactaccaacgacgacacggacctaacgaacgtggaacctaggaacggacgtcgtgaagataccgtagaaccgaacgaccggtccgtagttacttagtggtacgacgagaacgaggtacgggtaattacgtttagacgtacggttacccttgttacgtacgtacggttacggggcctaacgggtaccctacgg

SEQ ID NO: 197564 - DNA, 769 bp, Homo sapiens
  misc_feature: GYAE6OF02H8E2Q.39.81.H04.1.454.CMB.1.raw
  modified_base (353)..(353): a, c, t, g, unknown or other
  misc_feature (353)..(353): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaatatggtatctagttgggtgcgacgaggcccctggacaagggcttggagtggatgggatggatcgagcgtctacaagtggtcaacgaactaaacgtntgacacgaacgaaccctacgagggaccaagacgttccaacctataccgaccaacgaacgtaccgaacacgtacccaacggacgacccgaaccggtccctaacgacgtacggtaaccgtacgggaacgggaccgtacccgtagaaccggtaacgttacccgtacgggtaaacccgaacccgggtaacccgggttacccggttaagtttaaacccgggttttaacgttacgggtacggtaaaccggtaagggtaacggttaacgggttttaaaggggggtttaaaactttaaccggttttttaggtaaccgggtttacccggttttaaaccccgttttcggtttaaccgggttaacggttaacccgggttaccgggggtaacccggttaacccggggttaaccccgtttaacccgggg

SEQ ID NO: 197565 - DNA, 573 bp, Homo sapiens
  misc_feature: GYAE6OF02HGQAK.39.81.H04.1.454.CMB.1.raw
  modified_base (343)..(343): a, c, t, g, unknown or other
  misc_feature (343)..(343): n is a, c, g, or t
tcagtcgcactagtcacgaccggtgctcgatttagtagtgtagattcgcgggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcgagcgcttacatggtacacacaaactntgacacgacgaacctcgagggcagacgtacaaccatcgaccacagacacactccacgagcacgcctacagtcggaccctggacggacgcctaggaacgtatcctaggaccgaccgaccgggccgttaggtacttacgtgtagcgagagacgtaggggtaaattggtttagacgttcggtacccttgtttacgaccgttacggtcggggaccctaggggtaacccctcggg

SEQ ID NO: 197566 - DNA, 533 bp, Homo sapiens
  misc_feature: GYAE6OF02GWRXO.39.81.H04.1.454.CMB.1.raw
  modified_base (497)..(497): a, c, t, g, unknown or other
  misc_feature (497)..(497): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactatgcacagaacctcagggcagagtcacatgaccacagacacatccacgagcacggcctacatcggacctgaggacgcctagagatcgtgacgacacggccgtgtacttacgtgtcgacgagagagtacggggaatagtttgacgtggttaccctntttacgacgttacgtcggggccagggtacccgtcgg

SEQ ID NO: 197567 - DNA, 587 bp, Homo sapiens
  misc_feature: GYAE6OF02I2V3I.39.81.H04.1.454.CMB.1.raw
  modified_base (322)..(322): a, c, t, g, unknown or other
  misc_feature (322)..(322): n is a, c, g, or t
  modified_base (362)..(362): a, c, t, g, unknown or other
  misc_feature (362)..(362): n is a, c, g, or t
tcagtcgcactagtcacgaccggtgctcgatttagtagtgtagattcgcggggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactatgcacagaacctccagggcagagtcaccatcgaccanagacacatccacgagcacggcctacatcggacctgaggancctgacgatcgtgacgacacggccgtgtacttcgtagtcgcgagagacgtacggggaaattagtttgaacttcgggtaacccttctttacggaccttacgtggggtacccaaggggtaccctgggtacctaccgtctaccttccgacgtccctaccaccgaaacgggcccctaagttcccgggttccctttcccccgtcggtaccccaccccgtccctaacccgg

SEQ ID NO: 197568 - DNA, 601 bp, Homo sapiens
  misc_feature: GYAE6OF02FQFMC.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggagtgggatggatcgaggcgcttacaagtggtcacgaacaaactatgcacacgaacctcgagggcagacgtcacatcgaccacagacacactaccacgacgccgaccggcctaacgagtacgggaccctaggaacgggacgccgtagacggtactcggtacgaacggtaccgacgggtccgttagtacgtttactggtacggcgaagtaggaggttaacggggaaatttgtttacggacgttaccggttacccttgtttacgacgttaccggtcggggccaaccgggtaccgtcggg

SEQ ID NO: 197569 - DNA, 650 bp, Homo sapiens
  misc_feature: GYAE6OF02I88E9.39.81.H04.1.454.CMB.1.raw
  modified_base (227)..(227): a, c, t, g, unknown or other
  misc_feature (227)..(227): n is a, c, g, or t
  modified_base (273)..(273): a, c, t, g, unknown or other
  misc_feature (273)..(273): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtgggcctcagtgaagtctcngcaggcttcgtggttacctaccttacactatggtatcgtagttggngcgacgcggtccctaggacgagggtcttggagtcggagtgggatggactcgagcgtacttaacgaagtcggtacacaacgtaaactcgtagctaaccgaacgtaaccctacgagggacagacgtaccgacgtataccgaccacgtacgactaacgactacccgaacgacgaccgaccggtacctaacgtacgtcgaccgtaggacgacgtcgtagacgtacgtcgtacgacggtaccgtaccggtacgttagttacgttacgtcggtagacgagttacggacggttagggttaaagttcgtttaacggacgttaccggttacccgttaggtaccgttaccggtacggtccgggttaccggacgggttacccttcggg

SEQ ID NO: 197570 - DNA, 565 bp, Homo sapiens
  misc_feature: GYAE6OF02ICRPS.39.81.H04.1.454.CMB.1.raw
  modified_base (381)..(381): a, c, t, g, unknown or other
  misc_feature (381)..(381): n is a, c, g, or t
tcagtcgcactagtcacgaccggtgctcgatttagtagtgtagattcgcgggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcgagcgcttacaatggcacaacaaactatgacacagaacctccgaggcagagtcaccatcgaccanacgacacactccacgacgcgacggcctacagtcggacctaggacggacgccgtgacgtatcgtgaccgacgaccggtccgtagttacttactggtgacgagagagtacgggtaattagtttacgacgttcggttacccttgtttacgacttacggtacggggaccctacggggtaccctacggg

SEQ ID NO: 197571 - DNA, 642 bp, Homo sapiens
  misc_feature: GYAE6OF02HHDO8.39.81.H04.1.454.CMB.1.raw
  modified_base (316)..(316): a, c, t, g, unknown or other
  misc_feature (316)..(316): n is a, c, g, or t
  modified_base (386)..(386): a, c, t, g, unknown or other
  misc_feature (386)..(386): n is a, c, g, or t
  modified_base (454)..(454): a, c, t, g, unknown or other
  misc_feature (454)..(454): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctgggcctcagtgaaggtctcctgcaaggcttctggttacacctttacaactatggtatcagttgggtgcgacaggcccctggacaagggcttgagtggagtgggatggatnagcgcttacaatggtacacacaaactatgacaacagaacctccgaagggcagacgtcaaccatcgaccanacgacacaactccgaacgacgacgtaccgcctaacagtcggaacctggacggagcctagagtataccnggaccgaaccgtacggccgttagtaacgtttaccgtgggttcgaccggtaagtaacgggtagttaaccggggggtaaaattttacggttttacggaaacgtttcccggttaacccgtttacggttttacggtaacccgttacggtttacccgggggacccttaaccggggggaacccctttaccgggg

SEQ ID NO: 197572 - DNA, 591 bp, Homo sapiens
  misc_feature: GYAE6OF02GFJMW.39.81.H04.1.454.CMB.1.raw
  modified_base (345)..(345): a, c, t, g, unknown or other
  misc_feature (345)..(345): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatggggatggatcagcgcttacaatggtacacacaaactntgcacagaacctcgagggcagagtacacatcgaccacagacacactaccacgacgcaccggcctacactcggaccctggaacggacgcctggacgtactccgtgaaccggacgaccgggccgttagttacttacgtggtgaccgaagacgtagtaacggggtaaatttagttttacgaaccgttcgggttacccttacgtttacgaccgttaccggtacggggtaccgtacggggtaccctacggg

SEQ ID NO: 197573 - DNA, 621 bp, Homo sapiens
  misc_feature: GYAE6OF02G1J8E.39.81.H04.1.454.CMB.1.raw
  modified_base (324)..(324): a, c, t, g, unknown or other
  misc_feature (324)..(324): n is a, c, g, or t
  modified_base (346)..(346): a, c, t, g, unknown or other
  misc_feature (346)..(346): n is a, c, g, or t
  modified_base (352)..(352): a, c, t, g, unknown or other
  misc_feature (352)..(352): n is a, c, g, or t
  modified_base (361)..(361): a, c, t, g, unknown or other
  misc_feature (361)..(361): n is a, c, g, or t
  modified_base (381)..(381): a, c, t, g, unknown or other
  misc_feature (381)..(381): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggttctcctgcaaggcttctggttacacctttacaactatggtatcagttggtgcgacaggcccctggacgaagggcttgagtggatgggatggatcagcgnttacaagtggtcacacaaactntgacanaacgtaccncgagggcaagagtcaactancgacctagagacacgatccgaagacgctacggcctaacaagtcggaacctggaacggacgaccgtgacgatctacggaacggacgaccggtccggttagtagtttaacgtctaggccgaaggtacgtacggttacggggaaaattttcttttaagggacccttacggggttaccccttacgtttaggtaaccctttaaggggtacccggggtaaccgtaccggggtaacccttaccgggg

SEQ ID NO: 197574 - DNA, 572 bp, Homo sapiens
  misc_feature: GYAE6OF02HMUFC.39.81.H04.1.454.CMB.1.raw
  modified_base (432)..(432): a, c, t, g, unknown or other
  misc_feature (432)..(432): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacaccttttaccaactatggtatcagttgggtgcgacaggcccctggacaaggggcttgagtggatggggatgggatcgagcgcttacaatggtcacacaaactatgacacagaacctcgagggcagacgtcaccatcgaccacagacacatccacgagcacggcctacactacggacctgaagggacnccgtagacgataccgtgaaccgacgaccggccgttagtacttactgtagcgagagacgtacgggtaaattcgtttacgacgttcggttaacccgttgtttacggacttacggtacggggacctacggggacccgttcggg

SEQ ID NO: 197575 - DNA, 618 bp, Homo sapiens
  misc_feature: GYAE6OF02JWOW9.39.81.H04.1.454.CMB.1.raw
  modified_base (280)..(280): a, c, t, g, unknown or other
  misc_feature (280)..(280): n is a, c, g, or t
  modified_base (330)..(330): a, c, t, g, unknown or other
  misc_feature (330)..(330): n is a, c, g, or t
  modified_base (350)..(350): a, c, t, g, unknown or other
  misc_feature (350)..(350): n is a, c, g, or t
  modified_base (442)..(442): a, c, t, g, unknown or other
  misc_feature (442)..(442): n is a, c, g, or t
tcagtcgcactagtcacgaccggtgctcgatttagtagtgtagattcgcggggcacccaaaaaccaacaacccctccttcgggagaatcccctacgatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttcgtggttacacctttacacttatggtatcagttgggtncgacaggcccctggacagggcttgagtggatggatgatcgagcgctttanaagtggtcacgaacaaactntacgacaacacgtaacctccgagggacacgagttccgaacatacgaaccacgaacgaactacacgtaccacggtaacgcgaccgtcccaacncgtacggaccttacggaggtacgccgtagagactctaggacgacgaccggcgtacggttactacgtgtcgagacgtagacggtacggggtaaattagttttaacggacgtttacgggttacccttacggttttacggaccgtttacggtacggggtacccgtaacggggtaccccg

SEQ ID NO: 197576 - DNA, 608 bp, Homo sapiens
  misc_feature: GYAE6OF02IN3BM.39.81.H04.1.454.CMB.1.raw
  modified_base (347)..(347): a, c, t, g, unknown or other
  misc_feature (347)..(347): n is a, c, g, or t
tcagtcgcactagtcacgaccggtgctcgatttagtagtgtagattcgcgggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttcgtggttacacctttaccaactatggtatcgagttgggtgcgacacggcccctggacaagggcttggagtggatgggatggatcgagcgcttacatggcacacaaactntgacacagacctccgaggcagactcacatcgaccacagacacactaccacgagacgacgacatacgatacggactaggacggacgccgtagacgtactcgtacggaccgacggaccggtaccgttaggtaacgttaccgtagtacgacgaagacgggtaagttacggggtaaactttagtttacggtaacgttaccggttaaccctttccgttttacggtacccgttacggtaccggggtaccgtaaccggggttaacccg

SEQ ID NO: 197577 - DNA, 659 bp, Homo sapiens
  misc_feature: GYAE6OF02JXAPO.39.81.H04.1.454.CMB.1.raw
  modified_base (414)..(414): a, c, t, g, unknown or other
  misc_feature (414)..(414): n is a, c, g, or t
  modified_base (538)..(538): a, c, t, g, unknown or other
  misc_feature (538)..(538): n is a, c, g, or t
tcagtcgcactagtcacgaccggtgctcgatttagtagtgtagattcgcggggacccgaaaaaccacacccctccttgggagaatccctagatcacagctcctcaccatggactggacctggagcatccttttcttggtggtcagcaacaacaggtgcccactcccaggttcagctggtacagtctggagctgagatgacgaagcctggggcctcagtgaaggtctcctgcaggcttctggttacacctttacaactatggtatcagttggtgcgacgacggccctaggacagggtcttggagtggagtggatggatcgagtcgctagatggtacacaacgaaactgtagacgacaacgtaaccgtccgagggcagacgtacaccgatacgaccacagactacgatcccgaagngaccgaaccggtcctaagacgtacggaccctagggacggacgacccgtaggaacgtacgtcggagaaccggacgtaccgggtacccgtagttaacgtttacgacggttcggacgggttaaccgngggttacggtaacgggggttaaactttaggttttaccggaccgttaccgggtttaacccctttagttttacggaccgttaccgggttaccgggggacccgtacggggtaacccccttcggg

SEQ ID NO: 197578 - DNA, 662 bp, Homo sapiens
  misc_feature: GYAE6OF02G7SV6.39.81.H04.1.454.CMB.1.raw
  modified_base (362)..(362): a, c, t, g, unknown or other
  misc_feature (362)..(362): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagatgagatgacgaagccgtggggcctcgagtgaaggtctcctgcaaggcttctggttacacctttaccaactatggtatcgtaggttgggtgcgacgacggccccgtggacgaagggtcttggaggtggagtgggatggatcgagcgacttacgaatcggtacacaacaaactntcgactacacgaacctcgaggcagacgtacacatcgaaccacgacgacacactaccaacgacgaccgaccgcctaacgacgtacggacctagggaacggacgtaccgtaggaacgtacgtaccgtacggaaccggaaccggtaccgggtccgttaggttaactttacgtggtacggacggaaggtaggtacggtaacggggttaaatttcggttttacggaccgttaccgggttaccctttacggttacgtaccggttaaccgggtcggggtaacccggtaacggggtaccccgttcggg

SEQ ID NO: 197579 - DNA, 595 bp, Homo sapiens
  misc_feature: GYAE6OF02FLTMC.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgtcttacaatggtacacaacaaactatgacacacgaacctccgaagggcaggactcaccatacgaccacacgacacactccacgacgccgaccggcctaacagtcggaccgtaggacggacgcctagacgatcgtagaccgacgacgggtccgttaggtacttacgtggtcgagagagtagtaacggggtaatttacgtttaggacgttacggttacccttacgtttacgtaccgttaccggtcggggtacccgtacggggtacccgttaccggg

SEQ ID NO: 197580 - DNA, 642 bp, Homo sapiens
  misc_feature: GYAE6OF02I0ZA3.39.81.H04.1.454.CMB.1.raw
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacaggccctggacaagggcttggagtggagtgggatggatcgagcgcttacgaatggtacacacaaactatgcacagaacctccagggcagagtcaccatcgaaccacagacacactaccgacgagcgacggccaacacgtacggaccctaggaacggacgccgtgaacgactccgacgaaccggaaccgaccgggtcccgttaggttaacttttaccggtaggttacggaaccggaaggtaaggtacgggttaaacgggggtaaaatttcggtttttaacggaaccggtttcgggttaacccctttcgttttacgaccgtttaaccggtccggggaacccggttaacggggaccccgttacggg

SEQ ID NO: 197581 - DNA, 626 bp, Homo sapiens
  misc_feature: GYAE6OF02GEQY8.39.81.H04.1.454.CMB.1.raw
  modified_base (280)..(280): a, c, t, g, unknown or other
  misc_feature (280)..(280): n is a, c, g, or t
tcagtcgcactagtcacgaccggtgctcgatttagtagtgtagattcgcgggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcganacggcccctggacaagggcttgagtggatgggatggatcgagcgcttacagtggtcacgaacaaactatgacacaagaacctcgagggcagagtccaacatacgaaccacagaccacgactacccgaacgtacgacgaccgcctaacagtacggacctaggaggacgtccgtagacgtacgtccgtacgtaacgaacgtaccgggaccgttaggttaacgttacgtgtacggacggaagaggacgttaacggggtaaatttaggtttacgtacggttaccggttacccgtttcgtttacggaccgtttacgggtccggggtaccgtacggggtacccgttaccggg

SEQ ID NO: 197582 - DNA, 639 bp, Homo sapiens
  misc_feature: GYAE6OF02I2FCX.39.81.H04.1.454.CMB.1.raw
  modified_base (240)..(240): a, c, t, g, unknown or other
  misc_feature (240)..(240): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtctctgcaaggtcttntcggttacacctttaccaactagtggtaatcgtagttgggtgcgacacggccccgtggaacgaagggtcttagaggttggagtgggatggatcgagcgcttacaagtggtcacgaactaaatcgtagacaacacgaacctccgagggacgagacgtacaccatacgacccaacgaagacctaacacgtaccgaaacgtacgaccgaccggacctaacgagtacggtaaccgtcggaacggtacgcccgtagacgtactcgtacgacggtacaccggtacgtagtacttacgtggtacgacgagacgacgtaacgggtaattaggtttacgtacggttacgttaccgttcgtttaacggaccgttaccgggtcgggaaccggtaccggtaacccgttcgg

SEQ ID NO: 197583 - DNA, 542 bp, Homo sapiens
  misc_feature: GYAE6OF02JGEXW.39.81.H04.1.454.CMB.1.raw
  modified_base (344)..(344): a, c, t, g, unknown or other
  misc_feature (344)..(344): n is a, c, g, or t
  modified_base (432)..(432): a, c, t, g, unknown or other
  misc_feature (432)..(432): n is a, c, g, or t
  modified_base (440)..(440): a, c, t, g, unknown or other
  misc_feature (440)..(440): n is a, c, g, or t
  modified_base (468)..(468): a, c, t, g, unknown or other
  misc_feature (468)..(468): n is a, c, g, or t
  modified_base (471)..(471): a, c, t, g, unknown or other
  misc_feature (471)..(471): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgtcttacaatggtcacacaaactntgacacagaacctcgagggcagacgtacaccagtcgaccacgagacacactccacgagcacggcatacagtcggacctaggacggacncctgacgntcgcgacgacgacggtctagtattacgnggngacgagaggtagtacgggtaaattgtttgacgttcgtaccttgttcgacttcggcgggtaccaggtacccg

SEQ ID NO: 197584 - DNA, 641 bp, Homo sapiens
  misc_feature: GYAE6OF02G7DXL.39.81.H04.1.454.CMB.1.raw
  modified_base (278)..(278): a, c, t, g, unknown or other
  misc_feature (278)..(278): n is a, c, g, or t
  modified_base (328)..(328): a, c, t, g, unknown or other
  misc_feature (328)..(328): n is a, c, g, or t
  modified_base (348)..(348): a, c, t, g, unknown or other
  misc_feature (348)..(348): n is a, c, g, or t
  modified_base (354)..(354): a, c, t, g, unknown or other
  misc_feature (354)..(354): n is a, c, g, or t
tcagtcgcactagtcacgaccggtgctcgatttagtagtgtagattcgcgggggacccgaaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttcgtgttacacctttaccaactatggtatctagttggngcgacacggcccctggacaagggcttgagtggagtgggatggatcgagcncttacaatggcacacaaatntgacanacgacctcgaggcagatcacatcaccacacgacacactaccgaacgacgaccaaccggcctaacgacgtacgggaccctaggaacggtacgaccttggactactcgtacgaccgtaaccgaccggtacgttaggttaacttcggttaggtacggacgtaaggagggtaacgggttaacggggtaaattttacggttttacggaaccggtttaccggttaacccctttgtttaccggtaccgttaccgggtcccggggtaacccgtaccggggtaacccgttaccggg

SEQ ID NO: 197585 - DNA, 623 bp, Homo sapiens
  misc_feature: GYAE6OF02IGWRW.39.81.H04.1.454.CMB.1.raw
tcagtcgcactagtcacgaccggtgctcgatttagtagtgtagattcgcgggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttggtgcgacacggcccctggacgagggcttgagtggagtgggatggatcagcgtcttacaagtggtcacacaaactatcgacacagaacctccgagggcagacgtcaccatcaccacagacacacgtaccgagacgaccgaccggtcctaacgacgtacggaccgtggaacggacgtacccgtgaacgtacgtacgagaccgaaccgtacgggtaccgttagttaacttacgtggtcggacgagtaaggtacgtaacgggtaaactttggtttacggtaaccgttaccgggttacccttacggtttacgaaccgttacgggtaccgggtaccggtaccgggtacccgttacggg

SEQ ID NO: 197586 - DNA, 1008 bp, Homo sapiens
  misc_feature: GYAE6OF02HJK45.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtcgcccactcccaggttcagctggtacagtctggagctgagatgacgaagcctggggcctcgagtcgaaggtctccgtgacaagtcttctgttacacctttaccaactagtggtatcgaggttgggtcgcgacgacggccctaggacaagggtcttagagtggagtgggatggatcgacggcgtacttacaagttggtacacggggttttaaaaccccggttaaaaccggtttaaccgggttaacccgggttaaacccggtttaaacccggttaaacccgggtttaaacccggttaacccgggttaaaccggggttaaccggttaaaccgggttaaccggttaacccggttaaacccggttaaccggttaaccgggttaaacccggttaaccggttaaccggttaacccggttaaccggttaaaccggtttaacccggtaaaccgggttaaccggtaacccgggttaacccgggttaacccgttaaaccgggttaaccgggttaccgggttaacccggttaacgggttaacccgggttaaccgggttaacccgggttaacgggttaaaccggttaccggtttaacccgggttaaccgggttaaacccgggttaacccggttaacccgggttacccgggtttaacggttaacccgttaccgggtttaaccggttaaccgggtaaccggttaaccgggttaaccggttaccgggttaaccggggttaaaccgtttaccgggtttaacccgggtaaccggtttacccgggtttaacccgttacggtttaacccggtaaccggttaacccgggttaaccggggtaacccgttaacccgggttaacccggttaaccggg

SEQ ID NO: 197587 - DNA, 602 bp, Homo sapiens
  misc_feature: GYAE6OF02H1T48.39.81.H04.1.454.CMB.1.raw
  modified_base (309)..(309): a, c, t, g, unknown or other
  misc_feature (309)..(309): n is a, c, g, or t
  modified_base (363)..(363): a, c, t, g, unknown or other
  misc_feature (363)..(363): n is a, c, g, or t
tcagtcgcactagtcacgaccggtgctcgatttagtagtgtagattcgcggggcccctagatcacagctcctcaccatggactggacctggagcatccttttcttggtggcagcaaacaacaggtgcccactcccaggttcagctggtacagtctggagctgagatgacgaagcctggggcctcagtgaggtctctgcaggcttctggttacactttacaactatggtatcagttgggtgcgacaggccctggacaagggcttgagtggatgggatggatcagcgcttacaagtggtcacgacaaactntgcaacagaacctcagggcagacgtcaccatcgaccacagtacacatccacgancacggcctacatcggacctaggacgacgcctagacgtattcgacgacgacgacgggaccgtagtaataccgttagtcgacgacgagaacgtacggggtaaattcgttttagacgttacggttacccttacttttacggtaccgttaacggtcgggggtaccctaacggggtaaccccgttcgggttacccgtacccggttacccgttacccgttaccgtaccgtccccgttaaccccgg

SEQ ID NO: 197588 - DNA, 626 bp, Homo sapiens
  misc_feature: GYAE6OF02JPJYV.39.81.H04.1.454.CMB.1.raw
  modified_base (329)..(329): a, c, t, g, unknown or other
  misc_feature (329)..(329): n is a, c, g, or t
  modified_base (347)..(347): a, c, t, g, unknown or other
  misc_feature (347)..(347): n is a, c, g, or t
  modified_base (460)..(460): a, c, t, g, unknown or other
  misc_feature (460)..(460): n is a, c, g, or t
tcagtcgcactagtcacgaccggtgctcgatttagtagtgtagattcgcggggacccaaaaccacaccctccttgggagaatccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcgagttggtgcgacacggcccctggacaagggtcttaggagtggagtgggatgggatcgagctcgtanagtggtcaacacaaactncgacacagaacctcgagggcacggatccgaaccagtacgaccgaacacggacaacgactacccaacgacgaccaacggccttaacgacgtcggacccgtaggacgacgtccgngtaagacgtctacggaccgaaccgtccggaccgtacggttacttaccgttggacgtacgacggtacgagggttacgggtaaacgtttcggtttacgtacggttacggttacccttcggtttacgtacggttaccgtaccgggggtactaccgggtaacccttcggg

SEQ ID NO: 197589 - DNA, 573 bp, Homo sapiens
  misc_feature: GYAE6OF02FXRV5.39.81.H04.1.454.CMB.1.raw
  modified_base (423)..(423): a, c, t, g, unknown or other
  misc_feature (423)..(423): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcgagcgcttacatggtcacacaaactatgcaacagaacctccgagggcagacgtcaccgatcgaccacagacacactaccaccgagacacggcctacagtcggaccnggaggacgcctacgagtactcgtacgaccgacgacggccgtagtaacttacgtgtcggcgagagagtacggggaattagtttagacgttacggttacccttcgtttacgacgttaccggtcggggtaccgtacggggtacccgttacggg

SEQ ID NO: 197590 - DNA, 543 bp, Homo sapiens
  misc_feature: GYAE6OF02GCO1X.39.81.H04.1.454.CMB.1.raw
  modified_base (416)..(416): a, c, t, g, unknown or other
  misc_feature (416)..(416): n is a, c, g, or t
  modified_base (421)..(421): a, c, t, g, unknown or other
  misc_feature (421)..(421): n is a, c, g, or t
  modified_base (425)..(425): a, c, t, g, unknown or other
  misc_feature (425)..(425): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttggagtggatgggatggatcagcgtcttacaatggtacacacaaactatgcacagaacctcaggcagagtcacatgaccacagacacataccacgagcacggctacatcgacctgagngctgnatcngacgacgacggccgtgtacttactgtgcgtagagagtacggggtaaattgtttacgacgttacggttacccttattttacggacttacggtcggggaccgtacgggtacccgttacgg

SEQ ID NO: 197591 - DNA, 699 bp, Homo sapiens
  misc_feature: GYAE6OF02HHMLY.39.81.H04.1.454.CMB.1.raw
  modified_base (258)..(258): a, c, t, g, unknown or other
  misc_feature (258)..(258): n is a, c, g, or t
  modified_base (387)..(387): a, c, t, g, unknown or other
  misc_feature (387)..(387): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacacaggtgcccactcccaggttcagctggtacagtctggagctggagatgacgaagccgtggggcctcgagtggaaggtctcctgcagcttctggttacacctttacactntggtatctaggttgggtcgcgacgacggcccccgtaggacgaaggggtccttggacggttaggaggttgggaagtgggactacgaggccgtacgtttaacgaagttcggtaccacgaactaaaacgttntacggacaacgaacgaaccctccgacggggacaagggactacgacgactaggaacccagaacgtacaacactaccgaacacgacaccggacctaacgacgtacggaacctagggaacggaccggaccgttacggacgtaacgtccgtaacgtaccggaaccgtacccgggtaccggttacgtaacgtttcgtcggtacgaccggtagaggtagtagtacgtaaccgttactttccgtaacgttacggttacgggttacgggggttaacttaaggttacggtttacggttaccggtacccggttaacccgggg

SEQ ID NO: 197592 - DNA, 619 bp, Homo sapiens
  misc_feature: GYAE6OF02JXZ55.39.81.H04.1.454.CMB.1.raw
  modified_base (283)..(283): a, c, t, g, unknown or other
  misc_feature (283)..(283): n is a, c, g, or t
  modified_base (359)..(359): a, c, t, g, unknown or other
  misc_feature (359)..(359): n is a, c, g, or t
  modified_base (369)..(369): a, c, t, g, unknown or other
  misc_feature (369)..(369): n is a, c, g, or t
  modified_base (450)..(450): a, c, t, g, unknown or other
  misc_feature (450)..(450): n is a, c, g, or t
tcagtcgcactagtcacgaccggtgctcgatttagtagtgtagattcgcggggacccgaaaaaccaacacccctccttcgggagaatccctagatcacagctcctcaccatggactggacctggagcatccttttcttggtggtcagcaacaacaggtgcccactcccaggttcagctggtacagtctggagctgagatgacgaagcctggggcctcgagtgaaggtctcctgcaaggcttctggttaccaccgttttacaacgtatggtaatctagttgggngtcgacaggccctggacagggcttgagtggatggggatggactcgagcgtcttaacaagtcggtcataaccaaatntgacaacganaacctcgagggcagagtcaactatccggaccaagcgaacacactaccgacgtagaccaacggcctacagcggactgacggngactgagacgtcctacggaaccgacgtaccggaccggttagtacgtttaccgtcggttacgacggtaacggaacgagggtacgggttaaactaagttttacggacgttacggtaccttcggttacgtacgtacggttaccggggaaccgtacggggtaacccttacggg

SEQ ID NO: 197593 - DNA, 719 bp, Homo sapiens
  misc_feature: GYAE6OF02HNBZE.39.81.H04.1.454.CMB.1.raw
tcagtcgcactagtcacgaccggtgctcgatttagtagtgtagattcgcggggacccgaaaaaccaacacccctccttcgggagaatcccctagatcacagctcctcaccatggactggacctggagcatccttttcttggtggcagcaacaacaggtgcccactcccaggttcagctggtacagtctggagctgagatgacgaagccgtgggggcctcgagtgaaggtctctgcgaaggcttctggttactaccttttaccaacttactggtatctaggttggtgacgagacggtccccgtgggaactacgggccttaggacggtggagttgggagtggatcgagtccgtacttacgaagtcggtacacaactaaacgtatgacacgtaacgtaaccctccggaagggtacccaaggtaaccgtaccgaaaccctagtaaccggaacccaaaccgacggaaccctaaccgtaccgtaacccgaacggaaccgaccgaacccgggactaaccgagttaccgggactagggaacggtcgccgtagtagactcgtaagaccgtaacgcccgggtacggtattaccgtagtcggtagaccggttaaggaggtaccgggtaacggggtaatttacgtttagggtacttacccgggtttacccctttaggtttccgtaacgttcgggttaccggggggtaccctacgggttacccccggtaggg

SEQ ID NO: 197594 - DNA, 834 bp, Homo sapiens
  misc_feature: GYAE6OF02H23VU.39.81.H04.1.454.CMB.1.raw
  modified_base (362)..(362): a, c, t, g, unknown or other
  misc_feature (362)..(362): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcattccttttcttggtgcagcaacaacgaggtcgcccacctcccgaggttcagctggtacagtctggagctgagatgacgaacgccgtggggcctcgagtgaacggttctccgtgacgaaggtcttcgttcggttacctacctttaccaactagtggtatcgtaggttgggtgccgacgacggccccgtagggaaccgagggtcgttaggacggtggagttgggagtaggactacgngccggtacttaacgaagttcggacacaaactaacgtacgtcgaccaacgacgtaaccccgtacgagggacaacggtacgtaccaaccgtagtaccgaaccgacgaacgaaccgactaccgtacccgaaacggtacgacccgaaccggtacccttaacgaacggttaccgggaaccttacgggaacggtaaccgtcccgtaggtaaaccgtacttaccggtacggtaaacccggaaccggtaccccgggtaaccggtttacgttaaaccgtttacggtcggttaccgggaacgttaaggggaacgtttaacggggtaaccggggtttaaaatttcggtttttaaccgggtaaccggtttaaccgggtttaacccccttttagggtttttaacccggaaaccggttttacccggggttaaccggggggttaacccccggggtaaccccggttttaacccccggtttacccgggg

SEQ ID NO: 197595 - DNA, 661 bp, Homo sapiens
  misc_feature: GYAE6OF02FQOXH.39.81.H04.1.454.CMB.1.raw
  modified_base (521)..(521): a, c, t, g, unknown or other
  misc_feature (521)..(521): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacgaagggcttgagtggagtggggatgggatcgagcgcttacaagttggtacacgaacaaactatcgacacacgaacctccgagggcaggagtacaccatacgaccacacgacacactacccaacggacgtaccacggacctaacgagtaccggaccgtaggaacgggacgccgtaggaacgtacgtccgtacggaaccgaccgtaccgggtacccgttagttactttacgnggtacggaccgaaggacggtaggtacggggtaaatttacggttttacggtaaccggtttaccgggttaacccctttagttttacggtaaccgtttacggggttacccggggacccgtaccggggtaaccccgttaccggg

SEQ ID NO: 197596 - DNA, 570 bp, Homo sapiens
  misc_feature: GYAE6OF02GAXG7.39.81.H04.1.454.CMB.1.raw
  modified_base (211)..(211): a, c, t, g, unknown or other
  misc_feature (211)..(211): n is a, c, g, or t
  modified_base (338)..(338): a, c, t, g, unknown or other
  misc_feature (338)..(338): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgaaaaaaaaaacgngccgtggggcctcgagtgaaggtctcctgcaaggcttctggttacacctttaccaactatgtatcagttggtgcgacaggcccctggacaagggcttggagtggagtgggatggatcagcgtcttanaatggtcacacaaactatcgacacagaacctcgagggcagagtcacatcgaccacgagacacactaccacgacgccaccggacctaacgagtcggacctggacggacgcctgacgatccgagacgacaccggtcgtagtacttacgtgtcgagagagagtacgggtaattgtttagacgtacggttacccttgtttacgacgttacggtcgggaccgtacgggtaccctcgg

SEQ ID NO: 197597 - DNA, 572 bp, Homo sapiens
  misc_feature: GYAE6OF02I63LI.39.81.H04.1.454.CMB.1.raw
  modified_base (388)..(388): a, c, t, g, unknown or other
  misc_feature (388)..(388): n is a, c, g, or t
  modified_base (432)..(432): a, c, t, g, unknown or other
  misc_feature (432)..(432): n is a, c, g, or t
  modified_base (440)..(440): a, c, t, g, unknown or other
  misc_feature (440)..(440): n is a, c, g, or t
  modified_base (443)..(443): a, c, t, g, unknown or other
  misc_feature (443)..(443): n is a, c, g, or t
tcagtcgcactagtcacgaccggtgctcgatttagtagtgtagattcgcgggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacacggcccctggacaagggcttggagtggatgggatggatcgagcgcttacaagtcggtacacacaaactatgacacagaacctcagggcagacgtcaccatcgaccanacgacacactaccagacgcacggcctacatcggacctgacgganccgtgacntcngacacgacgcgtagtacttacgtgtcgcgagaggtacgtacggggtaaattcgttttacggacgttacggttacccctttcgtttacgaaccgttaccggacggggtaccgtaccggggacccttcggg

SEQ ID NO: 197598 - DNA, 632 bp, Homo sapiens
  misc_feature: GYAE6OF02GDO43.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcaggttgggtgcgacacggcccctggacgaagggtcttgaggtggagtgggatggatcgagcgcttacaagtggtcacaactaaactatcgacaacacgaacctccgagggcagacgtacacatacgaccacacgacacactccaacgacgaccaccggacctacagtacggaccgtggaacggacgccgtagacgtactacgtacgaaccggaccgaccgggtccgttagttaacttacgttgtcggacggaggtaggtacggttacggggtaaatttcggtttacgtacggtttacggttaccctttacggtttacgaccggtttaccgggacggggtacccggtaacgggttacccgtaccggg

SEQ ID NO: 197599 - DNA, 569 bp, Homo sapiens
  misc_feature: GYAE6OF02HXAE4.39.81.H04.1.454.CMB.1.raw
  modified_base (275)..(275): a, c, t, g, unknown or other
  misc_feature (275)..(275): n is a, c, g, or t
  modified_base (350)..(350): a, c, t, g, unknown or other
  misc_feature (350)..(350): n is a, c, g, or t
  modified_base (448)..(448): a, c, t, g, unknown or other
  misc_feature (448)..(448): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctctgcaaggcttctggttacacctttaccaactatggtatcagttgggtncgacacggcccctggacaagggtcttgagtggatggggatggatcgagcgcttacagtggtacacgaacaaactnacgcacacgaacctcgagggcagcgtacaccatacgaccacagacacactccacgagacacggacctacagtcggacctggagagcgtgagtctacgngaccgacgacggtcgtagttacttacgtggtgcgagagtagtacgggtaacttgtttacgacgttcgtacccgttcgttacgtacgttaccgtcgggtaccggtacgggtaccgtaccggg

SEQ ID NO: 197600 - DNA, 593 bp, Homo sapiens
  misc_feature: GYAE6OF02JAHF6.39.81.H04.1.454.CMB.1.raw
  modified_base (275)..(275): a, c, t, g, unknown or other
  misc_feature (275)..(275): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtncgacaggcccctggacaagggcttgagtggatgggatggatcgagcgcttacaatggtcacacaaactatcgcacagaacctcagggcagagtcacatcgaccacagacacactccacgacgcacgcctaacagtcggacctggaggacgccctagacgactcgtagaccgaacgaccgggtccgtaggtacttacgtggtacgacgtagaagtacggtacggggtaaattggttttacggaaccgttcggtaaccccgtttagtttcggtaaccgttaccggtcgggggtacccgaaccggggtaaccccgttcggg

SEQ ID NO: 197601 - DNA, 648 bp, Homo sapiens
  misc_feature: GYAE6OF02G9NPU.39.81.H04.1.454.CMB.1.raw
  modified_base (441)..(441): a, c, t, g, unknown or other
  misc_feature (441)..(441): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttgggtggcagcaaacaacaggtcgccccacccccagtttcagctggtacagtctggagctgagatgacgaacgccgtggggcctcgagtgaaggtctctgacaaggcttctggttacacctttacactatgtatcagttgggtgcgacacggtccccgtaggacgaagggtcttaggaggtaggtatggggatggatcgagcgtacttaacaagtcggtacacaacgtaaactagtcacgaacacgaaccctcgaagacagacgtacactagtacgacaacgagaaccacactaccgaacgaacnccgaccgacctacgacgtacggacctggagacgcctagagactcgtacgacgacggaccggtccgtagttacgtacgttgcgcggaagtagaaggtacgggtaaattttacggttaggtaccggtttaccgtaccgtttaccgttacgttaacgttaccgggtacggggttacccggaaacccgggttacccgtacggttaaccccg

SEQ ID NO: 197602 - DNA, 549 bp, Homo sapiens
  misc_feature: GYAE6OF02FIVPD.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactatgcacacgaacctccgagggcagacgtcaccatcgaccacagacacactccacgagcacggcctacagtcggacctggacggacgccgtagagatcgtacgacgacgacggccgtagtattacgtgtcgcgagagagtacgggaattgtttagacgttcggtaccttgttacgacgttacgtcgggaccgtacgggtacccgtcgg

SEQ ID NO: 197603 - DNA, 692 bp, Homo sapiens
  misc_feature: GYAE6OF02JB4BR.39.81.H04.1.454.CMB.1.raw
  modified_base (362)..(362): a, c, t, g, unknown or other
  misc_feature (362)..(362): n is a, c, g, or t
tcagtcgcactagtcacgaccggtgctcgatttagtagtgtagattcgcgggggacccgaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacaccgtttaccaactatggtatctagttgggtgacgtacaacggtcccctaggacaagggcttaggagttgggatggggactgggatcgagcgcttacaatggtacacacaaactnagacacagacctcgagggcagacgtacacgatacgaccagacgacacactacccagacgacaccggacctacgacgtacggaccttaggacggacgtccgtaggaacgtacgttacctcgggtaaaccgaacccgtaaccgggtacccgtttaggttaaccttttaaccgttcggttaccggaacgtaacgggaacggttacggggtaaccggggttaaaagttttaccggtttttaaggaacccggtttacggttaaccccgtttggttttaacggtacccgtttacggttaccgggggaccctaaccgggggttaccccttaccgggg

SEQ ID NO: 197604 - DNA, 653 bp, Homo sapiens
  misc_feature: GYAE6OF02JW0LE.39.81.H04.1.454.CMB.1.raw
  modified_base (262)..(262): a, c, t, g, unknown or other
  misc_feature (262)..(262): n is a, c, g, or t
  modified_base (330)..(330): a, c, t, g, unknown or other
  misc_feature (330)..(330): n is a, c, g, or t
  modified_base (385)..(385): a, c, t, g, unknown or other
  misc_feature (385)..(385): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacctacctttaccaactntggtatcaggttgggtgcgacaggccccgtggacaagggtctggagtgggatgggatggatcgagcgnttaacatggtcacacaactatcgcacgacgaacctccgaggcagacgtcaaccanacaccaacacgacacactacccgacgacgaccgaccggtcctaacgtacgtaccgggacctagggaacggtacgaccgtagacgtactacgacgaaccggaccgtacggccggttacgttacgttaccttggtaccgacggtaacggaacggtaggtaacgggtaaagtttaacggtttacgtacggttaccggttacccgtttaggtttaccgtaaccgttaacgggtccgggggtaaccgttaaccggggttaccccgttaccggg

SEQ ID NO: 197605 - DNA, 534 bp, Homo sapiens
  misc_feature: GYAE6OF02HZRFK.39.81.H04.1.454.CMB.1.raw
  modified_base (381)..(381): a, c, t, g, unknown or other
  misc_feature (381)..(381): n is a, c, g, or t
  modified_base (421)..(421): a, c, t, g, unknown or other
  misc_feature (421)..(421): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttggtgcgacaggcccctggacaagggcttgagtggatgggatggatcagcgcttacaatggtcacacaaactatgacacagaacctcgagggcagacgtcaccatcgaccanacgacacatccacgagcacggcctacatcggactgaggancctgagatcgtgacgacacggccgtgtacttactgtcgacgagagagtacgggaatagtttagacttggtacccttgtttacgacgttacgtaggggacctacgggacctcgg

SEQ ID NO: 197606 - DNA, 593 bp, Homo sapiens
  misc_feature: GYAE6OF02IJ790.39.81.H04.1.454.CMB.1.raw
  modified_base (447)..(447): a, c, t, g, unknown or other
  misc_feature (447)..(447): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggtcttctggttacaccttaccaactatggtatcagttggtgcgacaggcccctggacgaggtcttggacgtggagtgggatggatcgagcgcgttacaagtggtacaacaacaaactatgactacgacgaaccctcgaggcagagtacaccatcgaccacacgacacactaccacgtacgcaccggcctacgagtacggcctaggacggtanccgtgatcgtcgagcgaccgcggtcgtagtacttcgtagtcgacgaggtacgtacgtacgggtaattgtttacggtacgttcggttaccccttaggtttcggaaccttcggtaaccgggggtcctaacggggtaccccttacgggg

SEQ ID NO: 197607 - DNA, 661 bp, Homo sapiens
  misc_feature: GYAE6OF02IISM4.39.81.H04.1.454.CMB.1.raw
  modified_base (277)..(277): a, c, t, g, unknown or other
  misc_feature (277)..(277): n is a, c, g, or t
  modified_base (327)..(327): a, c, t, g, unknown or other
  misc_feature (327)..(327): n is a, c, g, or t
  modified_base (417)..(417): a, c, t, g, unknown or other
  misc_feature (417)..(417): n is a, c, g, or t
tcagtcgcactagtcacgaccggtgctcgatttagtagtgtagattcgcgggggacccaaaaaaccacacccctccttgggagaatcccctagatcacagctcctcaccatggactggacctggagcatccttttcttggtggcagcaacaacaggtgcccactccccaggttcagctggtacagtctggagctgagatgacgaagccgtggggcctcgagtgaaggtctctgcagcttcgtggttacacctttaccaatatggtatcgaggttggngacgacgacggccctaggacgaggtcttggaggtggagtgggatggatcnggctcttaacgagttcggtaccaacaactaaactagtcgacaacgaacgaaccctacggacggacaacggactacaccagaccgaccaanacgacacgcaccgacgacgaccgaccggtactaaccgagtaccggaaaccgtgggtaacggaccgtaccgtaaggacgtacgtacgacggaaccgaccgggtaccggtcgttaacgttacgttacgtcggacgcggtaagacgggtaacggttacgggtaaattttcggttacggtacgttacggttaccctttggtttacgaccgttacgggccggggtaacccgtaccgggtacccggtcgg

SEQ ID NO: 197608 - DNA, 610 bp, Homo sapiens
  misc_feature: GYAE6OF02HDMW6.39.81.H04.1.454.CMB.1.raw
  modified_base (349)..(349): a, c, t, g, unknown or other
  misc_feature (349)..(349): n is a, c, g, or t
  modified_base (355)..(355): a, c, t, g, unknown or other
  misc_feature (355)..(355): n is a, c, g, or t
  modified_base (372)..(372): a, c, t, g, unknown or other
  misc_feature (372)..(372): n is a, c, g, or t
tcagtcgcactagtcacgaccggtgctcgatttagtagtgtagattcgcgggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttcgtggtacacctttaccaactatggtatcagttggtgcgacaggcccctggacaagggcttggagtggagtgggatggatcaggcgtcttaacaatggtcacacaaactntgacanacgaacctcgaggcagngtccaccatgaccacacgaacacactaccacgaacgcgacggcctaacacgtcggacctggaaggacgcccgtagaacgactcgtaggaccgaaccgcgggtccgttagtaacttcgtggacgacggaagacggacggttaacggggaaattttgtttacggtaacgttccggttacccctttagtttaccggtaaccgttacggtcgggggtacccgtacggggtaccccttcgggg

SEQ ID NO: 197609 - DNA, 647 bp, Homo sapiens
  misc_feature: GYAE6OF02GQ4O3.39.81.H04.1.454.CMB.1.raw
  modified_base (345)..(345): a, c, t, g, unknown or other
  misc_feature (345)..(345): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacacggcccctggacaagggcttgagtggagtgggatggatcgagcgcttacatggtcacacaaactntcgacacacgaacctcgagggcagagtcacatcgaccacacgacacactacccgagacgaccgacggcctacgacgtcggacctgggaacggacgtccgtaggaacgtacgtcgtacggaacccgaaccggtaccgggtcccgttaggttaactttaccggtggtacggtaccggaaggtacggtacgggttaaccgggggttaaaatttacggtttttacggaaccgtttcgggttaacccctttgtttaacggaccgtttaccggacggggtacccgtaacggggtaaccccgttcgggg

SEQ ID NO: 197610 - DNA, 702 bp, Homo sapiens
  misc_feature: GYAE6OF02JN4RZ.39.81.H04.1.454.CMB.1.raw
  modified_base (228)..(228): a, c, t, g, unknown or other
  misc_feature (228)..(228): n is a, c, g, or t
  modified_base (245)..(245): a, c, t, g, unknown or other
  misc_feature (245)..(245): n is a, c, g, or t
tcagtcgcactagtcacgaccggtgctcgatttagtagtgtagattcgcggggcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactntggtatctagttgggtncgacacggcccctaggacgagggcttggagtaggatgggataggatcgaggtcgtacttaacaagttggtaccaacgaacaaactgtcgactaacacgaaccctacgacggacgagacgtaccaccgtatacgacccaacgactaaccgaacactaacccgaacggaccgaccgaacccgggtaccctaaccgtagtacccggtaaccgtaggaaccgggtacgccgtaagacgtactccgtaggaccgtaccgaaccggtccgttaagtactacggtgtaggaccggtaagaaggtacgggttaacgggttaaaatttcggttttaacgaacggttccggttaccccgttacgtttacggtaccgttaaccggggtacggtaacccgggaacgggttaaccccgttacggtaccgttaccccggtcctcccgtacgtacccgtacccgtaacccgg

SEQ ID NO: 197611 - DNA, 617 bp, Homo sapiens
  misc_feature: GYAE6OF02IS6YH.39.81.H04.1.454.CMB.1.raw
  modified_base (356)..(356): a, c, t, g, unknown or other
  misc_feature (356)..(356): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctccgtgcaaggcttctggttacaccctttacaactatggtatcaggttgggtgcgacgacggcccctggacaagggcttggagtggagtggggatgggatcgaggcgcttacaagtggtacacaacaaactngaccagacgaacctccgaggacagacgtaccacagtacgaccacgacgacacacgtaccacgacgccgaccggcctaacgacgtaccggaaccgttggaagggacgaccctaggagtactcgttacgacgaaccgtccggtccgttagttagttacgtgtcgacggtagagtacggtagggtaacttcgtttacgtacggttacgttacccgttagtttacggacgttaccggacgggtacccgtacgggacccgttacgg

SEQ ID NO: 197612 - DNA, 663 bp, Homo sapiens
  misc_feature: GYAE6OF02IM5ZS.39.81.H04.1.454.CMB.1.raw
  modified_base (246)..(246): a, c, t, g, unknown or other
  misc_feature (246)..(246): n is a, c, g, or t
tcagtcgcactagtcacgaccggtgctcgatttagtagtgtagattcgcgggggacccaaaaaaccacacccctccttgggagaatcccctagatcacagctcctcaccatggactggacctggagcattcctttttcttggtggcagcaacaacaggtcgcccactcccaggttcagctggtacagtctggagctgagatgacgaagccgtggggcctcgagtgaaggtctcctgcaaggtcttntcggttactacctttaccaatatggtatctaggttggtgcgacacggcccctggacgaagggcttggagtggagtgggatgggatcgagccgtacttaacaagttcggtacaactaactaaactatacgacaactaacgtaaccctacgagggaccaggacgtccaaccgtagtacgaaccacacgacaacacgtacccaacgacgaccgaccggacctaacgacgtacggacctagggacgaccgtccgtaggagactcgtacgaacgaccgtacccggtacgttacgttaacgttacgttcggaggtacggaggaacggtaggttaacgggtaagtttaagtttacgacggttaacgttacccgttacggttctacggtaccgtacggggtaccgtaccgggtaccgttacccgg

SEQ ID NO: 197613 - DNA, 822 bp, Homo sapiens
  misc_feature: GYAE6OF02JMD8T.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggctctggttacaccttaccaactatggtatcagttgggtgcgacacggcccctggacaagggtccttgacgtgggactggggactggtatacgaggtaccgctttaccgaaagttcggtaccgacctaaaccgtaaaacgttagttacggacctaacgaaccggtaaccccttacccggaacggggtaccaacgggtacgtacccgtaaacccgtagttaccggaaacccctaacggtaacgaaccctaaaccgtacgttaaccccaaccgggtaacggacccgtaacccgggtacctaaccgtacggtaccggtaacccgttaagggacggtaaccggtaccgttaaggaccgtaacgtaccggttacgaaccggtaaccgtaacccgggtacccggtttaacgtaaccgttttaaccgtacgggtacggaaccggtaacgggtaccggttacgggtaaccgggggtaaacttttaacgggttttaccgaaccgggtttaacgggttaaccccgtttcggttttaaccggtaaccggtttaaccggtaccgggggtacccggtaaccggggttaccccgttaacgggg

SEQ ID NO: 197614 - DNA, 669 bp, Homo sapiens
  misc_feature: GYAE6OF02GRWZW.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcgagtgaaggtctcctgcaaggcttctggttaccacctttaccaactatggtatcgaggttgggtgcgacgacggccccgtaggacgaagggtcttgaggtggagtgggatggatcgagcgtacttacaagttcggacacgaacaaaatatacgacacgaacgaaccctacgagggacaagacgtaccaaccatacgaaccaacgacgaccacactacccgaagaccgaccgaaccggacctaacgacgtacggtaccgaggaacgggacgtccgtagaacgtactccggtaacggaccgaaccggtaccgggtaccgttagttaacttacgttcggtacggaacggaagaggtacgggtaacgggttaatttacggttttacggaccgttaccggttaccctttagttacggtaccgtacgggtacgggtacccggtaaccgggtacccgtccgg

SEQ ID NO: 197615 - DNA, 814 bp, Homo sapiens
  misc_feature: GYAE6OF02I8KXG.39.81.H04.1.454.CMB.1.raw
  modified_base (318)..(318): a, c, t, g, unknown or other
  misc_feature (318)..(318): n is a, c, g, or t
  modified_base (356)..(356): a, c, t, g, unknown or other
  misc_feature (356)..(356): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgagcctggggcctcagtgaaggtctcctgcaaggcttctggttacacctttaccaactatggtatcagttgggtgcgacacggcccctggacaagggcttgaggtggagtgggatggancgagcgtacttacgaagtcggtacacgtaactaaactntacgacctaacgaacgtaaccctcgaacggggcaacggtacggttaccaaccgtacgtacggaacccaaccgaacggaacctaaccgaactaccccgaaacgggaccgaccgaacccgggtacctaacgaaacggtccgggtaaacccgttgggaaaccggggtaacgtacccgtaacggtaacgggtaccttaacccggtacgggaaaccggtaaccccggtaacccggggtacccggttttaggttaaccgttttaaaccgtcgggtttacggacccgggtaagggtaaagggtaacgggttaaccgggggttaaaagttttacggtttttaaccgggtaaccgtttaacccggggtttaacccccgtttagttttaacccgggttaaaccggttcccggggttaaccggggggttaccccgtaaacccggggggttaaccccgtttacccggggg

SEQ ID NO: 197616 - DNA, 672 bp, Homo sapiens
  misc_feature: GYAE6OF02HS6I3.39.81.H04.1.454.CMB.1.raw
  modified_base (354)..(354): a, c, t, g, unknown or other
  misc_feature (354)..(354): n is a, c, g, or t
  modified_base (392)..(392): a, c, t, g, unknown or other
  misc_feature (392)..(392): n is a, c, g, or t
tcagtcgcactagtcacgaccggtgctcgatttagtagtgtagattcgcgggggacccaaaaaccacacccctccttgggagaatcccctagatcacagctcctcaccatggactggaccctggagcatccttttcttggtggcagcaacaacaggtgcccactcccaggttcagctggtacagtctggagctgagatgacgaagcctggggcctcagtgaaggtctccgtgcaaggcttctggtacacctttacaactatggtatcagttgggtgcgacgacggcccctggacaagggtcttggagtggagtggggatgggatcgagcgcttacgagtggtcacgacaaactntgcacagaacctcgagggcagagtcaccatacgaccanacgacacgactacccgaaggacgaccgaaccggccttaacgacggtacggaaccctaggaacgggtacgcccgttagaacgacgttaccgtacgaaccggtaaccgtaccgggtccgttaggttaacgtttacgtcgggtacggacggtaggaggtacggtacggggttaaaacttcggtttttacggaaccggttaccggttaccccctttaggtttaccggtaaccgttacccgggttccgggggtaacccgttaccggggtaccccgtttacccggg

SEQ ID NO: 197617 - DNA, 628 bp, Homo sapiens
  misc_feature: GYAE6OF02GAI5D.39.81.H04.1.454.CMB.1.raw
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaagtctcctgcaaggcttctggttacacctttaccaactatggtatcagttggtgcgacaggcccctaggacaagggcttggagtggagtgggatggatcgagccgcttaacgaagttcggtacaacgaactaaaactctagaccaacgaacgaacctccggagggacaagacgtcaaccatacgaacacagaccacactccaacgacgaccgaccggacctaacgacgtacggacctagggaacggacgtacccgagacgtacgtacgacggaccgaaccggacggtccgtagttataccgttggtacgacggagtacggtaggtaacgggtaattacgttagtacgttaccggttaccctttggttacgacgttaccggacggggtacctacggggtaccctacggg

SEQ ID NO: 197618 - DNA, 650 bp, Homo sapiens
  misc_feature: GYAE6OF02FRDRP.39.81.H04.1.454.CMB.1.raw
tcagtcgcactagtcacgaccggtgctcgatttagtagtgtagattcgcgggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacgacggcccctggacaagggcttggagtggagtgggatggatcgagcgtctacgaagtggtacacacaaactatgacacacgaacctccgagggcagagtcacatcgacacgagacacactccgacgagaccacggtcctaacgacgtacggaccgtacggaacgggacacccgtagaagtacgtccgtagggaaccgaaccgaccggggtacccgttaggttaacgtttaccgtcggtcggaccgtaagggaacggtacgggtacggggtaaaagtttcgttttaggtaccggttacggttaaccccgtttgtttacgggtaccgttaccgggttacggggaccccgttacggggtaacccccgttcgggg

SEQ ID NO: 197619 - DNA, 634 bp, Homo sapiens
  misc_feature: GYAE6OF02HTCVW.39.81.H04.1.454.CMB.1.raw
tcagtcgcactagtcacgaccggtgctcgatttagtagtgtagattcgcggggacccaaaaaaccacacccctccttgggagaatcccctagatcacagctcctcaccatggactggacctggagcatcctttttcttggtggcagcaacaacaggtgcccactcccaggttcagctggtacagtctggagctgagatgacgaagcctggggcctcagtgaaggtctcctgcaaggcttctggttacacctttaccaactatggtatcaggttggtgcgacacggcccctggacaagggcttgagtggagtgggatggatcgagcgcttacagtggtacacgaacaaactatgacacacgaacctcgaggcagagtcaacatacgaccacagacacactacccaacgacgaccgaacggtaccctaacacgtacggaccgtaggaacggacgccgtaggaacgtattaccgtacggaaccgaccggtaccgggtcccggttattacgtttacgtggtcgaacgtagaacggtaggttaacggggtaaatttacggttttcgaacgttaccggttacccttaggttttacgaccggttacggtccgggggaaccctacggggtaccccgttcggg

SEQ ID NO: 197620 - DNA, 645 bp, Homo sapiens
  misc_feature: GYAE6OF02JNCNK.39.81.H04.1.454.CMB.1.raw
  modified_base (225)..(225): a, c, t, g, unknown or other
  misc_feature (225)..(225): n is a, c, g, or t
  modified_base (339)..(339): a, c, t, g, unknown or other
  misc_feature (339)..(339): n is a, c, g, or t
  modified_base (348)..(348): a, c, t, g, unknown or other
  misc_feature (348)..(348): n is a, c, g, or t
  modified_base (361)..(361): a, c, t, g, unknown or other
  misc_feature (361)..(361): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtcncctgcaaggcttctggttacacctttaccaactatggtatcgagttgggtgcgacaggcccctggacgaagggcttggagtggagtgggatggatcagcgacttacagtcggtnacacaactntgcacacgtaccncgagggcagagtacacagtcgaccacgagacacgactaccgacgacgccgaacggtacctactacgtacggacccgttaggaacggtacggtaccgtagtaacggtactacggtcgaacccggtacgtaacccgggtccgtttaacggttaaccgtttacgtcgggtacggtagaacggtaggttacggtacggggtaaatttacgtttaggtacgttacgggttaccctttacgttcggtaaccgttaccggtcggggacccgtaacgggtacccgttacggg

SEQ ID NO: 197621 - DNA, 672 bp, Homo sapiens
  misc_feature: GYAE6OF02IF96V.39.81.H04.1.454.CMB.1.raw
  modified_base (290)..(290): a, c, t, g, unknown or other
  misc_feature (290)..(290): n is a, c, g, or t
  modified_base (368)..(368): a, c, t, g, unknown or other
  misc_feature (368)..(368): n is a, c, g, or t
tcagtcgcactagtcacgaccggtgctcgatttagtagtgtagattcgcgggacccaaaaaacccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggtcttcgtcggttacctacctttaccaactatggtatctaggttgggtgcgacgnggcccctggacaagggcttggagtggagtgggagtggatcgaggccgtacttaacgagtacggtacacaacaaactancgaccaacacgaaccctccggagggacagacgtacaacctagtaccgaccaacacgacacactaccaacgacgaccgaacggaccctaagacgtacgggtaacccgtagggaaccgggtcgacccggtaggtaacgtactccggtagaacccggaccggtaccggtaccggttatttacgttaacgtggtcgacggagacggtaggtaacgggttaaattacggtttacggaccgtttcgttaaccccgtttgtttaccggacgtttacccggcggggtaaccgtacccgggtaaccgtccggg

SEQ ID NO: 197622 - DNA, 691 bp, Homo sapiens
  misc_feature: GYAE6OF02I1OU9.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctctgcaaggcttctggttacacctttaccaactatggtatcgtagttgggtgcgacgacggcccctggaccgaagggcttgagtggagtggggatggatcgaggcgtcttaacgaagtcggtacaaccgaacaaaacttatacgactaacgaacgtaaccctaccgaagggcaagtacgtaccaacatacgaaccacaacgacaacactacccaacggagcccaacggaccctaagtacgtaccggaccgtagggaacggacgtcccgtaggaacgtacgttacgtacggaaccgtaccgaaccgggtccgttaagttaacgtttaaccggttgggtacgaccggaagtaacggtacggttaacggggtaaattttcgttttaacgggtacgttaaccgggttccccttttagtttaacgtaccggttacggtaccgggggtaacctacgggggtaccccctacggg

SEQ ID NO: 197623 - DNA, 762 bp, Homo sapiens
  misc_feature: GYAE6OF02G867V.39.81.H04.1.454.CMB.1.raw
  modified_base (158)..(158): a, c, t, g, unknown or other
  misc_feature (158)..(158): n is a, c, g, or t
  modified_base (165)..(165): a, c, t, g, unknown or other
  misc_feature (165)..(165): n is a, c, g, or t
tcagtcgcactagtcacgaccggtgctcgatttagtagtgtagattcgcggggcccctagactcacagctcctcaccatggactggacctggagcatcctttcttggtggcagcaacaacaggtgcccactcccaggttccagctggtacagtctggngctgagntgacgaagccgtggggcctcgagtcggaaggtcctccgtgcgaaggtccttcgtcggttacctaaccttttaccgaaactttacgtcggtaatcgtaggtttcgggtcggcgaccgacggtccccgtacgggaacctaagggcttcggaggttggagtacgggagttggagtacgagcgtaccttaagaattcggtacaacacgtaaaacgtatacggacaacgtaaagtacccttaaccggaagggcaaacggtaccgtaccaacctaggtacccaaaccggtaccaaggtaacctaacgaacccttcgaaaccggacgaacgtaccccggattaaccgaactacggaaccgttacgaaggtaccggtcgtacggacgttagcgtaacgaacgaccgtaaacccgcgtacgttaacgtaccgttagacggacggtaacgtaagggtaacgtaaggggttaaactttacggttaggttaacccgtcgggtttaaccctttcgttaccggttaacttaccgggtacgggttacccggaacgggtaccccgttaggacccgtaccggttaccgtcccggtacaccggttccctacccgg

SEQ ID NO: 197624 - DNA, 848 bp, Homo sapiens
  misc_feature: GYAE6OF02IP04S.39.81.H04.1.454.CMB.1.raw
  modified_base (370)..(370): a, c, t, g, unknown or other
  misc_feature (370)..(370): n is a, c, g, or t
tcagtcgcactagtcacgaccggtgctcgatttagtagtgtagattcgcgggggacccaaaaaccacacccctccttgggagaatcccctagatcacagctcctcacccatggactggacctggagcatccttttcttggtggcagcaacaacaggtgcccactcccaggttcagctggtacagtctggagctgagatgacgaagcctggggcctcagtgaaggtctcctgcaggcttctggttacacctttacaactatggtatcagttgggtgcgacacggcccgtggacgagggcttggagtggatgggatggatcgagcgcttagaatggtacacgaacaaactatcgactaacgaacgtaacccncctaaggggccaacggtacggtaccctaacccgaagttaccggaaaccccaaccgaaacggaccaaacgtaacccgtaccccgaaaccgggtacggaacccgaacccgggtaccccgtaaaccgtaacggttaacccgggtaacccggtaaccgggaacggggtaacccgtaccccggttaaggaaaccggtaccgtttaccggtacggttaaacccggaacccgggtaaccccggggtaccgggttttaacggttaaccgttttaaccggttacggttgggtaaacccgggtagggtaaaccgggttaccggggttaaacgggggttaaaacgtttttaacgggttttttaaccgggttaaccggtttaccgggtttaaccccgttttacggtttttaaccggtaacccgggttttaacccgggtaaccgggggggtaaccccggtaacccgggggttaccccggttaacccggggg

SEQ ID NO: 197625 - DNA, 669 bp, Homo sapiens
  misc_feature: GYAE6OF02HYBS8.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctccgtgcaaggcttctggttacacctttaccaactatggtatcagttgggtgcgacacggcccctggacgaagggtcttggaggtggatggggatgggatcgagtcgtactttaacaagttggtacaacaactaaactatgaccacaacgtaacctcgagggacagacgtaccaaccatcgaacccacaacgaccaacgactacccgaacgacgaccgaaccgggtacccttaacgaacgtcggaaccgtaggaacgggtacgtcccgtaggaacgtactaccgtaggaaccggacggaccgggtccgttaaggttacttacgtggtacgacggtaagaggtacggtaacggggtaatttacggtttacggaccgttacggttaccccttagtttaccggtaaccgttaccggtcggggtaccgtacggggtaaccccttcgggg

SEQ ID NO: 197626 - DNA, 716 bp, Homo sapiens
  misc_feature: GYAE6OF02JLUPM.39.81.H04.1.454.CMB.1.raw
  modified_base (258)..(258): a, c, t, g, unknown or other
  misc_feature (258)..(258): n is a, c, g, or t
  modified_base (356)..(356): a, c, t, g, unknown or other
  misc_feature (356)..(356): n is a, c, g, or t
tcagtcgcactagtcacgaccggtgctcgatttagtagtgtagattcgcggggacccaaaaaccacacccctccttggagaatccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttcgtggttacacctttacaactntggtatcgtagttggtgtcgacgtacggcccctaggacgaagggcttggagttggagtgggatggatcgagcgtctacaagtcggtcacgacaaactntagacacgaacgacctccgaagggcaggataccacagtcgaaccagacgacaacactccgacgagccgaacgaccgtactagtacggtacccgtaggaacggaccgtaccgtacggacgtacgtaccgtacggaaaccggtaccgaaccggggtccgttaggttaaccgtttaaccgtcgggttaaccggtacggtaacggtaacgggttaacgtaacgggggtaaacttttaaggttttaccggtaaccgggtttacccggttaacccccgttttggttttaaccgggtaaccctttaccggggtttaaccccggggggtaacccggttaaccgggggttaacccccgttacccggggg

SEQ ID NO: 197627 - DNA, 631 bp, Homo sapiens
  misc_feature: GYAE6OF02I75EO.39.81.H04.1.454.CMB.1.raw
  modified_base (356)..(356): a, c, t, g, unknown or other
  misc_feature (356)..(356): n is a, c, g, or t
  modified_base (363)..(363): a, c, t, g, unknown or other
  misc_feature (363)..(363): n is a, c, g, or t
  modified_base (401)..(401): a, c, t, g, unknown or other
  misc_feature (401)..(401): n is a, c, g, or t
tcagtcgcactagtcacgaccggtgctcgatttagtagtgtagattcgcgggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatctaggttggtgcgacacggcccctggacgaacgggtcttagaggtggatggggactgggatcgaggcgtcttaacgaagtcggtacacaanaaactangcacgacgaacctcgagggcacgagacacatcgaccanacgacacactccagacgcacggccaacagtacggtaccctaggaacggacgaccgttagaacgtacgtactacggacgaccgacgggcccgttaggtaactttaccgtggtacgacggtaacggagggtacgtacgggtaaacgtttcgttttacggaccgttaccggttacccttacggtttacgtaaccgtttccggaacggggtacctacggggaaccccttcgggg

SEQ ID NO: 197628 - DNA, 563 bp, Homo sapiens
  misc_feature: GYAE6OF02FLGOG.39.81.H04.1.454.CMB.1.raw
tcagtcgcactagtcacgaccggtgctcgatttagtagtgtagattcgcggggcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatgggatcagcgcttacaatggtcacacaaactatgcacagaacctcgagggcagagtcacatgaaccacagacacactccaacgagcacggcctacagtggacctgacggagcctagagatcagacgacgacggcgtgtacttacgtgtgacgagagtagtacggggtaaattgttttagacgttcggttacccttgtttgaaccgttacggtcggggacccgtaacggggtacccttcgggtacctacccggttcctacccgtaccacgtccctaaccccgg

SEQ ID NO: 197629 - DNA, 633 bp, Homo sapiens
  misc_feature: GYAE6OF02HSBTU.39.81.H04.1.454.CMB.1.raw
  modified_base (273)..(273): a, c, t, g, unknown or other
  misc_feature (273)..(273): n is a, c, g, or t
  modified_base (379)..(379): a, c, t, g, unknown or other
  misc_feature (379)..(379): n is a, c, g, or t
  modified_base (475)..(475): a, c, t, g, unknown or other
  misc_feature (475)..(475): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaggtctctgcaggcttctggttacacctttacaactatggtatctagttgggngcgacgacggcccctgggacaaggggcttgaggtggtagtgggagtggatcgagccgacttaacgagtggtacaacaacaaactagtgacacaacgtaaccctcgngggacaggacgtacaacctagtcgaaccacacgaccacactccaacgacgcgaccggtactacagtacggtactacggaaggtacgcgtagagtcncgtacggaccgacgtaccgggacgttacggtacgtttacgtcggtacggcggtaagaggtacggttacggggtaaactttaggtttacgtacgttacggttacccgttctttacggtaccgttacggtccggggtaccgtacgggttacccgttacgg

SEQ ID NO: 197630 - DNA, 693 bp, Homo sapiens
  misc_feature: GYAE6OF02GLOU1.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgagcctggggcctcagtgaaggtctcctgcaaggcttctggttacacctttacaactatggtatcgagttgggtgcgacacggcccctggacgagggtcttggagtggagtgggatgggatcgagcgtcgttaacaagtcggtacaacgtaacaaaaccttatacggaccaacgaacgaaacccctccgaacggggacaacggtacgtaccaaccgagtaccgaacccaaccgaagtaaccaacctaactcccgaaccgacgacccgaaccgggtccctaacgtacgtacggaccgtaggaacggaccgtcgtagaacgtataccgtacggaccgaccggaccgggtaccgttagttaacgtttacgcgttacggacgaaggtacggaggttaacggggtaatttacggttttaggacgtttaccggttacccgtttacgtttcggtaacccgtttcgggtccgggaacccggttacgggacccgttaccgggg

SEQ ID NO: 197631 - DNA, 689 bp, Homo sapiens
  misc_feature: GYAE6OF02IMF8W.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttcgtggttactaccttaccaactatggtatcgagttcgggtgacgacgaggcccctggacaagggcttagagtggatgggatggatcagcacgttacaagtggtacacaacaaactatgacacaagaacccgtaccaggggccaaggacgtacaaccataccgaaccgaccaagaccaaacgtacgtacccgaaacggacgaccgaaccggaccctaaacgtcgtaccggaccgttaaggaacgggtaccgaccgtagaacgtacttacggaacacggaacccgtacgggtacccgtagttaacgtttaacgtcgggtacgaccgggaagtacgggtaacgttaacggggaaactttacgtttaacgggaccgttaacgtaccccggtttagtttaccggaaccgttaccggttacgggggtacccgtaaccggggttaccccgttaaccggg

SEQ ID NO: 197632 - DNA, 595 bp, Homo sapiens
  misc_feature: GYAE6OF02J1GW4.39.81.H04.1.454.CMB.1.raw
  modified_base (498)..(498): a, c, t, g, unknown or other
  misc_feature (498)..(498): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcgagcgtcttacagtggtcacacaaactatgacacagaacctcgagggacacgagtacaacatacgaccacgagacacactaccgacgacgacgacgcctacgagtacggacctaggaacggacgcctacggagtactcgtacggaccgaccggacggccgttaggtaattacgtggtacgnggaagtacggagtacggggtaaattgtttacggacgtcggttacccttagtttacggtaacttacggtacggggtacctacggggtaacccttcggg

SEQ ID NO: 197633 - DNA, 621 bp, Homo sapiens
  misc_feature: GYAE6OF02GPTKP.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacacggcccctggacaagggcttggagtggagtgggatggatcgaggcgtcttacaagtggtacaaccaacaaactagtcgacaacacgaacctccgagggcaaggacgtaccaaccatacgaaccacgaagaccaacactacccaacggacgccgacggacctaacacgtacggacccttaggacggacgccgtaggacgtatcgacggtaccgaaccgaccgggcccgttaggttacttacgtgtaggacgaggagtagggtacggtaaatttgtttacgacgttcggttaaccctttgttacgtacgttaaccggtggggacccgtacgggacccttcggg

SEQ ID NO: 197634 - DNA, 563 bp, Homo sapiens
  misc_feature: GYAE6OF02IT2JX.39.81.H04.1.454.CMB.1.raw
  modified_base (386)..(386): a, c, t, g, unknown or other
  misc_feature (386)..(386): n is a, c, g, or t
  modified_base (400)..(400): a, c, t, g, unknown or other
  misc_feature (400)..(400): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaggtctcctgcaaggcttctggttacacctttaccaactatggtatcagttgggtgcgacacggcccctggacaagggcttgagtggatgggatggatcgagcgcttacaatcggtacacacaaactatgcaacagaacctccagggcagagtcaccatcgaccacanacacactccagacncacggccacactcggacctggagacgccgtagagtatcgtagaccgacgaccggacgtgttattactgtacgcgagagacgtagggtaattagttttacgacgttcggtacccttacgtttacgacgttaccggtacgggtaccgtaccgggtacccgtacgg

SEQ ID NO: 197635 - DNA, 649 bp, Homo sapiens
  misc_feature: GYAE6OF02JRJQC.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttggtgcgacaggccctggacagggcttgagtggagtgggatggatcgaggcgtacttaacaagtcggtacacaacaaactatagacaacgaacgaaccctccgagggcaagacgtaccacgatacgaaccacgagacacactccgaacgacgccaacggcctaacacgtacggaccctaggaacggacgccgtaggactacgtccgtaggacccgaacggtaccggtaccgttaggttaaccttacgtagggtacggaccggtaagggacgtacgggttacggggtaaaatttcggttttacggaacggtttaccggttaccctttaggttacggtaccgttacgggtacgggggacccgtaacggggtacccgttacggg

SEQ ID NO: 197636 - DNA, 540 bp, Homo sapiens
  misc_feature: GYAE6OF02JE6FC.39.81.H04.1.454.CMB.1.raw
  modified_base (315)..(315): a, c, t, g, unknown or other
  misc_feature (315)..(315): n is a, c, g, or t
  modified_base (456)..(456): a, c, t, g, unknown or other
  misc_feature (456)..(456): n is a, c, g, or t
  modified_base (460)..(460): a, c, t, g, unknown or other
  misc_feature (460)..(460): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttggtgcgacaggcccctggacaagggcttgagtggatgggatggancagcgcttacaatggtcacacaaactatgcacagaacctccagggcagagtcaccatgaccacagacacatccacgagcacggcctacagtggacctgaggagccgtgacgatctgaccgacacgggccgtgtacgttacnggtncgagagagtacggggaaattgtttagacgtcggtaacccttgttacgacctagtcggggaccctagggaccccttacggg

SEQ ID NO: 197637 - DNA, 852 bp, Homo sapiens
  misc_feature: GYAE6OF02IGT9K.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcgagtgaaggtctccgtgcgaaggcttcgtaggttacctaccttttaaccaacttacgtagggttaacttcgtaagggtttggggtacgaccggaacgtaacgggcccccgttacgggaaacggtaaacggggtccgtttagggaagggttagggtaaggttaggggtacgtttaggggattaccggaaggtccgtaccgtttaacgtaagttacggttaccgaaaccgtaaaccgtaaaacgtaacgttcgaaaccgaccgaaacggtaaacccgttccggaacggggaccaacggtaacggttaacccaaccgttaacggtaaccgaaccctaaacgaacgaactaaccgaacgtacccgaacggaaccgaaccgaaccggtacctaacgtaacgtacgggtaccgtaacggaacgggtacgaccgtagtaacgtacgtaccgtacggaacccggtaacggacccgggtccggttaacggttacgtttaccgtacggtacggaaccggtaacgtaacgggtacggttaaacgggggtaaactttaacggtttacggtacggttaccggttaacccgtttcgttaccgtaacggttaccggtacggggtaacccggtacgggttacccgttaccgggg

SEQ ID NO: 197638 - DNA, 758 bp, Homo sapiens
  misc_feature: GYAE6OF02ISYNT.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggtcttcgtggttacctaccttttaccaactagtggtatctaggttgggtcgcgacgacggtcccccgtggacgaacgggtcttcggaggtaggtagtcggggattagggatccgaggtccgtacgtttacaagttcgggtaccaaccgtaaactaaaacgtacgtacgaccaaccgaacggtaaccccgtaccggaaggggacctaacggtaacggtacccaaacccgtaacgttaccggaaaccccgaaccaacggaacctaaccgtaaccgtaaccccgaaacggtaaccggacccgaaccggtaccctaaactacggttaccgggacccgtaaggcggggtaacctcccggtaagacggttaacgcgttacggaaaccgtaccgaccgggtccgttagttaacgtttccgtaggttcgacggaaggtacgacgggttacgggtaatttacggtttcgacgtttacggtccctttaggttacgttaccgtacggtccggggtaccgtaaccggtccgtacgg

SEQ ID NO: 197639 - DNA, 619 bp, Homo sapiens
  misc_feature: GYAE6OF02GQEHO.39.81.H04.1.454.CMB.1.raw
  modified_base (323)..(323): a, c, t, g, unknown or other
  misc_feature (323)..(323): n is a, c, g, or t
  modified_base (348)..(348): a, c, t, g, unknown or other
  misc_feature (348)..(348): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctgggggcctcagtgaaggtctcctgcaaggcttctggttacacctttaccaactatggtatcagttgggtgcgacacggcccctggacgaagggcttggagtggagtgggatggatcngcgcttacatggtcacacaactatnacacacgaacctcgagggacagtacgtcacatacgaccacacgacacatcccgacgagcaaccggcctaacacgtcggacctggaacggacgtccgtagagtacgtaccgtaggaaccggaccgaccgggtccgttaggttaactttacgtggtacggacgtacggaagtacggtaacggggtaaatttacgtttaggaccgttcggttacccctttaggttttacgaccggttaacggtccgggggtacccgtaccggggaccttccggg

SEQ ID NO: 197640 - DNA, 620 bp, Homo sapiens
  misc_feature: GYAE6OF02I969A.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctccttcaaggcttcgtggttaccacctttaccaactatggtatcagttggtgcgacaggcccctggacaggggcttgagtggagtggggatggatcgaggcgtcttaaccaagttggtacaacgaacaaactatcgacaccaacgaacctccgaagggacagagtaccaaccatacgaacccaacacgaaccaacactacccgaacgacgccgaccgggaccctaacgactacggaccgtaggaaggacgtccgtgagacgtcgagacgaccgaccggcgtacgtagttacgtgtcgcgaggagtacgtacgggtaattacggtttcgacgttacggttacccttcgtttaggtaccgttacggtccgggtaccgacgggtacccgtggtacccgg

SEQ ID NO: 197641 - DNA, 610 bp, Homo sapiens
  misc_feature: GYAE6OF02F5XDZ.39.81.H04.1.454.CMB.1.raw
  modified_base (394)..(394): a, c, t, g, unknown or other
  misc_feature (394)..(394): n is a, c, g, or t
  modified_base (477)..(477): a, c, t, g, unknown or other
  misc_feature (477)..(477): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcgagcgcttacaatggtcacacaactatgcacagaacctcgagggcagagtacacatcgaccacagacacatccacgngacacgcctaacgactacggacctggacggacgccgtagagtactcgacgacgaccgtaccgggaccgttgtaacctttacgnggttcgacggagggaaggtacgtaacggggtaaagtttacggttttacggaaccggtttccggttaaccctttacggttttacggaaccgttaccgggttcgggggaccctaacggggtaccccgttaccggg

SEQ ID NO: 197642 - DNA, 650 bp, Homo sapiens
  misc_feature: GYAE6OF02GINL5.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcaggttgggtgcgacacggcccctggaccgaagggcttggaggtggatgggatggatcgagcgtcttacaatcggacacacaaactatgacacacgacctccgagggcagacgtcaaccatcgaccacgagaaccacactaccacgacgaccgaccggacctacgacgtacgggaccgtaggacggacgaccgtagacgtactacgtcgaaccggtaccgaccggggtaccgttaggttaccgtttacgtcggtcggacggtagggtaggtacgtacgggggtaaatttacggttttacgtaccggttaccggttacccgtttacgttttacggtaaccgtttaccggtacgggggtacccgtaaccggggtaccccgtaccggg

SEQ ID NO: 197643 - DNA, 693 bp, Homo sapiens
  misc_feature: GYAE6OF02H6OGG.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatctagttgggtgcgacgacggcccctggacgaagggcttggagtggagtgggtatggagtcgaggcgtacttaacaatggtacacgaaccaaactatcgactaaccaacgtaacccgtaccgacgggacaacggtaagtacccaacctagtaccgaaccctaacaacgaacctaaccgactacccaacggacgacccgaaccgggtacctaacgacgtacggaacccgtaggaacggacgaccgtcggaagtactcgtacgaccgaaccggaccggtacgttacgtaactttacgtggttacgacggtacgaaggtacggttaaccggggtaaatttacggttttacggaacgttacgggttaaccccgttgttttacggaccggttaccggtaccggggtaaccgtaccggggttaaccctacccggg

SEQ ID NO: 197644 - DNA, 766 bp, Homo sapiens
  misc_feature: GYAE6OF02JNH84.39.81.H04.1.454.CMB.1.raw
  modified_base (525)..(525): a, c, t, g, unknown or other
  misc_feature (525)..(525): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttcgtggttaccacctttaccaacttagtcggtatctaggttgggtgacgacgacggtccccgtgggactaagggtcttaggagtgggtacgtggggataggctcgaggtcgactttaagaacgtggtaccaacgaactaaacgtacgtgaccaagaaccgaacccttaccggaacgggtcgaacggtacgtacctaaccaagttaccggaaccaccgtaagaccacgactaccgaaccggacgaccaccggtactacgtagtacggaacccgtgacgggacgtaccgnggaacgtacgtacgtacgaaccggaccgtaacccgggtacggttacgtttaacgttaaccgttcgggtacggtaaccgggtacgtaaacggtacgggtttaaaccggggtaaaacttttcggttttaaccggaaccggttaccgggtttaaacccccttttcggttttaaccggtaacccgggtttaacgggtacccgggggttaaccccggttaaccggggttaaccccggttacccggg

SEQ ID NO: 197645 - DNA, 575 bp, Homo sapiens
  misc_feature: GYAE6OF02FO3RF.39.81.H04.1.454.CMB.1.raw
tcagtcgcactagtcacgaccggtgctcgatttagtagtgtagattcgcgggggacccaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcgagcgcttacaatggtcacacaaactatgacacagaacctcgagggcagagtcaccatacgaccacagacacactccacgagacacggaccacactacggacctaggacggacgccgtgagactcgtacgacgacgacggccgttagtacttacgtgtcgacgagagtagtacggggtaaattagtttacgacgttcggttacccttcgtttacgaccgtttacggtcggggtacctaacgggtaaccccgttacggg

SEQ ID NO: 197646 - DNA, 702 bp, Homo sapiens
  misc_feature: GYAE6OF02I2TK9.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtggggcctcgagtgaaggtctcctgacaaggtcttcgtggttacctacctttaaccaactataggtactcgtaggttgggtcgcgacgacggcccccgtggaacgaacgggtcttaggaggtggagtggggagtgggatcgagacgtactttaacgaagttggtaccaacaacaaacttatacgaccaacgaacgtaaccctccgaacgggacaaggacgtccaactagtacgaaccacgaacgaaccactactaccgaacgacgccgaaccggtacctactacgtacggaaccgtaggaacggaccgtcgtaggaacgtacgtacgtacggaaccggaccggtaccgggaccgttagttaacgttacgttacgacggacgaacggtagtacgggttaacgggtaagtttaggttttacgacggtttacccggttacccgtttagtttacgtaacgttaccggtaccgggtaccgtaccgggtacccgttaccgg

SEQ ID NO: 197647 - DNA, 629 bp, Homo sapiens
  misc_feature: GYAE6OF02IJED9.39.81.H04.1.454.CMB.1.raw
  modified_base (349)..(349): a, c, t, g, unknown or other
  misc_feature (349)..(349): n is a, c, g, or t
  modified_base (413)..(413): a, c, t, g, unknown or other
  misc_feature (413)..(413): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggagtgggatgggatcagcgtacttacgaatggtcacactaaactntgacaacacgaacctccgagggacaagagtcaccatacgaccacacgaacacatacccacgacnccgacggcctacaactcggacctggaaggacgccgtagaagtactcgtacgaaccggacgaccgggtccgtagttacttacgtgtacggcgaagtaggacggttacgggtaaagtttacttttacggacgtttaccggttaacccgtttacgttttacggtaaccgtttacgggtaccggggtaacccggttaccggggtaacccgtttacccggg

SEQ ID NO: 197648 - DNA, 570 bp, Homo sapiens
  misc_feature: GYAE6OF02IIEWH.39.81.H04.1.454.CMB.1.raw
  modified_base (333)..(333): a, c, t, g, unknown or other
  misc_feature (333)..(333): n is a, c, g, or t
  modified_base (351)..(351): a, c, t, g, unknown or other
  misc_feature (351)..(351): n is a, c, g, or t
  modified_base (406)..(406): a, c, t, g, unknown or other
  misc_feature (406)..(406): n is a, c, g, or t
  modified_base (423)..(423): a, c, t, g, unknown or other
  misc_feature (423)..(423): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttcgtggtactacctttaccaatatggtatcaggttggtgacgacgacggcccctggacaagggtcttgaggtggatgggattggatcagcgacttanaagtgtcacgactaaatntgacactaagaccgtcagggcagaactcaacatgaccacagacacactccaacgnaccgacggcctaacganacggtacgaggaacggtcgacctagagaactctaggaaccgtacgacggtcgtatacgttagaggtcgcgaacgaggacgtagggtaatcgttagacgtacgtcttacgttcggaacgttcggtacgggacctacgggtacctacgg

SEQ ID NO: 197649 - DNA, 725 bp, Homo sapiens
  misc_feature: GYAE6OF02HGBBG.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcgagtgaaggtctcctgcaaggcttctggttacacctttaccaactatggtatcgaggttgggtgcgacgacggcccctaggacgaagggtcttggaggtggagtgggattggatacgagcgtacttaacaagttcggactaacgaactaaaactgtacgaccaacaacgtaacctcgaaggggacaaggacgtaccaaccgtatacggaacccaagacgaacacgtacacccgaagacgaccgaacggaccctagaacgtcggaactggaacggacgtccgtaggacgtaactccgtacggaccgaaccggtaccgggtaccgttacgttaacgttccgttacggtacggacgtaacggtaacggtacggttaaccgggggttaaacttttacggtttttaacggaaccggttttaccgggtttaaccccttttacggttttaccggtaacccggtttacgggttacccggggggtaacccgttaaccggggtaacccccgtttaccgggg

SEQ ID NO: 197650 - DNA, 693 bp, Homo sapiens
  misc_feature: GYAE6OF02IM20T.39.81.H04.1.454.CMB.1.raw
tcagtcgcactagtcacgaccggtgctcgatttagtagtgtagattcgcggggacccaaaaaaccacacccctccttgggagaatcccctagatcacagctcctcaccatggactggacctggagcatcctttttcttggtggcagcaacaacaggtgcccactcccaggttcagctggtacagtctggagctgagatgacgaagccgtggggcctcagtgaaggtctcctgcgaaggtctttcgtggttacctaccctttaccaatagttggtatcagttgggtgcgacgacggcccctggacgaagggtcttggagtggagtgggagtggatcgagcgtcttaacagttggacaacgaactaaactactgacacaacggtaacctaccggaagggccaaggtaccgtaccaacctaacgttacgaacccaacgacgaaccgaactactacccgaacgtacgaccgaccggtaccctaacgacgtacgggaccgtcggaacggtacgccgtagaacgtactacgtacggaaccgaaccgtaccgggccgttacggttaacgtttacgtcggtacggacggtacgaggtacgggtaacgggttaagtttacgtttacggtaccggttacgttacccgtttcgtttacgtaccggttcggttaccgggacggtacccgggtaccgttacccggg

SEQ ID NO: 197651 - DNA, 665 bp, Homo sapiens
  misc_feature: GYAE6OF02I5SEV.39.81.H04.1.454.CMB.1.raw
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacacggcccctggacaagggcttgagtggatgggatggatcgagcgcttacaatggtcacaacaaactatgacacacgaaccctccgagggacaggacgtacaaccatacgaccacgacgacacactacccgaacgacgaccaccggcctaacgagtacggacccgtaggacggacgccgtaggacgtacgtaccgtacggaaccgaccgaccgggtccgttagttaacgtttacgtcggtacggacggagtacgtacggttaacggggtaaaatttttacggttttacggaaccgtttaccgggttaccccttttacggttttacggtaccgtttaaccgggtaccgggggtaccccggtaaccggggtaaccccgtttaccgggg

SEQ ID NO: 197652 - DNA, 573 bp, Homo sapiens
  misc_feature: GYAE6OF02I7UIM.39.81.H04.1.454.CMB.1.raw
  modified_base (275)..(275): a, c, t, g, unknown or other
  misc_feature (275)..(275): n is a, c, g, or t
  modified_base (453)..(453): a, c, t, g, unknown or other
  misc_feature (453)..(453): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtncgacaggccctggacaagggctggagtggatgggatggatcgaggcgcttacaagtcggtacacacaaactatcggacaacacgaacctccgagggacaacgagtcgaaccatacgaccaacaagacaacactaccaacgacgcaccggacctacatacggacctagaggcgcctganctcagacgacgcggcgtagtattacgtgtacgagagcgagtacgggtaaatttagtttgaacttcggttaccctttagttacgaccgttacggtggggaccgtacggggtaaccctcggg

SEQ ID NO: 197653 - DNA, 731 bp, Homo sapiens
  misc_feature: GYAE6OF02JR8XB.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaacggtctcctgcaaggcttcgtgttacacctttaccaactatggtatcgtaggttggtgacgacgacggccccgtaggacgaagggtcttagacggtggtagtgggatggactcgagtcgtactacgtaagtcggtacacgaactaaactagtcgacgaacaacgaacccgtaccgagggtacaacggaacgtaccgaacccaagtacgaaccctacgaagaaccactacctaccgaacgacgaccgaccggtacctacgacgtaccggacctcgggaacgacggtaccgtaggacgtacgtaccggtaggaaacccggtacggtacccggtccgtttacggttaacgtttacccgttgggtaccgacgggtaacgtaagggtacggtaacgggggttaaaacttttcggttttaaccggaaggttttacccggttaacccgttttggtttaacgtaacggtttcccggaacggggtttacccggtaaccgggtacccccgggtttaacgg

SEQ ID NO: 197654 - DNA, 639 bp, Homo sapiens
  misc_feature: GYAE6OF02H3EAL.39.81.H04.1.454.CMB.1.raw
  modified_base (436)..(436): a, c, t, g, unknown or other
  misc_feature (436)..(436): n is a, c, g, or t
  modified_base (448)..(448): a, c, t, g, unknown or other
  misc_feature (448)..(448): n is a, c, g, or t
  modified_base (467)..(467): a, c, t, g, unknown or other
  misc_feature (467)..(467): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcgagtgaaggttctcctgcaaggcttcgtaggtacacctttaccaactatggtatctaggttggtgcgacgaggccctggacaagggcttggagtggagtgggagtggactgacgtcggcttaacgaagtcggtacaactaacgaaaactagtagaccaacaaggaaccctacggagggactaaggacgtaccaacagtcgaacaacagacacacgtcacganacgacgacctanacgtagaccgtagaggacnccgtagacgtatcgtagaaccggtacaccggtacgttacgtaacttacgttaccggtgacggtaagaggtacgggtaacgggttaaagttagttttaacggtaccggtacggttaaccccgttgtttacgtacgtacggttaccgggaccgttaccgggaccgttacccggg

SEQ ID NO: 197655 - DNA, 630 bp, Homo sapiens
  misc_feature: GYAE6OF02HJJTW.39.81.H04.1.454.CMB.1.raw
  modified_base (343)..(343): a, c, t, g, unknown or other
  misc_feature (343)..(343): n is a, c, g, or t
  modified_base (349)..(349): a, c, t, g, unknown or other
  misc_feature (349)..(349): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacatggtcacacaaactntgacanacgaacctcgagggcaggagtacaccatcgaccacagaccacactaccgacgacgcgaaccggacctacgactacggaccttggaacgggacgcccgttagacggtactccggtagaaccgaaccgaccgggtcccgttaggttaacgtttaccgttggtacggacgtaggaagtacggtacgggggtaaattacggttttacggacgtttacgggttaacccctttgtttacggtaccgttaccggtcgggggtacccgacggggttacccgttaccggg

SEQ ID NO: 197656 - DNA, 638 bp, Homo sapiens
  misc_feature: GYAE6OF02HOOE2.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacacggccctggacaagggcttgagtggagtgggatgggatcgaggcgtcttacaagtggtacaacaactaaactatagacacaacgaacctccgagggacaaggacgtacaaccatacgaccaacacgaccacactaccaacgacgaccaccggacctacacgtacgggaacctagggaacggacgccgttagaagtactcgtacggaccgtaaccgaccgggtccgttagttaacgttacgtggtcgacggaaggacgtacggtaacgggtaaagtttacgttttacggaacgttaccggttacccgtttagttacgtacgtacggttcggggtaaccgtaccgggtacccgttacggg

SEQ ID NO: 197657 - DNA, 596 bp, Homo sapiens
  misc_feature: GYAE6OF02FKGKJ.39.81.H04.1.454.CMB.1.raw
  modified_base (281)..(281): a, c, t, g, unknown or other
  misc_feature (281)..(281): n is a, c, g, or t
  modified_base (397)..(397): a, c, t, g, unknown or other
  misc_feature (397)..(397): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcgagtgaaggtctcctgcaaggcttctgggttacacctttaccaactatgtatcagttggtgcgacngcccctggacaagggcttggagtggagtgggatggatcagcgcttacaagtcggtcaacacaaactatgacacacgaacctcgagggcagatcaccatacgaccacacgacacacnccacgagccacgcctacacgacggacctgacggacgccgtagacgactcgacggaccgacgtaccggccgttagttactttacgtggtcgaggacgtaggagtacggggtaaatttacggtttcgtaacgttccggttacccgttcgtttacgtacgttaccgggtacgggtacccggtaaccgggtaccgttcccggg

SEQ ID NO: 197658 - DNA, 669 bp, Homo sapiens
  misc_feature: GYAE6OF02IHETP.39.81.H04.1.454.CMB.1.raw
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcagcttctggttacacctttacaactatggtatcagttggtgcgacaggcccctggacaagggtcttggagtggagtgggagtggatcgaggccgtacttaacaagttcgggtaccaacgaacaaaacgttactacgaccaactaacgaaacccgtccggaagggacacggaacgttccgaaacccaagttaccggaaacccaaccgaacgaaccaacaactacccgaacggaacgaccgaccggtacctaaccgacgttacgggaccgtaggaacgggacgtccgtagacgtactaccgtacggaaccgaccggtaccggtaccgttacgttaacgttacgtgtacggacgaaggtagtaggtacgggtaaatttcgtttacgacgttacgttacccttgtttacgacgttacggtcgggacgtaccgggtacctcgg

SEQ ID NO: 197659 - DNA, 630 bp, Homo sapiens
  misc_feature: GYAE6OF02GHX03.39.81.H04.1.454.CMB.1.raw
  modified_base (380)..(380): a, c, t, g, unknown or other
  misc_feature (380)..(380): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttgggtgcgacaggtccccttgacaagggcttgagtggatgggatggatcagcgacttacaatggtcaacaacaaaactatcgacacaagaaccctcgaggcagatcaaccntcgaccacagacacatccacgacgcgaccggacctacgacgtacggacctggaacggacgccgtagacgtatactcggaaccgaccgaccgggtccgtaggttaacttaaccgtggtcggacgtaacgaggtacggtaacggggtaaatttacggttttacggaaccgttaccgggttaaccctttacggttttacggaaccgttaacggggttccggggaaccggtaacccggggtaacccttccgggg

SEQ ID NO: 197660 - DNA, 726 bp, Homo sapiens
  misc_feature: GYAE6OF02IK0P0.39.81.H04.1.454.CMB.1.raw
tcagtcgcactagtcacgaccggtgctcgatttagtagtgtagattcgcgggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttactacctttaccaactatggtatctagttggtgacgacacggcccctaggacgaagggtcttggagtggagtggggtagtggatcgaggcgtacgttaacaagtggtacaacaactaaactatcgacacgaagaaccctccggagggtaccaaggacgtaccaacctacgtacgaaccaacgaacgaaccaacgtaaccgtacccgaacggaacgacccggaaccggtacccttaacgaacgttaccggggtacccgttagggaaacggggacgtacccgttaagggaacgtaacgtaccggtacggaaaccggtaaccggtacccgggtaccggttagtttaaccgtttacgttcgggtacgacggtaagtaacggtaggttaaccggggtaaattacggttttacgaccgtttacggttaccctttacggttacgtaaccgttacggtacggggaccgtaacccgggtacgttacccgg

SEQ ID NO: 197661 - DNA, 747 bp, Homo sapiens
  misc_feature: GYAE6OF02IFCUB.39.81.H04.1.454.CMB.1.raw
  modified_base (291)..(291): a, c, t, g, unknown or other
  misc_feature (291)..(291): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctccttcgaaggcttctggttaccacctttaccaacttatggtatctagttggtgcgacgaggccccnggacaagggcttgaggtcggtagtgggatggatcgagcgtacttacgaagttggtaccaacgtaacaaaaccttagttacggacctaacgaaccgaaccgtcccgaacggggccaaggaaccgttccaaacccgtacgttaccggaaccccaacgtaacggaaccaaccgaaccttaacccgaaccgaacggttaacccgaacccgggtaccctaaccgaagtccgggtaacccgtaggaccgggacgtcccgtaggaacgtacgtcggtaacgaccggaacgtaccgggtaccgtagttaaccgttacgttcggtgtaccggagtaacggagtaaccggggtaaattttacggttttacggaaccgtttccggtttaacccgtttcgtttaaccggtccgttaacgggttccggggtaacccggtaaccgggttaccccgttacgggtaccccgg

SEQ ID NO: 197662 - DNA, 565 bp, Homo sapiens
  misc_feature: GYAE6OF02INB9I.39.81.H04.1.454.CMB.1.raw
  modified_base (275)..(275): a, c, t, g, unknown or other
  misc_feature (275)..(275): n is a, c, g, or t
  modified_base (350)..(350): a, c, t, g, unknown or other
  misc_feature (350)..(350): n is a, c, g, or t
  modified_base (352)..(352): a, c, t, g, unknown or other
  misc_feature (352)..(352): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtncgacaggcccctggacaagggcttgagtggatggggatggatcagcgcttacaatggtcacacgaaactatgcananaacctccagggcagatcaccatcgaccacagaccacactaccacgagcacggcctacactcggactgaggagacctagagatctagacgacgacggcgtgtagttacgtgtacgacgagagagtacggggtaaagttagttttacggacgttacggttacccgttcgtttacgtaccgttaccgttcgggaccgtacggggtaaccctacggg

SEQ ID NO: 197663 - DNA, 617 bp, Homo sapiens
  misc_feature: GYAE6OF02HZUAY.39.81.H04.1.454.CMB.1.raw
  modified_base (279)..(279): a, c, t, g, unknown or other
  misc_feature (279)..(279): n is a, c, g, or t
tcagtcgcactagtcacgaccggtgctcgatttagtagtgtagattcgcgggggacccaaaaaaccacacccctccttgggagaatcccctagatcacagctcctcaccatggactggacctggagcatcctttttcttggtggcagcaacaacaggtgcccactcccaggttcagctggtacagtctggagctgagatgacgaagccgtggggcctcagtgaaggtctctgcaggcttctggttacacctttaccaactagtggtatcgagttgggtncgacacggccccgtaggacgaagggtcttggagtggatgggatggatcgagcgtcttaacaagttcggacaacaacaaactatgacacgaacgaaccctcgagggacaaggacgtccaaccatacgaccacaagaaccacactaccaacgacgacgacgactaacagtacggactacggacggacgccgtagaacgactacgtacggaacgaccgacggtaccggtattaacgtagttgtgacgagagtaggtaacgggtaacgttgtttaacgtacgttacggttacccgttacgtttagaccgttacggtacgggaccggaccgggtacccgtcgg

SEQ ID NO: 197664 - DNA, 656 bp, Homo sapiens
  misc_feature: GYAE6OF02JG35K.39.81.H04.1.454.CMB.1.raw
  modified_base (278)..(278): a, c, t, g, unknown or other
  misc_feature (278)..(278): n is a, c, g, or t
  modified_base (358)..(358): a, c, t, g, unknown or other
  misc_feature (358)..(358): n is a, c, g, or t
tcagtcgcactagtcacgaccggtgctcgatttagtagtgtagattcgcgggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttcgtggttaccacctttacaactatggtatctagttgggtncgacacggcccctggaacaagggcttggagtggagtcgggatgggatcgagcgcttacaagtcggtacactacaaattangacacgacgaacctccgaagggcaaggactacaaccagtcgaaccacagaccgacactacccaacgacgccgaacggacctaacagtacggaacccttgggaacggtacgacccgtggaaacgtactaccgtacggaaccgaccggtaccgggtccgttaggttaacgttacggtcgtacggacggtaaggtacggtagtaacggggaattttaacgtttacgaccggttacggttacccgttctttaacggtacgttaccggggtacgggtaacccggtacggggtacccttacggg

SEQ ID NO: 197665 - DNA, 609 bp, Homo sapiens
  misc_feature: GYAE6OF02G7JF3.39.81.H04.1.454.CMB.1.raw
  modified_base (273)..(273): a, c, t, g, unknown or other
  misc_feature (273)..(273): n is a, c, g, or t
  modified_base (299)..(299): a, c, t, g, unknown or other
  misc_feature (299)..(299): n is a, c, g, or t
  modified_base (322)..(322): a, c, t, g, unknown or other
  misc_feature (322)..(322): n is a, c, g, or t
  modified_base (346)..(346): a, c, t, g, unknown or other
  misc_feature (346)..(346): n is a, c, g, or t
  modified_base (351)..(351): a, c, t, g, unknown or other
  misc_feature (351)..(351): n is a, c, g, or t
  modified_base (373)..(373): a, c, t, g, unknown or other
  misc_feature (373)..(373): n is a, c, g, or t
  modified_base (380)..(380): a, c, t, g, unknown or other
  misc_feature (380)..(380): n is a, c, g, or t
  modified_base (430)..(430): a, c, t, g, unknown or other
  misc_feature (430)..(430): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttggtncgacaggcccctaggacaaggcttgngtggagtgggatggatcgagcgnttaacatggtcacacaaactcganacaanacctccaggacagacgtcacancgaccanagacacactccaacgacgacacggacctacgagtacggacgtacgagganccgtagacgagtacgacgacgtaacgaccggtaccgtacgttacgttaacgtcggttacgacgaggtaacggtacgttaacggggtaaatttacggtttacgtaaccggttcggttaaccccgtttagtttacgtaccgttaaccggtcggggtacccgtacgggtaaccccgtacggg

SEQ ID NO: 197666 - DNA, 686 bp, Homo sapiens
  misc_feature: GYAE6OF02HBK5T.39.81.H04.1.454.CMB.1.raw
  modified_base (260)..(260): a, c, t, g, unknown or other
  misc_feature (260)..(260): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttactaccttacaactntggtatcagttggtgcgacgaggcccctggacaagggtcttggaggtggagttgggattggatcgagcgtcttacgaagtggtcaacaacgtaaactagtgacacgacgtaaacctcgaagggcaagtacgtacaaccgatacgaccaactaagaccaacactacccgaacgacgaccgaaccggacctaacgtacgtacggacccgttaggaacggtacgtcccgtaggaacgtacgtacgtacggtaaccgaaccggtaccgggtccgttaggttaactttaccgtaggtacggacggaacgtaaggtacgggttaacgggtaaagtttaacggttttacggaccgttaccggttacccgtttaccgtttacggtaacgttaccgggtacggggtacccgttaacgggtaccccggttaccggg

SEQ ID NO: 197667 - DNA, 636 bp, Homo sapiens
  misc_feature: GYAE6OF02ISTWK.39.81.H04.1.454.CMB.1.raw
  modified_base (373)..(373): a, c, t, g, unknown or other
  misc_feature (373)..(373): n is a, c, g, or t
  modified_base (386)..(386): a, c, t, g, unknown or other
  misc_feature (386)..(386): n is a, c, g, or t
  modified_base (405)..(405): a, c, t, g, unknown or other
  misc_feature (405)..(405): n is a, c, g, or t
  modified_base (420)..(420): a, c, t, g, unknown or other
  misc_feature (420)..(420): n is a, c, g, or t
tcagtcgcactagtcacgaccggtgctcgatttagtagtgtagattcgcgggggacccaaaaaaccacacccctccttggggagaatcccctagatcacagctcctcaccatggactggacctggagcatcctttttcttggtggcagcaacaacaggtgcccactcccaggttcagctggtacagtctggagctgagatgacggaagccgtggggccctcagtgaaggtctcctgacaagcttctggttactacctttaccaactatggtatctagttgggtgcgacgacggccccgtggacgaagggcgttgaggtaggagtgggagtggatcgaggtcgtacttacgaagtcggtacacaactaaactancgacacacgaccnccgaggacagacgacacanacgaccacgacacanactaccgacgcgacgacggactacacgtaccgggaccgtggaacggacgccgtaggaacgtacgtcgacgacgtaccggaccgggtccgttagttaacttggtagtacggagaagggagtagggtacgggttaagtttacggtttacgtaccgttcggttaccgttacgttacggtacggtacgggtaccggggaccggttaccgggaccttcggg

SEQ ID NO: 197668 - DNA, 587 bp, Homo sapiens
  misc_feature: GYAE6OF02JK40B.39.81.H04.1.454.CMB.1.raw
  modified_base (349)..(349): a, c, t, g, unknown or other
  misc_feature (349)..(349): n is a, c, g, or t
  modified_base (462)..(462): a, c, t, g, unknown or other
  misc_feature (462)..(462): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacaatctggagctgagatgacgaagcctggggcctcagtgaaggtctcctgcaaggcttctggttacaccttttaccaactatggtatcgtagttggtgcgacaggcccctggacaagggcttggagtggagtgggatggatcgagcgcttacaagtggcaacacaaactntcgcacacgaacctcgagggcaagagtcaacagtacgaaccacaacgaccacgactaccgaacgagccaccggacctacgagtacggacctggaacggacgccgtagaacgtntcgtagaccgaccgacggccgtagttacttacgtgcgagagtagacgtacgggtaattgtttacgacgttacgtacccttagttacggaccgttacgacggggtacctaacgggtacccgttcgg

SEQ ID NO: 197669 - DNA, 617 bp, Homo sapiens
  misc_feature: GYAE6OF02HAP7B.39.81.H04.1.454.CMB.1.raw
tcagtcgcactagtcacgaccggtgctcgatttagtagtgtagattcgcgggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttggtgcgacaggcccctggacaagggcttgagtggagtgggatggatcgagcgcttacgaatggtcacacaaactatgctacacgaacctccgagggacagacgtacaccatacgaccacagaacacactaccacgacgaccaccggacctacacgtacggaccctaggacggacgccttagacgtatctcgaaccggacgacggccgttagttacttacgtggtcgaccgggagtacgtacgggttaacggggtaaatttggttttacggacgttttaccgggtacccctttgttttacgaaccgttaccggtacgggggtacccgtaccggggtaccccttccgggg

SEQ ID NO: 197670 - DNA, 628 bp, Homo sapiens
  misc_feature: GYAE6OF02HLDPI.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcgagcgtcttaacaatggtacacacaaactatgacacacgaacctcgagggcagacgtcaccatcgaccacacgacacacaccacgagccacggacctacgatacggaccctaggaacggacgaccgtagacgtatacgtacggaaccgaccgaaccgggccgttaggttaacgtttaaccgtggttacgcggtaagaacggtacggtacgggggttaaacttagttttacggaccgttacgggttacccttcggttttacgtaccgttaccggttacgggggtacccgtaccggggtaaccccgttacggg

SEQ ID NO: 197671 - DNA, 678 bp, Homo sapiens
  misc_feature: GYAE6OF02ICY46.39.81.H04.1.454.CMB.1.raw
  modified_base (244)..(244): a, c, t, g, unknown or other
  misc_feature (244)..(244): n is a, c, g, or t
  modified_base (507)..(507): a, c, t, g, unknown or other
  misc_feature (507)..(507): n is a, c, g, or t
  modified_base (565)..(565): a, c, t, g, unknown or other
  misc_feature (565)..(565): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccagtttcagctggtacagtctggagctgagatgacgaagccgtggggcctcgagtgaaggtctccgtgacaaggctttcnggttacaccttttaaccatatggtaatctagttcgggtgtcgacgtaggcccctaggacgaaggggctttagacgttggatagggtagtggatcgagcgtacgttacgaagtggtcacaacgtaaactatacgacgtaaccagaaaccctcgacggggacaacgggtaactacccgaactacgttacgacccgaacgacgaccacgactaccagaacgacgaccggacctaacagtacggacccgttaggaacgggacgtacncggtaacgtacgaccgtacggaaccgaaccgaccgggtaccgttaggtaactttacgnggttacggacgttaacgagtacggtacgggtaaagttacggtttgaccgttacggttacctcggtttacgaaccgttaccggtcgggtacccgtaccgggtaaccttccgggg

SEQ ID NO: 197672 - DNA, 633 bp, Homo sapiens
  misc_feature: GYAE6OF02IAZX5.39.81.H04.1.454.CMB.1.raw
  modified_base (255)..(255): a, c, t, g, unknown or other
  misc_feature (255)..(255): n is a, c, g, or t
  modified_base (391)..(391): a, c, t, g, unknown or other
  misc_feature (391)..(391): n is a, c, g, or t
  modified_base (417)..(417): a, c, t, g, unknown or other
  misc_feature (417)..(417): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaggcttctggtacactttacaactntggtatcgagttgggtgcgacaggcccctaggacgaagggtcttggagtggagtgggatgggtactcgagcgacttacgaattgggacctaacgacaaactagtcgactacacgaactcgagggcagacgtcacancgacacgacgacacataccgacgacncgacgaccacgaacgcggacgtgacggacgccgtagacgtactacgtacgacgtaacgaccggaccgttacgtacgttacgtcggtacgaacggagtaggtaacggttaacggggtaattaacggtttacggtaccggttaccggttaacccgttacgtttcggtaccgttaccgggttaccgggtaaccggtacccgggtaaccgtttcccgggg

SEQ ID NO: 197673 - DNA, 644 bp, Homo sapiens
  misc_feature: GYAE6OF02HKG5N.39.81.H04.1.454.CMB.1.raw
  modified_base (514)..(514): a, c, t, g, unknown or other
  misc_feature (514)..(514): n is a, c, g, or t
tcagtcgcactagtcacgaccggtgctcgatttagtagtgtagattcgcgggggacccaaaaaaccacacccctccttggggagaatcccctagatcacagctcctcaccatggactggacctggagcattccttttcttggtggcagcaaacaacaggtgcccactcccaggttcagctggtacagtcgtggagctgagatgacgaagccgtgggcctcgagtgaagtctctgcgaggtcttcgtggttactacctttaccaactagtgtatctaggttgggcgccgacgacggtccccgtaggaacgaagggtctaggaggtggagtggggatggagtcgagcgtacttaacaagtggtacaacaaacgtaaactgtacgacaacgaacgtaaccctaccgagggacaggacgtaccaaccgtagtacgaacccaactacgaaccacgaacctacccgaaacgtacgaaccgtaaccggacctaacgagtacggtaccgtaggaacggaccncgtagacgtactacgtacgaccgacggtacggtcgttagttactacgtgagcgaagacgtaggtaacggtaattggttacgacgttcgtaccttgttacgacgttacggacggacgtacggtacctacgg

SEQ ID NO: 197674 - DNA, 570 bp, Homo sapiens
  misc_feature: GYAE6OF02JH3SG.39.81.H04.1.454.CMB.1.raw
  modified_base (349)..(349): a, c, t, g, unknown or other
  misc_feature (349)..(349): n is a, c, g, or t
  modified_base (388)..(388): a, c, t, g, unknown or other
  misc_feature (388)..(388): n is a, c, g, or t
  modified_base (442)..(442): a, c, t, g, unknown or other
  misc_feature (442)..(442): n is a, c, g, or t
tcagtcgcactagtcacgaccggtgctcgatttagtagtgtagattcgcgggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcgagttgggtgcgacacggcccctggacaagggcttgagtggatgggatggatcgagcgcttacgaatggtcacacaaactntgacacagaacctcagggcagagtacaccatcgacacanacacactaccacgacgcacggtcacagtcggacctagaggagccgtagagtacncgtagaaccgacgacggccgtagtattacgtgtcgacgagacgtagtacggggtaatttagtttacgacgttacgtacccttagtttacgacgttaccggtgggtaccgtacgggtaacccgtccggg

SEQ ID NO: 197675 - DNA, 740 bp, Homo sapiens
  misc_feature: GYAE6OF02IW54B.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctgtacagtctggagctgagatgacgaagccgtggggcctcgaggtgaaggtcttccctgaccaagggtcttcgtaggttacctacccttttaccgaacttagttggtatcaggttgggtcgacgacgacggcccctgggaacgaagggtcttacggaggtcggaggttgggagttcgggatcgaaggtccgtacgttaacaacgttggtaccaactaacgaaacgttagtacgaccgtaacgtaccgtaaacccgtccggaaacggggtccaaacggtacggtaaccacgtaacgtaccgaaccaacgaacgtaaccacgtaaccgtaccgaacggacgacccgaccggtaacctaaccgtacggtccggaaccgttaagggacggtacgacccgttaggaacgtaccgtagtacgaaccgacgaccggtccgtaggttacttacgtcgtggaaccgaggtacgtacggtaacggtttaacgttacgtttacggacctttaaccggttaccctttgtacccggttacgttaaccggcgggttacccggacgggtaacccgttccgg

SEQ ID NO: 197676 - DNA, 726 bp, Homo sapiens
  misc_feature: GYAE6OF02IT9X6.39.81.H04.1.454.CMB.1.raw
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggtcttctggttacaccttaccaactatcggtatcgaggttgggtgcgacacggccctggacaagggcttgaggttggaagtggggatggatcgaggtccgtacttaacagtcggtacaacgaacgtaaactatcggacacgaacgaacccgtaccgaacggggacaacggacgtaccaacctactacgacccaacgagaccaacgactaccaacgaccgactaccggacctaacgacgtacggaccgtaggacggacgaccgtagaacgtactacgtacggaaccgtaaccggtaccgggtaccggtttagtaaccgttttacgcggtacggacggtaaacggtacgggtacggttaaccgggggtaaaatttcggttttaacggtcccgggtttaaccgggtttaccccgttttacgggtttaacccgtacccggttaaccggggttcccggggtaacccggttaaccgggggtaaccccgttacccgggg

SEQ ID NO: 197677 - DNA, 600 bp, Homo sapiens
  misc_feature: GYAE6OF02F972P.39.81.H04.1.454.CMB.1.raw
  modified_base (573)..(573): a, c, t, g, unknown or other
  misc_feature (573)..(573): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggtcttgagtggagtgggatggatcgagcgtacttacgaagtggtcaacacaaactatgcaacacgaacctccgagggcagacgtcaaccatacgaccacagacacactaccacgagaccgacggacctacgagtacggaccgtggaacggacgccgtaggagtactcgtacggaaccgacgaccgggtccgttagttactttacgtgtcggacgagagtagtaacggggtaattgttttaggaccgttcggttacccttgtttacgacgtttaccggnggggtacccgtacgggtacccgtcggg

SEQ ID NO: 197678 - DNA, 610 bp, Homo sapiens
  misc_feature: GYAE6OF02HRADU.39.81.H04.1.454.CMB.1.raw
  modified_base (382)..(382): a, c, t, g, unknown or other
  misc_feature (382)..(382): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatcctttttcttggtggcagcaacaacaggtgcccactcccaggttcagctggtacagtctggagctgagatgacgaagcctggggcctcagtgaaggtctccgtgcaaggcttctggttacacctttaccaactatggtatcagttgggtgcgacgaggcccctggacaaggcttgagtggatggatggatcagcgcttaacatggctacaacaaactatgcacagaactccagggcaggactcgacatacaccanacgtacacatccgaacgagcacggacctacactagggtaccaggtacggagccttagatacgtctagaccgaacgaccgggtcccgtaggttacttaacgttcggtacgcggtaacgaagtacggtaccggggttaaaattacggttttacggtaccgtacgggtttaacccttcggttttacgaccgttaacggttaccgggggaccgtaagggtacccccttaggg

SEQ ID NO: 197679 - DNA, 652 bp, Homo sapiens
  misc_feature: GYAE6OF02IJVB8.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgtacaggcccctggacaagggcttgagtggatgggatggatcagcgcttacaatggcacacaaactatgcacagaacctcaggcagagtacaccatgaccaacgagaccacactacccacgacgaccaccggacctaacgacgttaggaacccgtggtaacgggacgaccgtaggtaacgtataccgtggaaccgaacgtacccgggtaccggtagttaacgttaaccgttcggtacggtacgggaacgtagggtaacggtacgggggttaaaacttcgttttttaggaacgtttaccgggttaaccctttacgttttacggaccgtttaaccggtacgggggtacccgttaaccgggtaaccccggttaccgggg

SEQ ID NO: 197680 - DNA, 747 bp, Homo sapiens
  misc_feature: GYAE6OF02HWWTL.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtctcctgcaaggtcttcgtggttactaccttttaacaacttagtggtatcgtaggttgggtcgcgactacggccccgtaggacgaacggggtcttggaggttggaagtgggagtggatcgaggcgtactaactaagtcggacaacgaactaaactatacgacaacgtacgaacccgtcgacgggacaacgaacgtacaaccgacgtacgaacccaacgaacggaacctaacgtacgtaccgaacggacgacgtacggaacctaacggtacgtacggtaccgtaggaacgggacgtcgtacggaacgtcgtaaccgttaggaaccggtaccgacccgggtcggttacgttaacgtttacgttacgggacggaacggaaggtaacggtaacgggtaacggggtttaaacgttcgttttaacgggttaccggttaaccgggttttacccctttgggtttaaccggtacccggtttaaccgggtacccgggggtaaccggttacccggggttaaccggttacccggg

SEQ ID NO: 197681 - DNA, 721 bp, Homo sapiens
  misc_feature: GYAE6OF02IOQP6.39.81.H04.1.454.CMB.1.raw
  modified_base (281)..(281): a, c, t, g, unknown or other
  misc_feature (281)..(281): n is a, c, g, or t
  modified_base (340)..(340): a, c, t, g, unknown or other
  misc_feature (340)..(340): n is a, c, g, or t
tcagtcgcactagtcacgaccggtgctcgatttagtagtgtagattcgcggggacccgaaaaaccacaacccctccttcgggagaatccctagatcacagctcctcaccatggactggacctggagcatccttttcttggtggtcagcaacaacaggtgccactcccaggttcagctggtacagtctggagctgagatgacgaagcctggggcctcgagtcgaaggtctcctgcaaggcttcgtggttacaccgtttacaactatcggtatcaggttggtncgtacgacggcccctggacaacgggtcttaggacggtggatggggatgggatgagcggnttaacaagtggtacactaacgaaactagtgacacgagaacctcgaaggcaagacgtcgaacctagtcgaacccacgacggaacaacacgtacccgacgtaacggaccgtaaccggcctaaacgacgtaccgggtaaccgtagggtaaccggaacggtacccgttacgggaagtaccgtacgttaacggaaccggtaaaccgaaccgggtccggttaacgttaacttaaccgttacggttacgaccggtaacgggtacggtaacggttaccgggggttaaagttaacgttttcgggtaaaccgttacgggtttaacccgttacgtttaccggtaacggtaccggttacggggtaaccgtaccggggtaacccgtttaccggg

SEQ ID NO: 197682 - DNA, 634 bp, Homo sapiens
  misc_feature: GYAE6OF02F8KYQ.39.81.H04.1.454.CMB.1.raw
tcagtcgcactagtcacgaccggtgctcgatttagtagtgtagattcgcgggggcccaaaaaccacacccctccttgggagatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacaccttttaccaactatggtatcagttgggtgcgacaggcccctggacaagggcttgagtggatgggatggatcagcgcttacatggtcacacaaactatgcacagaacctcagggcagacgtcaccatacgaccacaagacaacactccaacgacgccaacggcctaacacgtacggaccctaggaacggacgcccgtagtacgactccgtacggtaaccggaccgtaccgggtacccgttaggttaacgtttaccgtagttacggacgtaaggaacgtacgtacgggggtaaaatttaagttttacggaacgttaccgggttacccgtttaccgtttacggtaccgttaccggttacgggggacccgtaacggggtacccgttaccggg

SEQ ID NO: 197683 - DNA, 859 bp, Homo sapiens
  misc_feature: GYAE6OF02JKULN.39.81.H04.1.454.CMB.1.raw
tcagtcgcactagtcacgaccggtgctcgatttagtagtgtagattcgcggggacccaaaaccacaccctccttgggagaatccctagatcacagctcctcaccatggactggacctggagcatccttttcttggtggcagcaacaacaggtgcccactcccaggttcagctggtacagtctgagctgagatgacgaagccgtgggcctcagtgaagtctcctgacacggcttctggttacacctttaccaacttatcggtatcgagttgggtagtcgaacgacggcccccgtaggaccgaagggtcttaggacgttgggagtaggggtatgggtaattcggaggtacgtacgttaacgtaaacggtcgggtaccaaccaacgtaaaactagtacgacctaaccgaagtaacccgtaccggaaaggggtcccaaggggtaactttacccaaaccgtacgtaccggtaaaccccgaacggaaaccgaacccgtaacgaaacccgttacccgaaacccgtaacggtacccgaaacccggggtaccctaaccgtacggttaaccgggtacccgttacgggaaacgggtacccggttacccgtaacggtaaccgggtaaccgtaccggttaaccgggaaccggtaaacccggacccggggtaccccggttaggtttaaccccttagggttaccgggtttaccgacgggtaaaccgggtagtaacggggtttaaccggggtaaacggtttaacggtttttaccgggaaacgttttcccgggtttaaccctttacccggttttaaggtaccggttacccggttaccgggggttacccggtaccgggttaaccccggttaccgggg

SEQ ID NO: 197684 - DNA, 626 bp, Homo sapiens
  misc_feature: GYAE6OF02JQO7Z.39.81.H04.1.454.CMB.1.raw
  modified_base (456)..(456): a, c, t, g, unknown or other
  misc_feature (456)..(456): n is a, c, g, or t
tcagtcgcactagtcacgaccggtgctcgatttagtagtgtagattcgcggggacccaaaaaccacacccctccttggagaatccctagatcacagctcctcaccatggactggacctggagcatccttttcttggtggcagcaacaacaggtgcccactcccaggttcagctggtacagtctggagctgagatgacgaagctggggcctcagtcgaaggtctacctgcgaagcttctggttacaccgtttaccaactactgtatcagttgggtgcgacaggccctggacaagggcttggagtggagttgggatgggatcgacgtcggacttacgaatcggtcacgtaacaactatgacacacgaacctcagggccagacgtacacctatcgaaccacacgtaacgacactcccacgacgtcgacgaccgtacaacgtcggacctggtaacggacnccgttagacgtaagtcctaggtaaccaaccgacgggtcccgtaaggttacttacgtcggtaacgcggtaacggaagtacggtacggggtaaatttaacggttttcaacggttcgttaacccgttgtttacgaacgttcgttaccgggggaccctacgggtaacccgtcgg

SEQ ID NO: 197685 - DNA, 628 bp, Homo sapiens
  misc_feature: GYAE6OF02JKWNM.39.81.H04.1.454.CMB.1.raw
  modified_base (273)..(273): a, c, t, g, unknown or other
  misc_feature (273)..(273): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttggngcgacagccctggacaagggctgagtggagtgggatggatcgagcgcttacaagtggtcacacaaactgtacgcaacacgaacctccgagggacacgtacgtcaaccaatacgaacccacagacgaacactacccaaggaacgccgaacggaccctaacacgtacggacctaggacggacgccgagaacgtctcgtagaccgacgaccggccgtaggtaatttacgtcggtacgacggtacgaagtacggtacggggtaaacttaggtttagaccggttaccggtttaccgttccggtttacgtaaccggttaccggtaccgggggtacccgtaccgggtaaccccgttaccggg

SEQ ID NO: 197686 - DNA, 626 bp, Homo sapiens
  misc_feature: GYAE6OF02IVFXU.39.81.H04.1.454.CMB.1.raw
  modified_base (282)..(282): a, c, t, g, unknown or other
  misc_feature (282)..(282): n is a, c, g, or t
  modified_base (353)..(353): a, c, t, g, unknown or other
  misc_feature (353)..(353): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatcctttttcttggtggcagcaacaacaggtgcccactcccaggttcagctggtacagtctggagctgagatgacgaagccgtggggcctcagtgaaggtctcctgcaggcttcgtgttacacctttaccaactatggtatcagttgggtgcgacncggccccgtggacgaagggcttgaggtggagtgggagtggatcgagcgtactacagtggtcacgaacaatntagcaacgagaaccctcgaggcagacgtcaactagacgaccagacgacacactaccgacgacgacgaccgacctacgacgtacggtaccgtaggaacggacgccgtaggacgtacgacgtcggaaccggtaccgaccgggtaccgttagtaacgtttacgtggtcgtacgaacgtaggtacggtaacgggttaagttagttttacggacgttaccgttaccgtttacgttacgtacgttaccggtaccgggacggtaccggtacccgttccgg

SEQ ID NO: 197687 - DNA, 582 bp, Homo sapiens
  misc_feature: GYAE6OF02G0MM0.39.81.H04.1.454.CMB.1.raw
  modified_base (331)..(331): a, c, t, g, unknown or other
  misc_feature (331)..(331): n is a, c, g, or t
  modified_base (464)..(464): a, c, t, g, unknown or other
  misc_feature (464)..(464): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggttctcctgcaaggcttctggttacacctttaccaactatgtatcagttgggtgcgacacggcccctggacaagggcttgaggtggagtggggatggatcagcgcttanatggtacacaacaaactatcgacacgacgaacctccgagggaccaggacgtacactacgtcgacccacgacgaccacactaccacgagaccgacggacctacgatcggaccgtggaggacgctggactatccnggaacgaccgaccggtaccgtgtattaccgtggtgagtagaggagtacgggtaattgtttacgacgtcgttacccttgtttacgtacgtcggtacgggtaccgacgggtacccgtcgg

SEQ ID NO: 197688 - DNA, 666 bp, Homo sapiens
  misc_feature: GYAE6OF02FK00R.39.81.H04.1.454.CMB.1.raw
  modified_base (354)..(354): a, c, t, g, unknown or other
  misc_feature (354)..(354): n is a, c, g, or t
tcagtcgcactagtcacgaccggtgctcgatttagtagtgtagattcgcgggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcgagtgaaggtctcctgcaaggcttctggttacacctttaccaactatggtatctaggttggtgcgacacggcccctgggacaagggctgagtggatgggatggatcagcgtacttaacgaatcggtacactacaaactntgacaacacgaacctccgagggacacgacgtaccaaccatacgaccaactacgacacactaccgacgacgtacaccggtcctaacagtacggaccgtggacggactccgtagacgtactacgttacgggaaccggtaccgaccggtaccgttacgttaactttacggttcgggtacgcggtaagggtaacgtacgggttaacgggtaaattttacggttttaaccggaccgtttaaccggttaccccttttcggttacggacccgtttaaccgggtcggggtacccgtaacccggggtcccggttaaccggg

SEQ ID NO: 197689 - DNA, 737 bp, Homo sapiens
  misc_feature: GYAE6OF02G868W.39.81.H04.1.454.CMB.1.raw
  modified_base (257)..(257): a, c, t, g, unknown or other
  misc_feature (257)..(257): n is a, c, g, or t
  modified_base (312)..(312): a, c, t, g, unknown or other
  misc_feature (312)..(312): n is a, c, g, or t
  modified_base (363)..(363): a, c, t, g, unknown or other
  misc_feature (363)..(363): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctctgcaaggctctggtacacctttaccaactanggtatcaggttgggtgcgacgacggcccctaggacgaaggggtcttggaggtggngtggggatgggaatcgagccgtcgttaacaagttcggacactaacaaactntacgcaacacgaacctcgagggacacgagtcacgatcgaccgtaacagacaacgtactacccgaacgacgaaccaccggtacctaacgacgttacgggacccttagggacggaccgtacccgtagggaacgtacgttaccgacgtaaacccggtaaccgaccggggttaccgttacggttaccgtttaacggtcggtacgggtaacccggaacggtaagggtacgggttaaccgggggttaaaactttacggtttttaaccggaaccggtttacccgggtttaaccccttttacggtttaaccggttaaccgggtttacccgggttaacgggggggtcccccgttaaacgggggtaacccccggtttaccgggg

SEQ ID NO: 197690 - DNA, 732 bp, Homo sapiens
  misc_feature: GYAE6OF02HUEXM.39.81.H04.1.454.CMB.1.raw
tcagtcgcactagtcacgaccggtgctcgatttagtagtgtagattcgcggggacccaaaaaaccacacccctccttgggagaatcccctagatcacagctcctcaccatggactggacctggagcatcctttttcttggtggcagcaacaacaggtgcccactcccaggttcagctggtacagtctggagctgagatgacgaagccgtggggcctcaggtgaaggtctcctgcgaaggcttctcggttaccaaccttttaccaacttatggtatctaggttggggtcgcgtacgacgggcccctgggaccgaaggggtcttaggagtgggagtggggatgggatcgagcgactttaacagtggtaccacaacaaactatgacacacgtaacctccgaggacagacgtcaacagacgaaccacgacgaccacactacccgaagaacgaccgaaccggacctaacgtacgtaccggaacctcgggtaacgggacgacccttaggacgtactaccgtaggaacccgacgtaaccgggccggtttagttaaccgtttaccgtacggttacggaaccgggtacgggaaggtacgggttaacgggggttaaattttaacggttttttacggaaccggtttaccgggtttacccctttaggtttaaccggttaccggtttaaccgggttcccggggggtaacccggttaacccgggggtaaacccggtttacccgggg

SEQ ID NO: 197691 - DNA, 636 bp, Homo sapiens
  misc_feature: GYAE6OF02JG19C.39.81.H04.1.454.CMB.1.raw
  modified_base (257)..(257): a, c, t, g, unknown or other
  misc_feature (257)..(257): n is a, c, g, or t
  modified_base (272)..(272): a, c, t, g, unknown or other
  misc_feature (272)..(272): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctgggcctcagtgaaggtctcctgcaaggcttctggttacaccttacaactntggtatcagttggtncgacaggcccctggacaagggtcttgagttggagtgggatggatccgagcgtacttaacgaatggtaccaacaactaaactatcgacaacgaacgtaacctccgagggtacaggtactacaccaatcgaacccacaacgacaccactccgacgacgccaccggacctacacgtcggaccgtaggaacgacgcccgtaggaacgtacgtccgacggaccgaaccgtaccgggtacgttagttaacgtttaccgtacggttcggacgaggtaggacggttaacgggtaatttcgtttaggaccgttccggttacccttcgttacgtaccgttaccggtcggggtacccgtacgggtaccctacggg

SEQ ID NO: 197692 - DNA, 765 bp, Homo sapiens
  misc_feature: GYAE6OF02HBW8Y.39.81.H04.1.454.CMB.1.raw
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtctcctgcaaggtcttcgtggttaacacctttaccaacttatggtatcgaggtttgggtacgcgaacgtacggtcccctagggaacgaagggtcttagaggtggagtgggatggactcgaagcgtacttaagaagtggtacaacaactaaaatagtcgactaacgaacgaaccgtcggaagggtacaacggtacgtacaaaccgtagtacgaaccctacgaacgtaaccaaccacgtacccgaaacggacgaccgaaccggtacctaacgtaacgtacgggaaccctagggaaccggtacgtaccgttacgaacgggtactttcgggtaacggaaccggtaaccgtacccggggtaccgtttaacggtttaaaccgtttcgttacggttacggaacgggtaacgtaagggtacggttaacggggttaaatttaacggttttaccgggtaaccgttaaccgggtttaccctttaggtttaccggaaaccggtttacgggtacccgggggtaacctaacccgggggtaaccccttaccgggg

SEQ ID NO: 197693 - DNA, 561 bp, Homo sapiens
  misc_feature: GYAE6OF02FUSNX.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttggagtggatggggatggatcgagcgcttacaatggtcacacaaactatgcacagaacctccagggcagagtacaccatgaccacagacacatccacgagcacggcctacgactggacctagacggacgcctgacgatcgtagaaccgacaccgggccgtagtacttacgtgtgcgtaagagagtacgggaaattagttttacgacttcgggtacccttgttttacggacttaccgtggggaccctacggggtacccctcggg

SEQ ID NO: 197694 - DNA, 610 bp, Homo sapiens
  misc_feature: GYAE6OF02F6NZI.39.81.H04.1.454.CMB.1.raw
  modified_base (421)..(421): a, c, t, g, unknown or other
  misc_feature (421)..(421): n is a, c, g, or t
  modified_base (506)..(506): a, c, t, g, unknown or other
  misc_feature (506)..(506): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtctcctgcaaggcttctggttacacctttacaactatggtatcaggttgggtgcgacacggcccctggacaagggtcttgaggtggagtgggatggatcgagcgtacttacaagtcggtacacaacgaactagtcgaccaacgacgaacctcgagggcaacgagtaccacagtcgaacacacgacacactccaacgnacgacgacctagactacggacctaggacgacgtaccgtagacgtacttccgagaccgaccgacggtccgttatacgttacgtcgngacggagacgtaggtacgggtaactttcggtttacgaccgttaccggttaccttcggttcgtaaccgttaccggtacggggtacccgtacgggtacccctcggg

SEQ ID NO: 197695 - DNA, 766 bp, Homo sapiens
  misc_feature: GYAE6OF02GQ9ON.39.81.H04.1.454.CMB.1.raw
  modified_base (278)..(278): a, c, t, g, unknown or other
  misc_feature (278)..(278): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggtctctggtactacctttacaactatggtatcgtagttgggtncgacacggcccctggacgaaggcttgagtggagtgggatggatcgagcgtcttaacaagtcggtaccaacaacaaacgtagtacgaccaacaacggaaacccctacgacggggacaacggtacgtaccaaccgtatacggacccaacgaacgaaccgaaccacgtacccgaacggacgacccggtaacccgggtaccctaacgtaacggtacccgggaacctacggggaacggaccggtccgtagggaacgtacgtaccgtacgggaacccggtaccggaacccgggtaccgtttaacggttaacgtttaccggtaggttaccgggtaacggaagggttaacggtacgggttaaaccgggggtaaatttttaacgggttttaacggtaacgtttacccgggtttaaccccgttttacggttttaccggtaaccgtttaccgggggtaacccgggtacccggttaaccggggttaccccgttaccgggg

SEQ ID NO: 197696 - DNA, 673 bp, Homo sapiens
  misc_feature: GYAE6OF02GE28G.39.81.H04.1.454.CMB.1.raw
  modified_base (457)..(457): a, c, t, g, unknown or other
  misc_feature (457)..(457): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatggacgaagccgtggggcctcagtgaaggtctctgcaaggtcttcgtagttactacctttacaactagtggtatctaggttggtgcgacgcggccccgtaggacgtaaggggcttggacggtggagtgggagtggagtcaggtcacgttacgaagtggtacacaactaaatatgacacacgacctccgaggcaagcgtaccaccgagtaccgaaccacgaagaccaactaactacccgacggacgaccgaccggaccctaanacgtacggtaccgtaggaacgggtacgacgtcggaagtacgtccgtagggaacccgaaccggtccgtacggttacgttagttccgtgtacggtggacgaaggttacggtaacgggaaattttcggttacgtacggttccggttaaccttttaccggttacggttaacccggttaccggttaccggggaaccccggtaacggtaccccggttaccgg

SEQ ID NO: 197697 - DNA, 861 bp, Homo sapiens
  misc_feature: GYAE6OF02HO04J.39.81.H04.1.454.CMB.1.raw
tcagtcgcactagtcacgaccggtgctcgatttagtagtgtagattcgcgggacccaaaaaccacacccctccttgggagaatcccctagatcacagctcctcaccatggactggacctggagcatccttttcttggtggcagcaaacaacaggtgcccactcccaggttcagctggtacagtctggagctgagatgacgaagcctggggcctcagtgaaggtctcctgcaaggtcttctggttacacctttaccaactatggtatcgtagttgggtgcgtacgacggccccgtggacgaagggcttgaggtggagtgggagtagggatcgagtccgtacttacgtaagttggtacaaccgaactaaacgtagtacgacaacgtacgtaaacccgtcgacgggtacagaccgtaccgaaccgtagtaccgaacccaacgtaacgaaccctactaccgtacccggaacgtaccgaacctacccggtaccttaacgtaaccggtaccgggtacccgtaagggtaaccggtccgtaacccggttaggaaacggttaccgtttaccggtacgggaaacccggtaacccgggtaacccggggtcccgttttaacggttaacgtttttaccggtacgggttacggaaccgggtaaggtaaccgggttaaggggttaaaccgggttttaaaagggtttttccggttttttaacccgggttaaacccgggtttttaccccgggtttaaaccccccggtttttacggtttttaacccgggttaacccggtttaaacccggggttaccccggggggggtttaaaccccggtttaaccccggggggttaacccccggttttaaccccggggg

SEQ ID NO: 197698 - DNA, 702 bp, Homo sapiens
  misc_feature: GYAE6OF02JKYUO.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatctaggttgggtgcgacgaggcccctggacgaagggtcttgaggtaggagtggggataggatcgaggtccgtacttaacgagtggtacaacgaacaaactcgtagacaacgaacgtaacccgtccgtacgggacgacggaacgttccaaccgtacgtacgaaccaccgaacgaaccgtaccaactacccgaacgacgtacgaccgactacagtacggactcggaaggccgtacgtacgtagacgtaccgtacggaaccgaccggtaacccggtacgtttacgtaacctttacgttacgggtacgtaccggtaaggtaacggtacgggttaagggtaaaccgtttaaggtttacgtaacggttaccggttacccttttacggttacgttaacccggttaggtacccgggggaccggttacccgggtaacccggttccggg

SEQ ID NO: 197699 - DNA, 703 bp, Homo sapiens
  misc_feature: GYAE6OF02HAI6Q.39.81.H04.1.454.CMB.1.raw
  modified_base (242)..(242): a, c, t, g, unknown or other
  misc_feature (242)..(242): n is a, c, g, or t
tcagtcgcactagtcacgaccggtgctcgatttagtagtgtagattcgcggggcccctagatcacagctcctcaccatggactggacctggagcatccttttcttggtggcagcaacaacaggtgcccactcccaggttcagctggtacagtctggagctgagatgacgagccgtggggcctcagtgaggtctcctgcaggcttctgttacaccttaccaactatggtatcgtaggttgggngcgacgacggcccctaggacgaagggtcttggaggtggagtgggatggatcgagcgtacttaacgaagtggtaccaacaacaaaactatcgaccacgaacgaacctaccgagggacaagacgtaccaacacgacgaaccaacacgaacaacatcccaacgacgccgaccggaccacgtcgtacggaaccgtaggacgggacgccgtacggacgtagtaccgtacgaaccggaccggtacggtccggtagtttactacgttggacggacgtaaggtacgtaaggttacggggttaaatttacgtttacggtaacgtttaccggttaacccgttaccgttttacggaaccggttaacggggttccggggtaacccggtaaaccgggggttaaccccgttacggggttacccctacccggtttcccgtaccccgttaccgtacccggtaccccccgtaacccgg

SEQ ID NO: 197700 - DNA, 729 bp, Homo sapiens
  misc_feature: GYAE6OF02H6J25.39.81.H04.1.454.CMB.1.raw
  modified_base (509)..(509): a, c, t, g, unknown or other
  misc_feature (509)..(509): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattcctttttcttgggtggcagcaacaacaggtgcccactcccaggttcagctggtacagtctggagctgagatgacgaagccgtgggcctcgagtgaaggtctcctgcaaggtcttgtacggttacctaccctttacaactagttgtacgtactaggttggtgacgacgacgtccccgtaggaacgtaagggtcgttggtaggtaggtaaggtggggtaagtggataccgacggcgtaccgttaaagtagtacggtaccaaacaaactaaacgtacgtacggaccgacaaccgtaaccgtaccggaggacgaacgacggtccaacgtaccgtacaccggacaacggacctaacacctacgacggaacgccgaacgtccgtaanaccggttcgaaccgtggaacgaccgtcgaaggactgtaccgacgaaccggtaccgaacccggtcggttaactaacgtttacgtggtaccgaaccggtaagacggtaacgggtaaggggtttaacttaacgtttacggtaccttaaccgggtttaccttaacggtttacgtaaccgttacgggtacccgggggaccgttaaccgggtaacccgttaccggg

SEQ ID NO: 197701 - DNA, 751 bp, Homo sapiens
  misc_feature: GYAE6OF02ICR1C.39.81.H04.1.454.CMB.1.raw
tcagtcgcactagtcacgaccggtgctcgatttagtagtgtagattcgcgggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctgggggcctcagtgaaggtctcctgcaaggcttctggttaccacctttaccaactatggtatcagttgggtgcgacacggcccctggacgaagggcttgaggtggagtggggagtggatcgaggccgtcgttaacaagtggtaccacaaccaaaacgttataggacctaacgacggaaccccgtacccggtaacgggaccgaacggtaacgtaccgtaacccgtaactacggaccccaacgaaaccggaacctaaccgaaccgtaacccgaacggaaccggaccgtacccgggtaacccgtaacctaacggtaccggtaccggtaaggtaagggtaccggccgtaacggaggtacctaccgtacggaaccgaaccggacccgggtaccggttacgttagttaaccgttggtacgggaaccgaggaacgggtaggtaacggggttaacgttaacgttttacgggtaaccgttaccggttacccgtttacgttacggttaccggtaccggttccggggtaccggtaacccgggtacccggtaccgg

SEQ ID NO: 197702 - DNA, 579 bp, Homo sapiens
  misc_feature: GYAE6OF02GTD1B.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctctgcaaggcttctggttacacctttaccaactatggtatcagttgggtgcgacaggcccctggacaagggcttggagtggagtgggatggatcagcgcttacagtggtcacaacaaactatgcaacacgaacctccgagggcagacgtaccaccatcgacccacagaccacacaccacgagcaccggcctacagtcggacctggaacggacgcctgagactcgtagacgacgaccgggccgttgttaacttactgacgacgagacgtaggtacggggtaaattgtttacgtacgttccggttacccttgtttacggaccgttacggtcggggacccgtacggggtaccctcggg

SEQ ID NO: 197703 - DNA, 648 bp, Homo sapiens
  misc_feature: GYAE6OF02GIWCO.39.81.H04.1.454.CMB.1.raw
  modified_base (326)..(326): a, c, t, g, unknown or other
  misc_feature (326)..(326): n is a, c, g, or t
  modified_base (346)..(346): a, c, t, g, unknown or other
  misc_feature (346)..(346): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttggtgcgacacggccctggacagggcttgagtggagtgggatggatcagcgacttanaagtggtacacaacaaactntcgacacgaacgaacctcgagggcagacgtacaccagtcgaaccacacgacacacgtaccaacgagaccacggacctacgacgtcggaccgtggacggacgccgtagagtactcgtacggaaccgtaacgacccgggtacgtttaggtaactttacgtaggtcgtaaccgaggacggtagggttaaccggggtaaattttacgggttttacgtaccggtttacccggtttacccgtttcgttttacggaacccggtttaccggtcgggggaaccccgtaaccggggtaccccgttaccgggg

SEQ ID NO: 197704 - DNA, 676 bp, Homo sapiens
  misc_feature: GYAE6OF02JIRA0.39.81.H04.1.454.CMB.1.raw
  modified_base (274)..(274): a, c, t, g, unknown or other
  misc_feature (274)..(274): n is a, c, g, or t
  modified_base (340)..(340): a, c, t, g, unknown or other
  misc_feature (340)..(340): n is a, c, g, or t
  modified_base (364)..(364): a, c, t, g, unknown or other
  misc_feature (364)..(364): n is a, c, g, or t
  modified_base (577)..(577): a, c, t, g, unknown or other
  misc_feature (577)..(577): n is a, c, g, or t
tcagtcgcactagtcacgaccggtgctcgatttagtagtgtagattcgcggggacccgaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaggcttctggttacaccttacactatcggtatctagttgggngtcgacgacggccccgtaggacgaagggcgttgacggtggagtggggatggatcgagcgtacttanaagtcggtacaacgaactaaactntacgacaactaacggaacctacggagggtacgaaggtacctacgaaccctaagtaccgaacccaccgaacgtaaccgaacctaccgtaacccgaacggaaaccgaccgtaacccgggtacctaaaccgacgttacggtacccgtaaggacggtaacgtcccgtaggacgtaacgtcgacggtaacgaccgacgggtcgtaacgtatttaccgnggtctacggagtacgtaggtacgggttaaattcgttaagaccgttacggttccttagttacgtaccgtagtaccgggtacctaaccgggtccttaccgg

SEQ ID NO: 197705 - DNA, 745 bp, Homo sapiens
  misc_feature: GYAE6OF02GS7S4.39.81.H04.1.454.CMB.1.raw
  modified_base (424)..(424): a, c, t, g, unknown or other
  misc_feature (424)..(424): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatggacgaagccgtggggcctcaggtagaaggtcctccgtgcaaggtcttctaggttaccaaccttttaaccaacgttatggtaatcgtaggttgggtgcgacgacggcccctggacgaagggtcttaggacggtgggtaacgtggggactagggtagactaacggccggtacgttaacaaacgttggtaaccacgaaccaaaacttagtagaccaacgaaggtaacccnccggaagggacaacgggtactacgaaccaggtacaaaccctaacgagaaccaacacgtacccgacgacgacgaaccgtaccaactagccgacgtacggcgaacgtcacggagacgtacgtacgaacggaccgtaccgggtacccgttacgtaacggtttacgtacggttaggtaacccggtagaacgtacgggtaacggggttaaacgtttaaaggttttcggtaaccggttaaccgggtttacccttaaccgggtttaccttaacgggttaacccgttacggggggtaaccccggtaacggggttaaaccccggttcggg

SEQ ID NO: 197706 - DNA, 695 bp, Homo sapiens
  misc_feature: GYAE6OF02IKGW5.39.81.H04.1.454.CMB.1.raw
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttcgtgttacacctttaccaactagtgtatcgtaggttggtgcgacgacggcccctaggacgaaggtcttggagtggagtgggatgggagtcgaagcgtacgttacgaagtcggtcaacaacaaacttagacggacacgaacgtaacctccgaacgggcaaggaacgtccaaccgtacgtacgaacccaacgtaacgaccaaccgacgtacccgaaacgacgaccgacggaccctacgaactacggtaactacggacgggtacgaccgtagtacgtaactcgtacgaaccggtaacgacccgggtaccggttacggttaactttaccggttgggtacgaccgggagtaacgtacgggtaacgggtaaactttaggttttacgacccggttacggttaccccgtttagtttcgtaaccgttacggtaccggggtaccgtaccgggtaacccgttccggg

SEQ ID NO: 197707 - DNA, 639 bp, Homo sapiens
  misc_feature: GYAE6OF02F9E7Q.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcaggttggtgcgacacggcccctggacgaagggcttggagtggagtgggatggatcgagcgtacttacgaagtggtccaacaactaaactatcggacaacacgtaaccctccgagggcagacgtccaaccagtacgaccacaagaccaacactacccgaacgacgaccgaccggacctaacgacgtacggaccgtggaacggacgccgtagacgactcgtacgaccgaccgaccggtccgttagttacgttacgtggtacggacgaacggtaggtacggtacggggtaaatttacggtttacggtaccgttacggttacccttaggtttacgaccgttaccgggtacgggaccgtaccgggtacccgttccggg

SEQ ID NO: 197708 - DNA, 612 bp, Homo sapiens
  misc_feature: GYAE6OF02HAXG4.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcaggttgggtgcgacaggccactggacaagggcttggagtggatggggatggatcgaggcgtcttaacaagttggtacaacaacaaaactatcgacaacagaaccctccgaagggcaggaacgtccaaccatacgaccacgacgacacactaccaacgacgccgaccggaccctaacgacgtacggaccgtaggacggacgccgtagagtatcgtacgaaccgaccgacgggtccgtagttaacgttacgtggtgacgaggaggtaggtacggggtaaattagtttacggacgttacggtaccttcgtttacgacgttaccggtacgggtaccgtacgggtaacccgg

SEQ ID NO: 197709 - DNA, 619 bp, Homo sapiens
  misc_feature: GYAE6OF02IQCSY.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcgtagttgggtgcgacacggcccctggacgaagggcttggagtggagtgggatggatcgagcgtcttaacaagttcggtcaacaacaaactatgcaacacgaacctccgagggcagactcaaccgatcgaaccacacgacacactaccacgacgaccgacggacctacacgtcggaccgtaggacggacgccgtagacgtactcgtagaccgaacgaccggtacgtacgttacgttacgtggtcgacgagtaggtagtacggggtaaattacgttttacggacgttaccggttaccgttacgtttacggtacgttaccggtacggggtacccggtacgggtaacccgttccggg

SEQ ID NO: 197710 - DNA, 674 bp, Homo sapiens
  misc_feature: GYAE6OF02HX5FS.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttcgtgttacacctttaccaactatggtatctagttggtgcgacaggcccctgacgaagggcttgagtggagtgggatggatcgagccgtcttaacaagtggtactaacgaacaaactatgacacacgaaccctccggagggacaaggacgtccaacctagtaccggaaccaacgacgaacaacactacccgaacgtacgaccaaccggtacaactaacacgtacggaacccttgggaaggtacgcctagagtactcgtacggaaccgtaccgaccggtaccgttacgttaacgtttacgtgtacgaccggaagtaccggtaacgggttaccggggtaaatttaacggtttttacggaaccgttttaccgggttaaccctttcgttttaccggaaccgttaccgggtacgggggtaccccgtaacgggttaaccccgg

SEQ ID NO: 197711 - DNA, 679 bp, Homo sapiens
  misc_feature: GYAE6OF02FUGPU.39.81.H04.1.454.CMB.1.raw
  modified_base (263)..(263): a, c, t, g, unknown or other
  misc_feature (263)..(263): n is a, c, g, or t
  modified_base (271)..(271): a, c, t, g, unknown or other
  misc_feature (271)..(271): n is a, c, g, or t
tcagtcgcactagtcacgaccggtgctcgatttagtagtgtagattcgcgggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgagcctggggcctcagtgaggtctcctgcaaggcttctggtacacctttacactatggtatcngttgggtncgacaggcccctggacaagggtcttggaggtggagtggggatgggatcgtaggccggtacttacgagttggtcgacaacaaacttagcgaccaacacgaaccctaccgagggcaggacgtacaaccactcgaccacacgacaccaatcccgaacgagaccgaccggtacctacgacgtcggaccttagggacggacgccgtacggagtactacgtacgggaaccgaccgaccggggtccggttagttaaccgtttacgtcggtacggaccgggaagtacggtaggttaacggggaacgttttagttttaacgggtacggtttaacccggtttaccccgtttgtttaccgggtaaccggtttaccggtacgggggtaccccgtaacgggggttacccgttttaccgggg

SEQ ID NO: 197712 - DNA, 704 bp, Homo sapiens
  misc_feature: GYAE6OF02HLOLS.39.81.H04.1.454.CMB.1.raw
  modified_base (351)..(351): a, c, t, g, unknown or other
  misc_feature (351)..(351): n is a, c, g, or t
  modified_base (391)..(391): a, c, t, g, unknown or other
  misc_feature (391)..(391): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcagcttctggttacacctttaccaacttatggtatcaggttggtgacgacacggcccctggacgaagggtcttggaggtgagtgggatggatcaggcgtcttacaagtggtcacaacaatancgacacgagaacctccgaggaccaggacgtacaaccgtancgaaccacacgaaccaacacgtacccaacgacgacccacgggtaccctaacgtacgtacggacccgtaggaacgggacgacccgtagaacggtaactcgtaacggtaccggaaccgtaccggggtacccgtaggttaccgttttacgtaggtaccggaggaacgtaaggtacgggttaaaccgggggtaaaagttttcgttttaccggtaaccggtttaccggttaaccccgtttacggtttaaccggttacccggttaacgggttaaccccgggggacgttaaacccgggggtaacccgtttaaccccgggg

SEQ ID NO: 197713 - DNA, 597 bp, Homo sapiens
  misc_feature: GYAE6OF02HZEIA.39.81.H04.1.454.CMB.1.raw
  modified_base (189)..(189): a, c, t, g, unknown or other
  misc_feature (189)..(189): n is a, c, g, or t
  modified_base (238)..(238): a, c, t, g, unknown or other
  misc_feature (238)..(238): n is a, c, g, or t
  modified_base (277)..(277): a, c, t, g, unknown or other
  misc_feature (277)..(277): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctgganctgagatgacgaagccgtggggcctcagtgaaggtctctgcaaggcttntaggttacacctttaccaactatggtatctagttgggtncgacacggccccgtaggacaagggcttgagtagagtgggagtggatcgagcgtacttaacaagttggcaacaactaaactatacgactacaacgtaacctccgagggacaaggacgtacaaccatccgaaccacgacgacacactaccacgagccacgcacacgcgactagagagcctgacgatcgtagaccgacgaccgtcgtagtacttatgtacgagagacgtagtacggggtaattcggtttacgacgttaccggttacccttcgtttacgtaccgttaccggtacggggtaccctaaccgggtacccgttaccgg

SEQ ID NO: 197714 - DNA, 763 bp, Homo sapiens
  misc_feature: GYAE6OF02HRPLP.39.81.H04.1.454.CMB.1.raw
tcagtcgcactagtcacgaccggtgctcgatttagtagtgtagattcgcgggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtgggcctcgagtgaacgtctctgacaggcttcgtgttacctacctttaccaattagtggttatcgtagttgggtgacgacgacggcccctggacgaagggtcttaggagtggtagtagggtagtggatacgagtacgtacttacgaagtcgtacaacaaacgtaactatacgaccaacaaccgtaaccctacggacgggacaaggtacgtaccaccgtaactaccggaaccctaacgaacgtaacccaagaacctacccgaaacgacgacccgacggtaaccctaaccgaggtacccggtaacccgtagggaaccggacgtaccggtacgtaagtaccgtaccgggtaagaaccccgggacgtacccggggtcgtttaaacgggtttaaccttaccggttcggtacggaacgggtaacgggtaaggttaaccggggttaaggggtttaaactttacggtttttaccggaaccgtttcccgggtttaacccctttcggtttacgggtaccggttacccgggtaccggggtaacccggtaccggggtaccccgtttccgg

SEQ ID NO: 197715 - DNA, 614 bp, Homo sapiens
  misc_feature: GYAE6OF02GFH2S.39.81.H04.1.454.CMB.1.raw
  modified_base (474)..(474): a, c, t, g, unknown or other
  misc_feature (474)..(474): n is a, c, g, or t
tcagtcgcactagtcacgaccggtgctcgatttagtagtgtagattcgcggggacccaaaaaccacaccccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttcgtggttacaccctttaccaactatggtatcaggttgggtgcgacacggcccctgggacaagggcttgagtggagtgggatggatcaggcgacttacgaagtggtctaacaccaaactatcgacaacacgaaccctaccgaggggaccaaggagtaccaaccagtcgaacccacacgacacgactaccaacgagaccaccggaccctaacgagtcggaccctaggaacgacgtccngacgatcgacggaccgacgacggccgttagttacttacgtgtcggacgaggacgtaggtacgggtaaattgttttacgaccgttcggttacccttggtttcggacgttaccggcggggtaccaccggggacccttacggg

SEQ ID NO: 197716 - DNA, 636 bp, Homo sapiens
  misc_feature: GYAE6OF02FF2IW.39.81.H04.1.454.CMB.1.raw
  modified_base (282)..(282): a, c, t, g, unknown or other
  misc_feature (282)..(282): n is a, c, g, or t
  modified_base (398)..(398): a, c, t, g, unknown or other
  misc_feature (398)..(398): n is a, c, g, or t
tcagtcgcactagtcacgaccggtgctcgatttagtagtgtagattcgcgggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgagcctggggcctcagtgaaggtctcctgcaaggcttctggttacacctttaccaacttatggtatcaggttgggtgcgacnggcccctggacaagggcttgagtggagtgggatggatcgagcgtacttacaatggtacacaactaaactatgacacacgaacctcgaggcagagtcacatacgaccacagacacanccacgagcacggcctacagtacggacctggacggacgccgtagacgtactcgtacggaaccgaccgtaccgggtccgttaggttaactttaccgtggttacggacgtaagggaaggtacggttaacgggggtaaatttacgttttacggaacccggtttaccggttaccccgttttcgtttacggtaaccgtttaacgggtaccggggtacccgtaacggggtaaccccgttacgggg

SEQ ID NO: 197717 - DNA, 636 bp, Homo sapiens
  misc_feature: GYAE6OF02HQBM7.39.81.H04.1.454.CMB.1.raw
  modified_base (360)..(360): a, c, t, g, unknown or other
  misc_feature (360)..(360): n is a, c, g, or t
  modified_base (529)..(529): a, c, t, g, unknown or other
  misc_feature (529)..(529): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtctcctgcaggtcttgtggttactacctttaccaactgtcggtatcgaggttgggtgcgtacgcggccccgtggacgagggcttggaggtggagtggatggatcgagcgcttacagtcgtacaacgaacaaacgtntgacacgacgacctacgacgggacacgagtaccacgtacacgacccaacgtacaacacgactaccgacgtacgaccgaccggtacctacgtagacggacgtagggacgtacgccgtaggacgtataccgtagacccgacggtacccggtacgttacggtactttaccgnggtacgacgagtacggaggtaacgggtatttacggtttcgacgtaccggtttacccgtagttaccggtacgtaccgggtaccggggacgtaccgggtacccgtccgg

SEQ ID NO: 197718 - DNA, 663 bp, Homo sapiens
  misc_feature: GYAE6OF02I3O8G.39.81.H04.1.454.CMB.1.raw
  modified_base (296)..(296): a, c, t, g, unknown or other
  misc_feature (296)..(296): n is a, c, g, or t
  modified_base (337)..(337): a, c, t, g, unknown or other
  misc_feature (337)..(337): n is a, c, g, or t
tcagtcgcactagtcacgaccggtgctcgatttagtagtgtagattcgcgggggacccgaaaaaccacacccctccttgggagaatcccctagactcacagctcctcaccatggactggacctggagcatccttttctggtggcagcaacaacaggtgcccactccaggttcagctggtacagtctggagctgagactgacgaagccgtggggcctcgagtgaaggtctccgtgcaaggtcttcgttcggttactacccgtttaccaactagtggtatctaggttcggtcacgacncggccctaggacgagggcttgcggtggacgtgggatcgganacggagtccgtacgttacgaagtcggtaccaacaacctaaacgtagtcgacgtaacgaacgtaacccgtcgacggacaggaacgtaccaacacggtcaaccgagaacgaccacactacccgaacgacgaccacggtaccacgacgtccggactggaaggacgccgtagacgtactcggtacggacgaccgtacgggtccgttagtaccgttacgtggtacggtagtaggacgtagggtaacggttaacttaaggtttaccgacggttaccggtaaccttacgtttacgacgttaccgggtacgggtacgaccgggttccgtaccgg

SEQ ID NO: 197719 - DNA, 634 bp, Homo sapiens
  misc_feature: GYAE6OF02F2P9V.39.81.H04.1.454.CMB.1.raw
  modified_base (431)..(431): a, c, t, g, unknown or other
  misc_feature (431)..(431): n is a, c, g, or t
  modified_base (485)..(485): a, c, t, g, unknown or other
  misc_feature (485)..(485): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtgggcctcagtgaaggtctctgcaagcttcgtgttacacctttacaactagtaggtatcaggttgggtgcgacgacggtccccgtggaacaggggtcttggaggtgggagtggggatgggtactgacggcgtacttaacgaagttcggtacaacctaactaaaacctagtcgactaacgaacgtaaccctacgaacgggcgaagacgtccaactagtacaccanacgacacactacccgagactacgaccgcctacacgtcggacgtaggacgcgtcngatgtccgagaccgacgaccggtcgttagtacgttactggtacgtacggagacgtaggaacgggtaactttggtttacgtacgttaccggttacctttacgttacggtacgttcgggtacggtacccggtacgggtacccgttaccggg

SEQ ID NO: 197720 - DNA, 661 bp, Homo sapiens
  misc_feature: GYAE6OF02IBBUH.39.81.H04.1.454.CMB.1.raw
  modified_base (426)..(426): a, c, t, g, unknown or other
  misc_feature (426)..(426): n is a, c, g, or t
  modified_base (449)..(449): a, c, t, g, unknown or other
  misc_feature (449)..(449): n is a, c, g, or t
tcagtcgcactagtcacgaccggtgctcgatttagtagtgtagattcgcggggacccaaaaaaccacacccctccttgggagaatcccctagatcacagctccctcaccatggactggacctggagcatcctttttcttggtggcagcaacaacaggtgcccactcccaggttcagctggtacagtctggagctgagatgacgaagccgtggggcctcgagtgaaggtctcctgcaaggtcttctggttacctacctttaccaacttagtggtatctaggttgggtgcggacgacggccccgtggaacgagggtcttggaggtggagtgggagtggatcgagccgtacttaacaagtcggtacaacaacaaactagtacgacacaacgaacccgtcgaaggacagaacgtccaacagtcgaccaanacgacacacgtacccaacggacnccgtaaccggcctaacgtcacggacctaggacggacgcgtagacgtatccgaagaccggaccgtacggtacccgttaggtatttacgtggtaggaccgaagtaacgagggttaaacgggtaaatttcggttttaacgacggttccggtttaacccgttgtttaacggaccttacgggtacgggtacccggtaaccggtacccggttacccgg

SEQ ID NO: 197721 - DNA, 553 bp, Homo sapiens
  misc_feature: GYAE6OF02GNI8Y.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgctacaatggtcacacaaactatgcacagaacctccaagggcagagtcaccatgaccacagacacatccacgacgcgacggcctacatggacctgaggagcctgacgactctcgaccgacaccggccgtgtacttactgtcgcgagagatacggggaaattagtttacgaacgtcggttacccgttctttacggaccttaacgtcggggacctacggggtacccttacccggg

SEQ ID NO: 197722 - DNA, 609 bp, Homo sapiens
  misc_feature: GYAE6OF02GS2UK.39.81.H04.1.454.CMB.1.raw
  modified_base (467)..(467): a, c, t, g, unknown or other
  misc_feature (467)..(467): n is a, c, g, or t
  modified_base (481)..(481): a, c, t, g, unknown or other
  misc_feature (481)..(481): n is a, c, g, or t
  modified_base (517)..(517): a, c, t, g, unknown or other
  misc_feature (517)..(517): n is a, c, g, or t
tcagtcgcactagtcacgaccggtgctcgatttagtagtgtagattcgcgggggacccaaaaaccacacccctccttgggagaatcccctagatcacagctcctcaccatggactggacctggagcatccttttcttggtggcagcaacaacaggtgcccactcccaggttcagctggtacagtctggtagctgagatgacgaagcctggggcctcagtgaaggtctcctgcaagcttctggttacacctttaccaactatggtatcagttgggtgcgacgaggcccctggacaagggcttgaggtggagtgggatggatcgacgcgtacttacaagttcggacacaacaaactgtcgacacgaacgaaccctacgagggacaacgacgtaccacagtcgaaccagaacgacacatccgaacgagccgaaccggcctaacgacgttaccggaccgtaggacgggacncgtagagtctacgngaccgaacgccggtcgtagttacttacgtgtacggngtagaggacgttacggggtaatttcgttacgacgttacgttacccttgtttacgtacgttacggtcgggtaccgtaccgggtacccttacgg

SEQ ID NO: 197723 - DNA, 730 bp, Homo sapiens
  misc_feature: GYAE6OF02GVHNV.39.81.H04.1.454.CMB.1.raw
tcagtcgcactagtcacgaccggtgctcgatttagtagtgtagattcgcggggacccaaaaaccacgacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgagtctctgcagctctgtacaccttacactatgtatctagttgggtgcgacacggcccctggacaagggcttggagtcggagtgggatggatcgagcgcttacaagttcggtacacacaaactatcgactaacgaacgtaacccgtcgaacgggctaggacgtaccaacctatacgaacccacgacgaccacgactacccgaacgacgaccgaaccggacctacgacgttaccggacccgttaggaacggtacgtacccgtagaacgtactaccggtacggtaacccggaaccgtaccgggtacccggtttaagttaacgttttaaccgttgggttacggacgggtaacggtaacggtacgggttaaccgggggttaaaattttccggtttttaacggaacccggttttaaccgggtttaacccccgtttacggttttaaccgggacccgttttaacccggggtacccgggggtaccccggttaacccgggggtaaacccccgtttccgggg

SEQ ID NO: 197724 - DNA, 569 bp, Homo sapiens
  misc_feature: GYAE6OF02G3G5X.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggagtgggatggatcagcgcttacaatggtcacacaaactatgcacacgaacctccacgggcagagtcaccatcgaccacagacacactccacgagcacggcctacatcggacctggaggacgccgtgacgatccgtgaccgacgacggcgtgtagttacgtgtgacgagagagtacggggtaattgtttacgtacgttacggttacccgttcgtttacgtaccgttaccggtacggggtacccgtacggggtacccgttaccggg

SEQ ID NO: 197725 - DNA, 606 bp, Homo sapiens
  misc_feature: GYAE6OF02HF5AS.39.81.H04.1.454.CMB.1.raw
  modified_base (281)..(281): a, c, t, g, unknown or other
  misc_feature (281)..(281): n is a, c, g, or t
  modified_base (362)..(362): a, c, t, g, unknown or other
  misc_feature (362)..(362): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtctccgtgcaaggtcttcgtggttacacctttaccaactatggtatcaggttgggtncgacacggcccctaggacgaagggcttaggaggtggagtgggatggatcgagcgtcttacaagtggtacacgaacaaactngaccaacgacgaacctcgaaggcagacgtcacgatacgaccacgacgaccacactaccgacgacgaccgtaccgacctaacgacgttaccggaccgtaggaacggacgtaccgtagacgtactcgtacgaccgaccgtacggccgttagtagttacgtgtcgacgagagtacggtagggtaattcggttacgacgttacggtacccttgttacgacgtacggtacgggacgtacggaccgtcgg

SEQ ID NO: 197726 - DNA, 702 bp, Homo sapiens
  misc_feature: GYAE6OF02FW6JS.39.81.H04.1.454.CMB.1.raw
tcagtcgcactagtcacgaccggtgctcgatttagtagtgtagattcgcgggggacccaaaaaccacacccctccttgggagaatcccctagatcacagctcctcaccatggactggacctggagcatccttttcttggtggcagcaacaacaggtgcccactcccaggttcagctggtacagtcctggagctgagatgacgaagcctggggcctcgagtgaacggtctcctgcgaaggcttctggttacctacctttaccaactatacggtatctagtcggtgcgacacggtccctggacagggcttggaggtggatggggatggaatcgaggtcgtacttacgaagttcggtacacgtaacgtaactacgtacgacaacgacgaacccgtaccgagggaccaggacgtacctaaccgacgtaaccgacccacaacggaccacgtaactaccccggaacgacggaacccaccggtaccgtaaccgagttacccgggacctagggaacgacgtcccgtagtaacgacctcggaagccgaaaccgcggtaccgtagtttaacctccggtagtggtaacccggtagtaccggtaggttaacgggtaactttggtttaccggaccgttaccgggttaccctttaggttaccaacccggtttccgggaacgggtaccccggttaaccgggtacccgggttacccgg

SEQ ID NO: 197727 - DNA, 566 bp, Homo sapiens
  misc_feature: GYAE6OF02HUKOB.39.81.H04.1.454.CMB.1.raw
  modified_base (491)..(491): a, c, t, g, unknown or other
  misc_feature (491)..(491): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacaccttttaccaactatggtatcagttgggtgcgacaggcccctggacagggctgagtggatgggatggatcgagcgcttacaagtggtacacaacaaactatgacacagaacctccgagggcagacgtacaccatacgaccacgagaaccacactaccaacgacgccgacggcctaacgacgtcggacctaggacggacgcctggagactccgtagaccgacgacggccgttagtacttacgtgtngagagacgtagggaattgtttacgacgttcgtaccttgttacgtactacggtcggggacctacgggacccgtcgg

SEQ ID NO: 197728 - DNA, 706 bp, Homo sapiens
  misc_feature: GYAE6OF02JY3VY.39.81.H04.1.454.CMB.1.raw
  modified_base (354)..(354): a, c, t, g, unknown or other
  misc_feature (354)..(354): n is a, c, g, or t
tcagtcgcactagtcacgaccggtgctcgatttagtagtgtagattcgcggggacccgaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcaggtgaaggtctcctgcaaggtcttctggttacaccttacaactatggtatcgagttggtgcgacgacggccctggacaagggcttggagtggagtgggatggatcgagcgctacaagtggtcacgtaacaaactagtnacgaacacgaacctacgagggtccaagacgtacaccgatcggaaccacagacactactaccgaacgacgacgaccggtacctaacgacgtacggtaacctaggtaacggacggtacctcgggtacgtaactaccgtaggtaaacccgaacggtacccggggtaccgtacggttaacgttaccgttacggtcggaaccggtaacgggtaacggtaccgggttaacgggggttaaacctttaagggttttaaccggtaccggttaaccggttaaccccgttttaggttaccggtaaccgtttaccggggtaccgggttaacccgggtaacccggggtaacccgtttacccgggg

SEQ ID NO: 197729 - DNA, 586 bp, Homo sapiens
  misc_feature: GYAE6OF02HER3A.39.81.H04.1.454.CMB.1.raw
  modified_base (347)..(347): a, c, t, g, unknown or other
  misc_feature (347)..(347): n is a, c, g, or t
  modified_base (496)..(496): a, c, t, g, unknown or other
  misc_feature (496)..(496): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccagtttcagctggtacagtctggagctgagatgacgaagcctggggcctcagtgaaggtctcctgcaaggcttctggttacacctttaccaactatggtatcagttggtgcgacacggcccctggacaagggcttgagtggagtgggatggatcgaggcgcttacagtggtcaacacaaactntcgacacgacgaacctcgagggcaggacgtaccaaccatacgaccaacacgaacacactcccaagacgaccaaccggcctaacagtacggacctaggacggacgccgtagagtactcgcgaccgacgaccggtcgtagttactacgtgngacgagagacgtagggtaaatttgttagacgttcgggttacccttgtttacgacgttacggtaccggggtccgaacgggtaccctacggg

SEQ ID NO: 197730 - DNA, 587 bp, Homo sapiens
  misc_feature: GYAE6OF02GICGX.39.81.H04.1.454.CMB.1.raw
  modified_base (343)..(343): a, c, t, g, unknown or other
  misc_feature (343)..(343): n is a, c, g, or t
  modified_base (380)..(380): a, c, t, g, unknown or other
  misc_feature (380)..(380): n is a, c, g, or t
  modified_base (404)..(404): a, c, t, g, unknown or other
  misc_feature (404)..(404): n is a, c, g, or t
tcagtcgcactagtcacgaccggtgctcgatttagtagtgtagattcgcgggggacccaaaaaccacacccctccttgggagaatcccctagatcacagctcctcaccatggactggacctggagcatcctttcttggtggcagcaacaacaggtgcccactcccaggttcagctggtacagtctggagctgagatgacgaagcctggggcctcagtgaaggtctcctgcaaggcttctggttacaccctttacaactatggtatcagttgggtgcgacaggcccctggacaagggcttgagtgatgggatggatcagcgcttacaagtggtcacacaaactntcgcacagaacctcagggcagatcacatcgaccacanacacatccacagcacggcctacancggacctggaggacgccgtagacgtatcgtcgaaccgacgaccgggtaccgttaggtactttacgtcggtaggaccgtaggtacggacgttaccggggaaaatttcggttttaacgaacgttccggttacccgttcgtttacgaccgttaccggtcggggacctacggggtacccttaccggg

SEQ ID NO: 197731 - DNA, 732 bp, Homo sapiens
  misc_feature: GYAE6OF02IIOT4.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccacctcccaggttcagctggtacagtctggagctgagatgacgaagccgtggggcctcgagtgaaggtctcctgacgaggcttcgtggtacctacctttaaccactagttggtatcgtaaggttgggtcgacgtacgacggccccgtagggacgaagggtcgttaggaggttgggagtgggtagtaggacgtcgacggcgtactttaacgaagtgtaccaacgaaacctaaagtactacgacaacgaacgaacccgtcgaagggcaagacgtacaacccgataccgaccaacgacgacacactacccgaacgacgacccgacggacctacgacgtacggtccgtaggaccggacgacgttacggagtacgtacgtacggaaccgtaccgcccggttaccgttaggttaaccgttacgtcggtacggacggtaacggaacgggttaacggtaacggggtttaattaacgggttttccggaaccggtttacccggtttaccgtttaccgggtttacggtaacccggttacggggttaccggggaacccggttacccgggtaaacccggttccggg

SEQ ID NO: 197732 - DNA, 665 bp, Homo sapiens
  misc_feature: GYAE6OF02HLCWV.39.81.H04.1.454.CMB.1.raw
tcagtcgcactagtcacgaccggtgctcgatttagtagtgtagattcgcgggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctgggcctcagtgaaggtctcctgcaaggcttctggttacacctttaccaactatgtatcaggttgggtgcgacacggcccctggacgagggcttggagtggagtgggatggatcgagccgtcttacgaagtcggtactaacgactaaactagtcgacaacacgaaccctccgaaggggcaacggacgtaccaaccactacgaccaacacgacaacactaccgacgacgccgaccggtaccactacgtcgggaacccttaggaacggacgacccgtaggacgacttcggtacgaaccggaccgaccgggtccgttacgttacgtttacgtggtgaccggtagtacggaggttaacggggtaatttacggttttacggaccgtttacggttaccccgtttcgtttaccggtaaccgttaccggttaccgggggtacccgtacggggtaaccccttccgggg

SEQ ID NO: 197733 - DNA, 631 bp, Homo sapiens
  misc_feature: GYAE6OF02IY2L8.39.81.H04.1.454.CMB.1.raw
  modified_base (616)..(616): a, c, t, g, unknown or other
  misc_feature (616)..(616): n is a, c, g, or t
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtctctgcaggtcttctgttactaccttacaactatgtatcgagttgggtgcgacgacgtccccgtggacgtaagggcttgaggtgggtagtggggtatgggatcgaggtaccggtcttaacgaagtcgtacgaacaacctaaactatcgacaacgaacgtaaccctcggaaggtcgaagacgtccaacacgacgaacccaacaacgaccaacgactaccgaacggaccgaccgaaccggtacctacgtaacgaccggtacgtacggaggacccggtctaagggtacaacgtcctaggaccgtacgaccgtcgttacgtacttacgtgacgcgagacgagtagggtaaagttgtttaacgcgttacgtaccgttcgtttcggacttacgggnggaccgaggtacccg

SEQ ID NO: 197734 - DNA, 690 bp, Homo sapiens
  misc_feature: GYAE6OF02JWYFZ.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacacctttaccaactatggtatcaggttggtgcgacacggcccctggtacgaagggtcttaggactagggagtcggggatcgggatcgaggtcgcgttaacgaagtcgggtaccaacaaccaaactagtagacaacgtacgaacccgtccgaggggacccagtacgaccgtaacctagtacgaacccaacgaagtacccactactacccggaacgaacgccgaaccggaccgtaacacgttacggaacccgtaggaacggtacggtccagggactactccgtagaaccggtaccgacggtacccgtagttaccttagtcggttacgcggaacgtacgtagggtaacgggttaacttagttttaaccggaccgtttacggttaccctttaggtttacgttaccggtaacggttccggggaacccgtaacggggtaccccttccgggg

SEQ ID NO: 197735 - DNA, 667 bp, Homo sapiens
  misc_feature: GYAE6OF02JMKM7.39.81.H04.1.454.CMB.1.raw
  modified_base (444)..(444): a, c, t, g, unknown or other
  misc_feature (444)..(444): n is a, c, g, or t
  modified_base (499)..(499): a, c, t, g, unknown or other
  misc_feature (499)..(499): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttctggtggcagcaacaacaggtgcccactcccaggttcagctggtacagtctggagctgagatgacgaagctggggcctcagtgaaggtcgtccgtgcgaaggcttctggttaccacccgtttaccaactatcggtactcgtacgttgggtgcgacacggcccctaggacaagggtcttggagtcggagtgggagtggatcgagtccgactttacaagttcggtcaacgtacaaaacgttatggacctacgacgtaacccgtcgaacgggcgtaacgacgtaccaaccgtatcgaacccacgacgaacaacnctaacccaacggacgcctaccggcctacgacgttacggaccctaggaacgggacnccgtaggaacctagtccgttagaaccggacgaccgggtacccgttagttaaccgtttagtcggtcgacgtaagacggtaggtaacgggtaaagtttctttacggaccttacgggttaccctttagttccgtaacgtcggtacccgggaccggaccggtaccgtaccgg

SEQ ID NO: 197736 - DNA, 767 bp, Homo sapiens
  misc_feature: GYAE6OF02JW7Z2.39.81.H04.1.454.CMB.1.raw
  modified_base (239)..(239): a, c, t, g, unknown or other
  misc_feature (239)..(239): n is a, c, g, or t
  modified_base (265)..(265): a, c, t, g, unknown or other
  misc_feature (265)..(265): n is a, c, g, or t
  modified_base (276)..(276): a, c, t, g, unknown or other
  misc_feature (276)..(276): n is a, c, g, or t
  modified_base (328)..(328): a, c, t, g, unknown or other
  misc_feature (328)..(328): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgccactcccaggttcagctggtacagtctggagctagagatgacgaagcctggggcctcgagtcgaaggtctcctgcaggcttntggttacactttaccactagtggtancgtaggttggngcgacgacggcccgtgacgaggtcgttcgagtggagtcggagtggtatacgnggtaccgtacgttaacgaacgtcggtaccaaccgaacgaactaaggtcgacgaacacggaaaccctccggacggggacaacgtacgttaccgaacgttacgaccgaaccgaacaggtaccacgaccaccgaacgtaaccggactacccggactaacgacggttaccggacgttacggacgggaacccttacggaccggtaagtacgttaaccgacggttaaaccggaaacccgtcccggggttccggtaaaagggtttaccgtttaaccggtacggggttacgtacggggtaaacgtaaccgggttaccggggaaaggtttttaaaccggttacggtttttaacggtaacccggtttaaccgttcccggttttaacccgttacgggtaacgttccggggtaaccggtcccggttaaccgggaacccccgttttaccggg

SEQ ID NO: 197737 - DNA, 648 bp, Homo sapiens
  misc_feature: GYAE6OF02FUU9N.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatgtatcagttgggtgcgacaggcccctggacaagggcttgagtggatgggatggatcgagcgtcttaacgaatggtccacacaaaactatgacacacgaacctccgagggcagtacgtacaccatacgaccacacgaacacactacccgaacgacgtccaacgggccctaaacgacgttacgggaaccttcgggaacggtacgtcccgtagtaacgtacttaccgtacggaaccggaaccgtacccgggtaccgttaggttaacgtttaacgtcggtacgaccggaggtaacgtacggtacgggggtaaatttggtttacgtacgttacggttaccctttgttacgtaccgtaccgggttcggggaccctacggggtaacccttacggg

SEQ ID NO: 197738 - DNA, 626 bp, Homo sapiens
  misc_feature: GYAE6OF02IUSSS.39.81.H04.1.454.CMB.1.raw
  modified_base (329)..(329): a, c, t, g, unknown or other
  misc_feature (329)..(329): n is a, c, g, or t
  modified_base (336)..(336): a, c, t, g, unknown or other
  misc_feature (336)..(336): n is a, c, g, or t
  modified_base (371)..(371): a, c, t, g, unknown or other
  misc_feature (371)..(371): n is a, c, g, or t
tcagtcgcactagtcacgaccggtgctcgatttagtagtgtagattcgcggggccccctagatcacagctcctcaccatggactggacctggagcatccttttcttggtggcagcaacaacaggtgcccactcccaggttcagctggtacagtctggagctgagatgacgaagccgtgggcctcagtgaaggtctctgcaggcttctgttacacctttacaactagtggtatcgtaggttgggtgacgacacggtccccgtaggacgaagggtcttggaggtggagtgggatggatcgagtcgtctaacagtcggtacacaataaactncgacaanacgacctcgaggcagactcaccagcacacagacanctacacgcgacacggacaactcgtacgacgtacggaggccgtaccgtaggacgtaacgtcgtacggaaccgtaccgacggtacccggttagttaattacggtcgaggacgtagacggtaaggtaaccgggtaatttaacgttcggaacgttcggttacccgtttagttacgtaccgtacgggtaccgggtccggtaaacggttacccgtaggtacctcccggtaccgtaccgtacgaacccgtccctaaaccggg

SEQ ID NO: 197739 - DNA, 674 bp, Homo sapiens
  misc_feature: GYAE6OF02GBX6Y.39.81.H04.1.454.CMB.1.raw
  modified_base (353)..(353): a, c, t, g, unknown or other
  misc_feature (353)..(353): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtctcctgcaaggcttctggttacacctttaccaactatggtatctaggttggtgcgacacggcccctggaccgaagggcttgagtggatggggatggatcgagcgctaacgaatggtcacaacaaactngcacacgacctcgaggcagcgtacaccgatcgaaccacgacgacacactccacgacgaccacggcctaacagtcggaacctggaacggactccgtaggaacgtactaccgtaggaaccgaaccggacgggtacccgttaggttaaccgtttaccgtagggtacggaaccggtaagggtaacggtaacgggttaaccgggggttaaattttaacggttttaaccggaacccggtttaccgggttacccttttaccggtttacggtacccgtttaccggggtaccggggtacccggtaaaccggggttaccccgttaccgggg

SEQ ID NO: 197740 - DNA, 750 bp, Homo sapiens
  misc_feature: GYAE6OF02HABCA.39.81.H04.1.454.CMB.1.raw
  modified_base (338)..(338): a, c, t, g, unknown or other
  misc_feature (338)..(338): n is a, c, g, or t
  modified_base (467)..(467): a, c, t, g, unknown or other
  misc_feature (467)..(467): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaagtgcccactcccaggttcagctggtacagtctggagctgagatgacgaagcctggggcctcagtgaaggtctcctgcaaggcttctggttactacctttaccaactatggtatctagttgggtgcgacacggccccgtggacgaagggtcttgagtggagtgggagtggatcgagcgtacttanaagtcggtacacaacaatatgcacacgaacctcgaggcagacgtacaccatcgaccacacgacacactaccgacggacgccgacgacctacgacgttacggacctaggacggacgtccgaggtaacgtnttacccggacgaacccggaacccggacccggggttaccgtttaggttaaaccgttttaccgttcggggttaaccggaaccgggtaaggggtaaaccgggttaacggggttaaccgggggtttaaaaacttttttacgggttttttaacccgggaaccgggtttttaccccgggttttaaccccgtttttacggtttttaacccgggttaacccgggtttacccggggttaacccggggggtaaccccggtaacccgggggtttaaacccccgtttcccggggg

SEQ ID NO: 197741 - DNA, 556 bp, Homo sapiens
  misc_feature: GYAE6OF02GYFK9.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaagtctcctgcagcttctgttacaccttacactatgtatcagttgggtgcgacacggcccctggacagggcttggagtggagtgggatggatcgagcgcttacaagtggtcacgacaaactgtcgacacacgacctcgaggcagacgtcacatcgaccacacgacacactaccgacgtacgccgacggcctaacgagtacggacctaggacggacgcctaggacgactcgtgaaccgaccgacggccgtagtacgttctggcgagagagaggtaggtaattgttacgacgttcgtaccttgttacgaccgttacggtccgggactacgggaccctcgg

SEQ ID NO: 197742 - DNA, 695 bp, Homo sapiens
  misc_feature: GYAE6OF02G1G0Q.39.81.H04.1.454.CMB.1.raw
  modified_base (213)..(213): a, c, t, g, unknown or other
  misc_feature (213)..(213): n is a, c, g, or t
  modified_base (236)..(236): a, c, t, g, unknown or other
  misc_feature (236)..(236): n is a, c, g, or t
  modified_base (320)..(320): a, c, t, g, unknown or other
  misc_feature (320)..(320): n is a, c, g, or t
  modified_base (430)..(430): a, c, t, g, unknown or other
  misc_feature (430)..(430): n is a, c, g, or t
tcagtcgcactagtcacgaccggtgctcgatttagtagtgtagattcgcggggacccaaaaaccacacccctcctgggagaatcccctagatcacagctcctcaccatggactggacctggagcatccttttctggtggcagcaacacaggtgcccactcccaggttccagctggtacagtctggagctgagatgacgaagccgtggggcctnagtgaaggtctctgcaaggcttntggttacacctttacaacttagtggtaaaatctagttggtgcgacacggccctggacgaagggcttagaggtggagtgggtagngggtatcgagcgtacgttaacaagtcggtacaacgaacctaaaactatcgacaacgaacgaaccctaccggaggcctaaggatacccaacgtacacggaacccaacgaanacgtaacaaccgtaccgaaccgacggaccgaaccggacctacgagtaccgacgtaggacggacgccgttaggagtacgtccgagtaaccggacgtacccgggtacggtacgttaacggtttaccgtaggttggaaccgaggtaacgtacggtaacggggttaaactttaggtttacgtacccggttaacggttaccccgtttagtttaacgtacccggttaacgggtaccgggtaaccgggtacccgggtaaccgttacccgggg

SEQ ID NO: 197743 - DNA, 582 bp, Homo sapiens
  misc_feature: GYAE6OF02FGY49.39.81.H04.1.454.CMB.1.raw
  modified_base (345)..(345): a, c, t, g, unknown or other
  misc_feature (345)..(345): n is a, c, g, or t
tcagtcgcactagtcacgaccggtgctcgatttagtagtgtagattcgcgggggacccaaaaaccacacccctccttgggagaatcccctagatcacagctcctcaccatggactggacctggagcatccttttcttggtggcagcaacaacaggtgcccactccccaggttcagctggtacagtctggagctgagatgacgaagcctggggcctcagtgaaggtcctcctgcaaggcttctggttacacctttaccaactatggtatcagttgggtgcgacaggcccctggacaagggcttggagtggatgggatggatcagcgcttacatggcacacaaactntgcacacgaacctccgagggcagacgtcaaccatagaccacagacacactaccgacgagaccgacggacctacagtcggacccgtgacggacgccgtagagtactctacggaccgacgaccggtccgttagtaactttaccgagtcgacgagagtacgtacggggtaatttgtttagaccgttcggttacccttgtttacggacgttaccggtggggacccacgggtaccccgtcgg

SEQ ID NO: 197744 - DNA, 654 bp, Homo sapiens
  misc_feature: GYAE6OF02J3D9D.39.81.H04.1.454.CMB.1.raw
  modified_base (284)..(284): a, c, t, g, unknown or other
  misc_feature (284)..(284): n is a, c, g, or t
  modified_base (486)..(486): a, c, t, g, unknown or other
  misc_feature (486)..(486): n is a, c, g, or t
  modified_base (586)..(586): a, c, t, g, unknown or other
  misc_feature (586)..(586): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacacaggtgcccactcccaggttcagctggtacagtctggagctgagatgacgaagcctggggcctcagtgaaggtcctaccgtgcaaggtcttcgtggttacacccttttaaccaactatggtatctaggttggtnccgacgacggcccctaggacgaagggtctggagtggtacgtgggatggatcgagcgtacttacagttggaccaactactaaactagtcgacctacgaacgtaccctaccggagggacacggacgtaccaacctacgtacgaacccaacgacgaccacacctaaccgacgaacgccgaacgtcctaacgacgtacggtaccgnggacgacgtccgagacgtacttcgacgtaccgaccgtccggtagtacgttacttcgaggtacgtacggagaacgtacggtacggttaatttaccggttanacccggtttacgttaccctaggtttacggtacctacggttcgggaaccgtacgggttaccgtacccgg

SEQ ID NO: 197745 - DNA, 640 bp, Homo sapiens
  misc_feature: GYAE6OF02GS6Z3.39.81.H04.1.454.CMB.1.raw
  modified_base (327)..(327): a, c, t, g, unknown or other
  misc_feature (327)..(327): n is a, c, g, or t
  modified_base (345)..(345): a, c, t, g, unknown or other
  misc_feature (345)..(345): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcgagtgaaggtctcctgcaaggcttctggttacacctttacaactatggtatcagttgggtgcgacaggcccctggacaagggctgagtggatgggatggatcgagcgacttanaatggtcacgacaaactntgaccacgacgaacctccgagggacagatccaaccatcgaccacgagacacactacccaacggagccgacgacctaacagtacgggacccttgggaacggacgtccgtaggacgtacgttaccgtacgaaccggaaccgaccggtcccggttagttaacgtttaccgtggttacgacggagaacggtaggtaccgggtaaattttacggtttacgaaccgttaccgggttaccctttagtttacggtaaccggttacggtaccggggaccctaaccggggtaccccttaccgggg

SEQ ID NO: 197746 - DNA, 614 bp, Homo sapiens
  misc_feature: GYAE6OF02GR1RP.39.81.H04.1.454.CMB.1.raw
  modified_base (401)..(401): a, c, t, g, unknown or other
  misc_feature (401)..(401): n is a, c, g, or t
  modified_base (513)..(513): a, c, t, g, unknown or other
  misc_feature (513)..(513): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagcgtgagatgacgaagcctggggcctcgagtgaaggtctcctgcaggtcttctggttacacctttaccaactatggtatctaggttggtgcgacacggccctggacgaaggtctgaggtggagtgggatggatcgagcgtacttaacaagtcggtacaacaactaaactatcgacacgaacgaaccctcgaacgggcaaggacgtccaacanacgaccacgagacacactaccgaacgacgacgaccggacaacgtagcggacctggaacgacgtacgtgaagtcctcgtacgaacgaccggcggtacgttattaacgtttcgnggtacgagtaggagtacggttagggttaaatttggtttaacgacgttccggttacccttgttacggacgttacgggtccgggacgtaccgggtacctacgg

SEQ ID NO: 197747 - DNA, 741 bp, Homo sapiens
  misc_feature: GYAE6OF02GQJWS.39.81.H04.1.454.CMB.1.raw
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtcgtggagctgagatgacgaagccgtggggcctcagtgaaggtctctgcaaggcttctgttacacctttacactatgtatcgagttggtgcgacgacggcccgtaggacgaagggtcttggaggtggagtgggagtggatcgagcgtcttaacaagtcggtacaactaaccaaactagtacgacacgaaccgtaaccgtaccggaacgggccgaaggtacgtaccaacctagtaaccgaacccaacgtaacgaaccaaccgtaacgtccccgaaacggaccggtaacccaacccgggtacccttaaacggtaccgtaaccggggaccctaagggaccggtaacggaccgttagaacgttactaccgtaacgggaccgtaccggaacccggtccggtttagttaaccggttacgtcggtacggaacggaagtacggtacgggttaacggggttaaaattttcgggtttacgttaaccggtcggtttaccccttttaggttaccggttaaccggttaccgggtaccggggtacccgggtaacccggtacccggttccggg

SEQ ID NO: 197748 - DNA, 630 bp, Homo sapiens
  misc_feature: GYAE6OF02F3JJC.39.81.H04.1.454.CMB.1.raw
  modified_base (270)..(270): a, c, t, g, unknown or other
  misc_feature (270)..(270): n is a, c, g, or t
  modified_base (274)..(274): a, c, t, g, unknown or other
  misc_feature (274)..(274): n is a, c, g, or t
  modified_base (349)..(349): a, c, t, g, unknown or other
  misc_feature (349)..(349): n is a, c, g, or t
  modified_base (385)..(385): a, c, t, g, unknown or other
  misc_feature (385)..(385): n is a, c, g, or t
  modified_base (401)..(401): a, c, t, g, unknown or other
  misc_feature (401)..(401): n is a, c, g, or t
  modified_base (511)..(511): a, c, t, g, unknown or other
  misc_feature (511)..(511): n is a, c, g, or t
tcagtcgcactagtcacgaccggtgctcgatttagtagtgtagattcgcgggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtgggcctcagtgaaggtctcctgcgaagcttctggtacaccttacatatggtatcagttggtncganacggtccctggacaaggtctgagtggagtgggatggatcacggcgacgttaacgagtggtcaacaactaaactanacgacacacgaaacctccgaaggcagactacaccancgaccactagacaacntaccgacgagaccgacgcctaacgagtacggaacctggaacgacgtccgtagaaccgtatcccgtaagggacccgaaaccggtaccggccggttaagttactttaccggngttaccggagtagggtagttaccggtaacggggttaatttaccgttacggacgtttaccggttaacctttgttaacgttaccggtacgttcggggaacctaccggggttacctaccggg

SEQ ID NO: 197749 - DNA, 737 bp, Homo sapiens
  misc_feature: GYAE6OF02FH3Z2.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtcctcctgcgaaggtcttctggttacctacctttaccaactatggtatcgtaggttgggtgcgacgacggtccccgtaggacgaagggtcttggagtgggtagtgggagtggatcgacggcgtacttacgaagttcggtaccaaccgaactaaaacttgtcgactaacaacgtaaccctaccggacggggactaacggacgtaccaaccgtagtaccgaacccaacgacgacaacactacccgaacgacgccgaaccgtacctaacgacgtaccggtacccgtagggaacggaccgtaccgtaggaacgtacttacccgaacggaacccgtaacgggacccggggtaccgtttagttaaccgttttacgtcgggtaacggacggtaaggaacggttacgggtaacggggttaaacttttacggtttaccggaccggtttaccgggtttaccctttcggttacgtaaccggttccgggacggggtaacccgtaccggggtaaccccgttccggg

SEQ ID NO: 197750 - DNA, 647 bp, Homo sapiens
  misc_feature: GYAE6OF02IHS7Y.39.81.H04.1.454.CMB.1.raw
  modified_base (308)..(308): a, c, t, g, unknown or other
  misc_feature (308)..(308): n is a, c, g, or t
  modified_base (356)..(356): a, c, t, g, unknown or other
  misc_feature (356)..(356): n is a, c, g, or t
  modified_base (390)..(390): a, c, t, g, unknown or other
  misc_feature (390)..(390): n is a, c, g, or t
  modified_base (402)..(402): a, c, t, g, unknown or other
  misc_feature (402)..(402): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatggacgaagccgtggggcctcagtgaaggtctcctgcaaggcttctggttacacctttaccaactatggtatcaggttgggtgcgacacggcccctggacaagggtcttggngtggagtgggatggatcagcgtcttaacagtggtacacaactaaactntgacacgaagaaccctcgagggcagacgtcacancgacacagacanactaccaacgacgacacggtacctacgacgtcggacctacgggacgacggccctagtacgacgtacgtaggtaaccgacgtaccgggtacgtagttaacgttaccgtaggtagaccggaggtaactagggtaaccggggtaattttaacggttttacgacggtttacccgggttaccctttaggttttccggaacgtttaccggggtacccggggtaaccggtaccggggtaccccttaccgggg

SEQ ID NO: 197751 - DNA, 715 bp, Homo sapiens
  misc_feature: GYAE6OF02IIUT6.39.81.H04.1.454.CMB.1.raw
tcagtcgcactagtcacgaccggtgctcgatttagtagtgtagattcgcggagacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtctcctgcgagcttctggttactaccttacaactatggtactcgagttgggtgcgacgacggccccgtggacgaagggtcttggaggtggtacgtggggagtggtactgacgccgtacttaacgaagtcgggtaccaactaaccgaaaactagtacgaccgaacgtaaccgtaaacccgtccgaacggggaccgtacggtaacgtaccaacccgtaacgtaccgaacccgaaccgacgaacctaacgtaactaacccgaaccggtaccgaccggtaacccggaccgtaacgacgtacgggtaccgtaacgggacggaacgccgttagacgtagttacgcgaacggaccggaccggaccgttaggttaacttcggtaggacggtacgacggtaggacggtaacgggtaaatttcggttttacggacggttaccggttacccgttactttacggaccgtttaccgggacggtaccgggtaacgggtaacccgg

SEQ ID NO: 197752 - DNA, 610 bp, Homo sapiens
  misc_feature: GYAE6OF02I3UK0.39.81.H04.1.454.CMB.1.raw
tcagtcgcactagtcacgaccggtgctcgatttagtagtgtagattcgcgggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtactcgagttgggtgcgacacggccctggacgagggcttgagtggagtgggatggatcgacgcgtcttacgaagttcggtacacaactaaactagtcgacacgaacgaacctcgagggacaggacgtacaccatcgaaccacgacaacacactaccgacgagccacggctacacgtcgaccgtggacgacgccgtagagtactcgtacggaccgacgaccggcgttacgttacgttacgtcggtgacgaagacgtaggttacgggtaatttaggtttacgacggttaccggttaccgttacgtttacgacgttaccggtcgggtaccggtaccgggtacccgttacgg

SEQ ID NO: 197753 - DNA, 668 bp, Homo sapiens
  misc_feature: GYAE6OF02HX57Q.39.81.H04.1.454.CMB.1.raw
  modified_base (192)..(192): a, c, t, g, unknown or other
  misc_feature (192)..(192): n is a, c, g, or t
  modified_base (255)..(255): a, c, t, g, unknown or other
  misc_feature (255)..(255): n is a, c, g, or t
  modified_base (269)..(269): a, c, t, g, unknown or other
  misc_feature (269)..(269): n is a, c, g, or t
  modified_base (505)..(505): a, c, t, g, unknown or other
  misc_feature (505)..(505): n is a, c, g, or t
tcagtcgcactagtcacgaccggtgctcgatttagtagtgtagattcgcgggggacccaaaaaaccacacccctccttggggagaatcccctagatcacagctcctcaccatggactggacctggagcatccttttcttggtggcagcaacaacaggtgcccactcccaggttcagctggtacagtctgganctgagatgacgaagccgtggggcctcagtgaggtctctgcagcttctgtacaccttacaactntgtatcaggttggncgacacggccctaggacgaagggtcttggagtggagtagggatggatcgagccgtacttaacgaagttcgggtacaacgaactaaacgtagtacgacaacaacgtaaccctacgaagggacaaggtacgtaccaaccgtagtaccgaacccaacgaacgaaccaccgtaacctacccgaaacggaccgaccgacccggtacctaccgaacgtaccggaacctacggaacggtaccnccgtagaacgtctacggacgaaccgaaccggccggtacgttagttacgttacgtcggtagacgagacggtaggttaacgggtaatttcgtttacggacgttaccggttacccttaggttacgaccggttacggtaccggggaccgttaccgggtaccgtccgg

SEQ ID NO: 197754 - DNA, 636 bp, Homo sapiens
  misc_feature: GYAE6OF02FUSAG.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctctgcaaggcttctggttacaccttttaccaatatggtatcaggttgggtgcgacacggcccctggacaagggtcttggagtgggagtgggatggatcgagcgtacttaacgaagtggtacaacgaacaaaaccttatcggaccaacacgtaaaccctccggagggacaggacgtaccaccatcgaaccacgaacgaacacactaccgaacgacgaccgaccggacctaacgacgtacggacccgttaggacggacgccgttagacgtactacggtacggaccgaccggtaccggtacgttacgtaacgtttcgtcgtcggacgaggaacggtacggtaacgggtaaatttggtttacggacgttcggttacccttcgttagtacgtcggtacgggctaccgggtacctcgg

SEQ ID NO: 197755 - DNA, 848 bp, Homo sapiens
  misc_feature: GYAE6OF02HU7NM.39.81.H04.1.454.CMB.1.raw
tcagtcgcactagtcacgaccggtgctcgatttagtagtgtagattcgcgggggactggacctggagcatccttttcttggtggcagcaacaacaggtgcccactcccaggttcagttggtacagtctggagctgagatgacgaagcctggggcctcagtgaaggtctctgcaaggcttctggttacacctttaccaactatggtatcagttgggtgcgacgacggcccctggaaccgaagggtcttaggagtggagtgggataggatcagcgcttaacaatggtaccaacgaactaaaactatggactaacaacggaaccctaccgaaggggccaaggtacgtaccaaccaatcggaaaccaacaacgaactaacaactacccgaaacggacgaccgaaccggtacccttaacgacgtacgggtaacctacgggaacgggtaacgtacccgttaggaaacgtacgtttcgaacgggtaacccggaacccgaacccggggtaccccggttaggtttaaaccgtttaacgttcgggtacggaaccgggaagggtaagggtaaacgggttaaaccgggggttaaaaattttaacggtttttacggtaaaccgtttaccgggtttaaccccgttttcgttttaaacggaacccgtttaaccgggtaccggggggtacccggtaaaccggggttaaccccgttcggggtaccctaacccggtttccttacccgtacctaaccggtaccccgtacccgaaacccggaaccgggtaccccgtaacgttacccgggttccccttttaccccccggacggtaccccctacccccgttacccctacccgtaaaccgg

SEQ ID NO: 197756 - DNA, 700 bp, Homo sapiens
  misc_feature: GYAE6OF02GZKR9.39.81.H04.1.454.CMB.1.raw
  modified_base (273)..(273): a, c, t, g, unknown or other
  misc_feature (273)..(273): n is a, c, g, or t
  modified_base (346)..(346): a, c, t, g, unknown or other
  misc_feature (346)..(346): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacaactatggtatcagttggngcgacacggcccctggacaagggcttgagtggatggggatggatcgagcgcttacagtggtcacgacaaactntcgcacacgaacctccgagggcagacgtcaccatcgaccacgacgacacactacccacgacgaccgaaccggcctaacgacgtaccggaacctagggaacggtacgaccgttaggaacgtacttccggtacgaaccggtaaccgtaccgggtaccggtttaacgttacgtttaaccgtaggttaccgggtaccggtaagggtacggtacggggttaaaccggggtaaagttttaacggtttttaacggaaccggtttacccgggtttaaccccgtttaccggtttttaacggtaccctttaaccgggggttccggggtaaccccggtaaccgggggttacccccgttaccgggg

SEQ ID NO: 197757 - DNA, 682 bp, Homo sapiens
  misc_feature: GYAE6OF02HQDE9.39.81.H04.1.454.CMB.1.raw
  modified_base (368)..(368): a, c, t, g, unknown or other
  misc_feature (368)..(368): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtctcctgcaaggcttctcggttaccacctttaccaactatggtatctaggttgggtgcgacgacggtccccgtggaacgagggtcttagaggtggagtgggatggactcgagccgtactacgaagtcgtacactaactaactancgacacacgaacctcggagggaccagaaccgtcaaccgtacgtacgaacccagtacgaacctaccaacgtacccaacggtacgaccgaacggactaacgtacacggtacggaccgtaggacggacgtaccgtagagtacgtccgtacggaaccggtacgtaccgggtacggtaacgttacgttacgtaggcgtacggacggtacgggtacggttaacgggtaactttacgtttaccggtaacgtttcccggttaaccgttaccggtttacgtaccggttaccggtaccgggaccgggttaccggtaaccccggg

SEQ ID NO: 197758 - DNA, 580 bp, Homo sapiens
  misc_feature: GYAE6OF02GF3A9.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgctacatggtcacacaaactatgcacagaacctccagggcagacgtacaccatgaccacagacacactacccaacgacgacgaccggcctaacgactacggacctacggacggacggcccttaggacgtactcgtacgaaccggtacgaccggtccgtagtattactgtacgcgagagagtacggggtaatagttttagacgttacggttaccttcgtttacgaccgttaccgtcggggaccgtaccgggaccgttccgg

SEQ ID NO: 197759 - DNA, 702 bp, Homo sapiens
  misc_feature: GYAE6OF02I8RCB.39.81.H04.1.454.CMB.1.raw
  modified_base (493)..(493): a, c, t, g, unknown or other
  misc_feature (493)..(493): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtgggcctcgagtgagtctctgcgaagctcgtgtacaccttaccaactatggtactcgtaggttcgggtcgacgtaccgacggtccccgtaggacgaacggggtcgttaggaggttgggacgtggggagtaggattcgaggtcgtaaccttacgaagtcggtaccaacgtaactaacgtaagtcgacgaacacgtaaacctacggagggactaagtacggtacaacctaacgtacggaacctacaacggtaaccacacgtaacccgacgaacgaccgacggtaccaanacggtaccggacgtaggacgaccgtacgtacggaacgtactaccgacggtaaccggaccgtaacccgggtccgttaaggttactttacgagggttcgaaaggacgtaacgggtaggttaaccgggtaattttacggttacggtcggttaccgttccgtttacgttacggtagttaccggtcggggaaccgtaaccgggtcccgttacgg

SEQ ID NO: 197760 - DNA, 607 bp, Homo sapiens
  misc_feature: GYAE6OF02HEKMW.39.81.H04.1.454.CMB.1.raw
  modified_base (281)..(281): a, c, t, g, unknown or other
  misc_feature (281)..(281): n is a, c, g, or t
  modified_base (356)..(357): a, c, t, g, unknown or other
  misc_feature (356)..(357): n is a, c, g, or t
  modified_base (386)..(386): a, c, t, g, unknown or other
  misc_feature (386)..(386): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtgggcctgagtgaaggtctcctgcaaggtcttcgtagttacctaccttaccaactagtgtatctaggttggtncgacgacggccctaggacgaggtcttggagttggagtgggatggatcgagcgtacttaacagtgacacaacaatnnacacacgactcgagacagcgtacacgtancgaccacacgacactactaccaagacgaccacgtacgaacgtagtaccggactagggtaacgacgtaccgtaggagtacctcggacgaaccggacctacggccgttaagtacgtacgttcgagaccgaagacggtaggttaacgggtaatttcggttacggacgttaccgtaccctttgttaacgacgttacgggtaggtacccgacgggttaccctcggg

SEQ ID NO: 197761 - DNA, 762 bp, Homo sapiens
  misc_feature: GYAE6OF02H4TOS.39.81.H04.1.454.CMB.1.raw
  modified_base (331)..(331): a, c, t, g, unknown or other
  misc_feature (331)..(331): n is a, c, g, or t
  modified_base (394)..(394): a, c, t, g, unknown or other
  misc_feature (394)..(394): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttacacctttaccaatatggtatcgtaggttgggtgcgacacggccctggacaagggtcttgagtggagtggatggatcgagcgcttanagtcgtacacacaaactatcgacacaacgacctacgagggacagacgtacaccatacgaccanaacgacaacatacccaacgacgaccgacggacctaacgacgtaggtacccgtaggaacggtacgaccgtagaacgtactaccggtacggaaccggtacggtaaccgggtacccggttaacggttaaccgttttacccggttaggggtaccggaacggtaacgggtaacgggttaacgggtttaaccggggggtttaaaacgtttaacgggtttttttaaccgggttaccgggtttaaccccggggttttttaaacccccgtttttccgggttttaaccgggttaacccggtttaaccgggggtttacccgggggggttaccccgggtaaaccccggggggtttaaacccccgttttaaccccgggggg

SEQ ID NO: 197762 - DNA, 608 bp, Homo sapiens
  misc_feature: GYAE6OF02FTG9L.39.81.H04.1.454.CMB.1.raw
tcagtcgcactagtcacgaccggtgctcgatttagtagtgtagattcgcgggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacacggcccctggacgaagggcttgagtggagtgggatggatcagcgcttacaatggtacacaacaaactatgcaacacgaacctccgagggcagagtcaccatcgaccacaagacacactacccgacgacgccgaaccggacctacgacgtacgggacctaggaggacgccgtaggagacgtcgtagaccgacgacgggtaccgtagtacgttacgtcgtagcgacgagagtaacgggtaacggttaactttacggttacgttacggttacccgttaccgtttacgtaccgttaccggttacgggtaccggtaccggtacccggtaccgg

SEQ ID NO: 197763 - DNA, 737 bp, Homo sapiens
  misc_feature: GYAE6OF02HB45A.39.81.H04.1.454.CMB.1.raw
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgagcctggggcctcgagtgaggtctcctgcaggcttctggttaccacctttaccaactatggttatcgtaggttgggtgcgacgacggcccctaggacaagggcttaggaggtgggagtggggattgggactcgaggcgtctttaacgaagtggtccaacaacaaaacgtatacgacctaacgtaacgaaaccctccggaacgggactacggaaccgtaccaacccgtaacgtacgaacccgacgaacgacccaacacctacccgaacggacgaccgaccggaccgtaccgacgtaccgggaaccgtgggaacggtacggccgtacggacgtactcgtacgaaccgtaaccggaccggtacggttacgttaacgtttacgtacggtacggtacgaacggtaacggtaaggttaacggggttaaagttttaacgttttaccggttaaccggtttcggttaaccccgtttacgttttacggtacccggttaccgggttacgggggtaccccggtaaccggggtaacccgtttacccggg

SEQ ID NO: 197764 - DNA, 769 bp, Homo sapiens
  misc_feature: GYAE6OF02H0VB7.39.81.H04.1.454.CMB.1.raw
  modified_base (474)..(474): a, c, t, g, unknown or other
  misc_feature (474)..(474): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattcctttttcttggtggcagcaacaacaggtgcccactcccaggttcagctggtacagtctggagctggagagtgacgaagccgtggggcctcgagtggaaggtctccgtgcgaaggtctttcgtggttaacctaccttttaaccaacgttatggtattcgtaggttgggtgcggacgacggcccctaggacggaagggtcgttggaggtggagtgggtagtgggatcgagcgtacttaacgagttcggtacaacgaactaaactacgtacgacctaacgacgaaacccgtccgaaggggacaaggtacgtaccaacccgagtacgaacccaacgaaccgactaaccncgtaacccgacggacgccgaacggacctaacacggtcggaaccgtagggacgtacgccgtaagacgtactccggtaacggaccggtaacggtacccggttccggttatttacccgtttacgtcgggttaccggaagggtaagggtaggttaaccgggttaaacggggtttaaaacttttacgggtttaggaacccgggttttaccggtttaaaccccgtttcgttttaacgggacccggtttaaccggggtaccggggtaccccgggttaacggggttaccccgtttacccgggg

SEQ ID NO: 197765 - DNA, 888 bp, Homo sapiens
  misc_feature: GYAE6OF02GW53Q.39.81.H04.1.454.CMB.1.raw
  modified_base (498)..(498): a, c, t, g, unknown or other
  misc_feature (498)..(498): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactccaggttcagctggtacagtctggagctgagatgacgaagccgtggggcctgagtgaaggtcctctgcaaggtcttcgtaggttacctacctttaccaactagtggtactactaggttgggtgcgtaacgacggtcccccgtaggaccgtaacggggtcgttaggtacggttgggaagttggggagtgggtacgtacgaggtccgtacttacgtaagttcgtaccgaacctaacgtaaaactacgtacgaccaacgtaacggtaacccgtaccgaacggggtacaacggtaacgggtaccctaaaccggtaaccgtacggtaacccaaacggaanaacccggtaacaacccgtacccggaaacggtaacccggccgtaaccgggtaacccgttaacgaacggttaaccggtaacccgtaagggtacgggaaccggtacgtaacggaaccgttaagtttacccgaacgggaaccggtaacccggtacccgggtaccccgtttaaggtttaaccgtttaaccggtcggtaaaccgggtacggaaacgggaccggtttaacggggttaaacggggggttaaacgtttttagggtttttaaacccggacccggggtttaaacccggtttacccgttttacccgggtttaacggttaaccccgggtttaaaccgggtttaaccggggggacccgtttaaaccccgggggttaaccccggtttccccgggg

SEQ ID NO: 197766 - DNA, 596 bp, Homo sapiens
  misc_feature: GYAE6OF02G7F8R.39.81.H04.1.454.CMB.1.raw
  modified_base (213)..(213): a, c, t, g, unknown or other
  misc_feature (213)..(213): n is a, c, g, or t
  modified_base (275)..(275): a, c, t, g, unknown or other
  misc_feature (275)..(275): n is a, c, g, or t
  modified_base (299)..(299): a, c, t, g, unknown or other
  misc_feature (299)..(299): n is a, c, g, or t
  modified_base (319)..(319): a, c, t, g, unknown or other
  misc_feature (319)..(319): n is a, c, g, or t
  modified_base (345)..(345): a, c, t, g, unknown or other
  misc_feature (345)..(345): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctgggcctnagtgaaggtctccgtgcaaggcttcgtggttacacctttacaactatggtatcagttgggtncgactaggccctggacaaggctgngtggatggatggatcagcgnttaacgatgtcacgaacaaacttagngacacgtaacaaacctccgaagggacagtagtcaacatcggaacacaagacacactaccaacgagaccacggactacgatcggacctgacgtagacctgacgatctgaacgtacgacgccgtagttaactacgtcgtgaccgagtacgagtacggggtaaacttattttaggaacgtttccggttaacccgttcgtttttacgaaccgttacggtaccggggtacccgtaacgggtacccccgttaccggg

SEQ ID NO: 197767 - DNA, 583 bp, Homo sapiens
  misc_feature: GYAE6OF02F3KF1.39.81.H04.1.454.CMB.1.raw
  modified_base (345)..(345): a, c, t, g, unknown or other
  misc_feature (345)..(345): n is a, c, g, or t
  modified_base (435)..(435): a, c, t, g, unknown or other
  misc_feature (435)..(435): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctctgcaaggcttctggttacacctttaccaactatggtatcagttgggtgcgacaggcccctggacaagggcttggagtggatgggatggatcagcgcttacaatggtacacaacaactangacacataacctcgagggcagagtccaaccagtcgaccacagacactactccacgacgcgaccggacctacagtacgaccgtggaggacnccgtagagtactcgtaggaacccgacgaccgggccgttaggtacttacgtagtcggacgtagaggacgtaacggggtaatttgttagtacgttcggttacccttagttacgaccgttacggcgggtaccgtaccgggtaccttccggg

SEQ ID NO: 197768 - DNA, 638 bp, Homo sapiens
  misc_feature: GYAE6OF02F5YQN.39.81.H04.1.454.CMB.1.raw
  modified_base (428)..(428): a, c, t, g, unknown or other
  misc_feature (428)..(428): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtctcctgcgaaggtcttctggttactacctttaaccaactatggtatcgtaggttgggtgcgtacgacggcccgtggacgaagggtctagagtggagtggggagtggatcgagcgtacttagaagtcggtaccaacaacaaactagacgacaacacgtaaccgtccgaagggcaagtacgtacaaccgataccgaaccacgaanaccacaactaccgagacgcgaccgcctaacgtacgtacggaccttaggacggacgtacgtagacgtacgtacgtacgacccgacgacccgggtaccgttagtaccgtttacgcgacgtacggagtaacgtaggtaacggtattacggttacgtacgttaccgtcctttacggtcgtaccggtacggtccgggacgtaccggaccgtccgg

SEQ ID NO: 197769 - DNA, 731 bp, Homo sapiens
  misc_feature: GYAE6OF02JDFET.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcattccttttcttcggtggcagcaacaacaggtgcccaactcccgaggttcacgctggtacagtctggagctgagatgacgaagccgtgggcctcgagtagtaacgtctaccgtcgacaacggtcttacgtacggttaacctacccttttaaccaacgttagttaggttactcgtaggttcgggtcgacgtacgacggtcccgtaggaactaacgggtcttaggtaggtgtaggtacggagtaggattcgagtcgtacttacagtcgacaacgactaatacgtcacaacgacgaaccgcgaacggagacgacgtaccaacgagtaccaacgacgaacgactacgactacccgagaactaccggaaccgtacgtaacgacgtaccggaccgtagaacgtcgaccgttagaactacggtcgaacggtaacccgacgttacccgggtattaccggttacttaaccggtgtacggaggtaaccggtaagtacccgggttaaaggttaaccgtttagttaacccgggtacctttacggttacccgttttacggttaacgtaacccgggtacgggtttaccggaaccccggtaacggttaacccgggttcccg

SEQ ID NO: 197770 - DNA, 722 bp, Homo sapiens
  misc_feature: GYAE6OF02G2433.39.81.H04.1.454.CMB.1.raw
  modified_base (213)..(213): a, c, t, g, unknown or other
  misc_feature (213)..(213): n is a, c, g, or t
  modified_base (628)..(628): a, c, t, g, unknown or other
  misc_feature (628)..(628): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgccactccaggttcagctggtacagtctggagctgagatgacgaagccgtggggcctnagtgaaggtctcctggcaaggcttctaggttactacctttaaccaactagtaggtataccgtaggttgggtcgacgtaccgtacggccccgttggaacgtaagggtcttggaggtcggtagttcggggatgggtaactcgaacggtcgtaccgttaagaagttcgggtaccaaccgtaaacaaaacttgtacgaaccgtaacgaaccgtaaccgtccggaagggtccaacggtaacgtcccgaaaaccgtacgtaacggaacccgaaacgaaagtaccccaaactacgtacccgaaaccggagacccgaacggacccaagttacgacgggtactagacgggacttaccgagaacgtcgtacggacgtaacgacccggacggtaccgtgttaaccttacgttggacgtagaacggnggttaccgtacgggttaaagttgttcgtaacgtcggtttaacttccgttaacggtacgtaccgggttagggtaccggaccgttaaccggtccgg

SEQ ID NO: 197771 - DNA, 710 bp, Homo sapiens
  misc_feature: GYAE6OF02JOHLZ.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtggggcctacgagtgaacggtctcctgacgaaggtcttcgtggttaacctaccttttaccaacgtatacggtatacgtaggttcgggtacgccgtacgtaccggcccctagggtaaccgaaggggttcttaggacggttaggaggtaggggtacgtagggtaactccggtaaggccgttaccttaagtagtcggtacaaccgaactaaacttgtacgacacgacgtaaccgtacggagggacagacgtaccgaaccacggtacgaaccgtaacgaacgacctaaacgtaccgtaacccgtaacggtaccgaccggtaaccggtaacctacgacggtaccgaccgtagggaccgtacgacgtaggactaacgtgtacgacgtacgccggtactagttacgtgtacgcggacgagtacgacggttaacggtattcggttacgtacgtacgttacccgttagttacgtacggtaccgggtacggaccggtaccggttacgtaccgg

SEQ ID NO: 197772 - DNA, 701 bp, Homo sapiens
  misc_feature: GYAE6OF02IJVXX.39.81.H04.1.454.CMB.1.raw
  modified_base (217)..(217): a, c, t, g, unknown or other
  misc_feature (217)..(217): n is a, c, g, or t
  modified_base (379)..(379): a, c, t, g, unknown or other
  misc_feature (379)..(379): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgacgatgacgaagccgtggggccttnaggtgaaggtctccgtgccaaggtcttcgttaggttacctaaccctttacaacttagtggtatcgtagttggtgcgacgacggccctggacgagggtctaggagtggagtggggactggactcgaggtccgtacttaacgatcggtacaacgtacaaacgtncgtacacgaacgtacctccgagggacacggacgtaccgaactatcggaaccctacgaacgtacaactactacccgaacgacgccgaaaccggtacctacagtaccgtaccgtaggtaacggtacgaccgaggtaacgtactaccgtagaaccggtaccgacccgggtaccgttaggttaccgttacgttacggtcggaccgtaagtacggtaggtaacggggttaacttacgttttaaccggacgttaaccggtttacccgttacggtttacgtaccggttaccgggtaccgggacccggttaacgggacccgtttaccggg

SEQ ID NO: 197773 - DNA, 607 bp, Homo sapiens
  misc_feature: GYAE6OF02F4OFB.39.81.H04.1.454.CMB.1.raw
  modified_base (356)..(356): a, c, t, g, unknown or other
  misc_feature (356)..(356): n is a, c, g, or t
  modified_base (519)..(519): a, c, t, g, unknown or other
  misc_feature (519)..(519): n is a, c, g, or t
  modified_base (569)..(569): a, c, t, g, unknown or other
  misc_feature (569)..(569): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagcctggggcctcagtgaaggtctcctgcaggcttctggttacacctttaccaactatggtatcagttggtgcgacacggcccctggacagggcttgagtggatggggatggatcgaggcgtacttacgaagttcggtacaactaacaaaactntcgacacacgaacctccgagggcaggactacaaccagtacgaccacagaccacactaccgaacgcgaccaccggtacctaacgtacgtacggacccgtaggacggacgtccgtaggacgtatcgtacgaaccgaccgaccgggtaccgttgttacttacgtgnggaccgagagtacggtaagggtaatttcgtttgaccgtcggttacccttntttggacgttacggcgggaccgtaccgggtacctccgg

SEQ ID NO: 197774 - DNA, 666 bp, Homo sapiens
  misc_feature: GYAE6OF02GG6E0.39.81.H04.1.454.CMB.1.raw
tcagtcgcactagtcacgaccggtgctcgatttagtagtgtagattcgcggggacccaaaaaccacaccctccttgggagaatcccctagatcacagctcctcaccatggactggacctggagcatccttttcttggtggcagcaacaacaggtgcccactcccaggttcagctggtacagtctggagctgagatgacgaagcctggggcctcgagtggaaggtcttcctgcaaggcttctggtacacctttaccaactatggtatcgagttgggtgacgtacgacggacccctaggaacgaagggtcttaggagtcggagtgggatggtatcgaggtcgtcttaacgaatggtacaacacgtaaactctcgacaacgaacgtaacccgtacgacggggactaaggtagtaccaacgtactacggtaacccaacggacgaactacaacctccgaacggtacgaccgtaaaccggccttaaacgacgttacgggaaccttagggaaaccggtagtaccgttagaaacgtcttaccggagtaaaccgacgacccggtcgttaagttacgtttaacgtcgtaggccgtaaggaggtacgtaggggtaattgttacacggtacgttacttcgtttacgaccgttcggtacgggacctacggtaccctcgg

SEQ ID NO: 197775 - DNA, 657 bp, Homo sapiens
  misc_feature: GYAE6OF02HQQFU.39.81.H04.1.454.CMB.1.raw
  modified_base (313)..(313): a, c, t, g, unknown or other
  misc_feature (313)..(313): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctccgtgcaaggcttcgtcggttactaccttttaccaactatggtatcgaggtttgggtgcgacacggcccctggaacaggcttgagnggatgggatggatcgagcgtactacaagtggtacaacaacgtaaactataggacaacgaacgtaacccgtccgaagggaccaaggacgtaccaaccgtacgtacgaacccaacaacgaaccaacgacctaccgaacggacgaccgaacggccttaacgacgtcgaaccgtaggacggtacgcgtagagacttcacggaaccgaaccggaccggtccgtagttaacgttcgtaggtcgaacggaggtagacggtacgggtaaatttcggttacggtaccgttaaccggtttcccttagtttacgacccgttggtaccgggacccgtaccgggtaccgttacccgg

SEQ ID NO: 197776 - DNA, 797 bp, Homo sapiens
  misc_feature: GYAE6OF02IUO4H.39.81.H04.1.454.CMB.1.raw
tcagtcgcactagtcacgaccggtgctcgatttagtagtgtagattcgcgggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtcctcctgcaaggtcttcgtggtactacctttaccaactagtggtatcgaggttgggtgcgacgacggacccccgtggacgaagggtcttaggaggtaggtagtaggggagttagggaacttcgacggtccgtacgttaaccgtaaagttcgggtaccaacctaaactaaaacgttacgttacggacctaaccgaacgtaaacccgtaccggacgggtacaaacggtacgttaccgaacccgtaagtaccgaaacccgtaacgaacggtaaccaaccgtaacctaaccccggaacggaaaccggacccggttaaacccgggaccttaacggtaaacggttaccgggaaccttacgggaacgggtaccgaccggttaaacggacggtaacttacggtaacggaaccggaaccgtaccgggttaccgttagtttaacgttaccgtggtacggaccggaaggtacggtacggtaacgggttaagttcgtttaaccggacgttaaccggttacccgtttacgttacggtaaccggttaccggtacggggtaccccgtaacgggtaccccggtttaccgg

SEQ ID NO: 197777 - DNA, 618 bp, Homo sapiens
  misc_feature: GYAE6OF02FGK3F.39.81.H04.1.454.CMB.1.raw
  modified_base (278)..(278): a, c, t, g, unknown or other
  misc_feature (278)..(278): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttggtgcganaggcccctggacagggcttgagtggatgggatggatcagcgcttacaatggtcacacaaactatgcaacacggaacctccgaagggcaacggatacgaacccagtcgaacccacgagaccaaccatcccgaagacgaccgaccggacctacaagtaccggactggaaggacgccgtagacgtacgtcgtagacgaacgaccgggtcccgttaggttactttacgacgttgccggagacggtacgtacgggggtaaatttacggtttaggaaccgttcgggttaaccctttcgtttacggtaacttacggttacggggacccgtacgggtaccccttacgg

SEQ ID NO: 197778 - DNA, 669 bp, Homo sapiens
  misc_feature: GYAE6OF02IH55A.39.81.H04.1.454.CMB.1.raw
  modified_base (326)..(326): a, c, t, g, unknown or other
  misc_feature (326)..(326): n is a, c, g, or t
  modified_base (350)..(350): a, c, t, g, unknown or other
  misc_feature (350)..(350): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcgacgtgaaggtctcctgcaggcttcgtggttactacctttaccaatatggtatcagttgggtgcgacgaggcccctggacagggtcttggagtggagtgggatggatcagcncttacagttggacacactaaactntacgacacagaacctcgagggacaggactaccaacatacgaaccagacgaacacacacccaacgacgaccaacggtacctaacgacgtccggaaccgtacggaacgggtcgaccgtacgtaaggtacgtaccgtacggaaccggtacggtacccgggtccgttaaggttacctttaacggttagtacgggtacccggaaggtaaggtacggtaaccgggggtaatttaacgttttacggaccgtttaccggttaaccctttacgtttacgtaccgttaccggttacggggtacccggtaccgggtacccggtttacggg

SEQ ID NO: 197779 - DNA, 678 bp, Homo sapiens
  misc_feature: GYAE6OF02IEAP2.39.81.H04.1.454.CMB.1.raw
  modified_base (351)..(351): a, c, t, g, unknown or other
  misc_feature (351)..(351): n is a, c, g, or t
tcagtcgcactagtcacgaccggtgctcgatttagtagtgtagattcgcgggggacccaaaaaccacacccctccttgggagaatcccctagatcacagctcctcaccatggactggacctggagcatccttttcttggtggcagcaacaacaggtgcccactcccagtttcagctggtacagtctggagctgagatgacgaagcctgggcctcagtgaaggtctctgcaaggcttctggttacacctttaccaatatggtatcgtagttgggtgcgacacggcccctggaacaacggggctttggaggtggatgggagttgggaatcgagcgtactacaagtggtacaanaacaaactatgacaacagaacctcgaggcagactcaacatacgaccaacgacgaacaacacgtacccaacggagaccgaccggtacctaacaacgtcggaacctaggacggacgacctacggaatactaccgtaacgaaccggtaccgtaaccggggtacccgttaaggttaactttaccgttaggtaccggtaaccgggaagtaaacggtacgggttaaacgggggttaaaattttaacggttttacggtaacgttccggtttaaacccttggttttaaccggacgttacggttaccgggggaccttaaccgggtacccttacggg

SEQ ID NO: 197780 - DNA, 659 bp, Homo sapiens
  misc_feature: GYAE6OF02G60Y9.39.81.H04.1.454.CMB.1.raw
  modified_base (214)..(214): a, c, t, g, unknown or other
  misc_feature (214)..(214): n is a, c, g, or t
  modified_base (359)..(359): a, c, t, g, unknown or other
  misc_feature (359)..(359): n is a, c, g, or t
  modified_base (394)..(394): a, c, t, g, unknown or other
  misc_feature (394)..(394): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctnagtgaaggtctcctgcaaggcttctggtacacctttacaactatggtatctagttgggtgccgacacggcccctggacaaggggcttggagtgggagtaggggatggatcgagcggcttaacgaatcggtacacacaaactagtnacaacacgaacctccgagggcaaggactcaacctntcgaacacgaagacgacactaccaacggacacgacccggtacctaacgacgtacggaccgtacggaacgggacggtccctaggacgtactacgtacgaaccggtaccgaccgggtacgttacgttaagttaccgttaggtcggaacggtaagaggtacgggttaacgggtaaagtttacgtttaggtacggtttacggtacccgtttacggtttacggtaaccgttacgggtcgggggtaccgtacggggtaccccgttaccggg

SEQ ID NO: 197781 - DNA, 700 bp, Homo sapiens
  misc_feature: GYAE6OF02HQ6XS.39.81.H04.1.454.CMB.1.raw
  modified_base (231)..(231): a, c, t, g, unknown or other
  misc_feature (231)..(231): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcttgggtggcagcaaacaacaggtgcccacctcccgaggttcagctggtacagtctgtagctgagatgacgaacgcgtggggcctcagtgaaggtcncctgacaaggcttctggttacaccttttaaccaactagtcggttatcgtaggttggtgcgacgacggcccctaggaacgtaaggtcgttaggaggtaggaagtgggatggactcaggcacgttaacaagttgtacacgaactaaacttagcgacaacgtaacgaaccgtccgaggacgaacgtacgtaccgaacctacgacgaaccaagaacgaaccacactaccgaacgacgacgtacggaccaacgtacgcggtaacgtacgggacggactaccgtggaacgtatccgtaacggaacccggtaaccgtaccggggtcgtaacgtttaacgttacgcggttagacgggaagtaccgggaaggttaaccggtttaaagtcgtttaacggtaccggtaccggttttaacccgtttgttaaccgttaccggtaacgggttccgggaaccgtaccggggtaacccgtaccgg

SEQ ID NO: 197782 - DNA, 733 bp, Homo sapiens
  misc_feature: GYAE6OF02I4KR0.39.81.H04.1.454.CMB.1.raw
  modified_base (280)..(280): a, c, t, g, unknown or other
  misc_feature (280)..(280): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggtcttcgtggttacacctttacaactagtgtatcgtagttgggtncggacacggcccgtaggaacgaagggcttaggacgtgggtagtaggggactagggactcggacggtaccgtacgtttacgaagttacgggtaccgtaacctaacgtaaaacttagttcggaaccgaacctaacggtaaacccctaccggaacggggtaccaacggtaaccgtacctaaccgtacgtaaccgtaaccgaacgaagaaccaactaaccgtacccgaacggaacgacccgaacggtaccctaacgacggttacggaacccgttcggaaacggtacgtcccgtaagggacgtacgtacgtaggaaccgtaccggaccgggtccgtttaagttaacttaccgttggtaccgacggaagtagtacggtaacgggtaatttacggtttagaccgttacgttccttaggttacgaccgttccggtacgggaccgtacgggtaccgtaccgg

SEQ ID NO: 197783 - DNA, 693 bp, Homo sapiens
  misc_feature: GYAE6OF02H7R2T.39.81.H04.1.454.CMB.1.raw
  modified_base (238)..(238): a, c, t, g, unknown or other
  misc_feature (238)..(238): n is a, c, g, or t
  modified_base (346)..(346): a, c, t, g, unknown or other
  misc_feature (346)..(346): n is a, c, g, or t
tcagtcgcactagtcacgaccggtgctcgatttagtagtgtagattcgcgggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctgggcctcagtgaggtctcctgcaaggcttcngttacacctttacaactatggtatcagttggtgcgacgaggcccctggacgaaggtcttgagtggagtggggatggatcgagcgtcttaacgatggtacacacaactntgcacacgaactcgagggcaggacgtacaccagtacgaaccacgacgacacactaccaacgacgacgaacggcctaacacgtacggaaccgtggaacggaacgtccgtaacggaggtaaccttacggtacggaacccggaaccggtaacccggggtaccgttacggttaacctttacggttcggtaaccgggtaccgtaagggtaacggtacgggttaacgggggttaaacgtttacggtttttaacggtaaccggtttaccgggtttaacccccgttaggtttttaccggaaccgtttacgggttaaccggggggtacccgttaacggggacccccgtttacgggg

SEQ ID NO: 197784 - DNA, 664 bp, Homo sapiens
  misc_feature: GYAE6OF02JS9ZN.39.81.H04.1.454.CMB.1.raw
  modified_base (428)..(428): a, c, t, g, unknown or other
  misc_feature (428)..(428): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggtcttctcggttaccaccgttttaccaactatcggtatcaggttggtgcgtacaggccccgtaggacaagggcttgacgtggacgtggacgtggatcgaacgcggtacttacgtaagttcggtcaactaaccgaaactacgtgacacgtacgaaccctaccgagggcaagtacgtacaccgtagtcccgaaccanaacggactacaccgtaccacgacggtaccaccggtccacgaactcggaacccgtcggtagacgcctagtaagtcgtaccgtacggaaccgtccgacgggtaccgttcgtaacttccgtagtcggaggtacgaggttaacggacgggtaactttagttaccgttacgttccgggttaacccttgtttacccgaaccgtttcggttaccggggaaccggtacgggtacccttaccggg

SEQ ID NO: 197785 - DNA, 626 bp, Homo sapiens
  misc_feature: GYAE6OF02GIXQE.39.81.H04.1.454.CMB.1.raw
  modified_base (283)..(283): a, c, t, g, unknown or other
  misc_feature (283)..(283): n is a, c, g, or t
  modified_base (288)..(288): a, c, t, g, unknown or other
  misc_feature (288)..(288): n is a, c, g, or t
  modified_base (307)..(307): a, c, t, g, unknown or other
  misc_feature (307)..(307): n is a, c, g, or t
  modified_base (326)..(326): a, c, t, g, unknown or other
  misc_feature (326)..(326): n is a, c, g, or t
tcagtcgcactagtcacgaccggtgctcgatttagtagtgtagattcgcgggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggtcttctaggttaccaccgtttaccaactagtggtatcgaggttgggtncgacncggccctggacagggctgngtggagtgggatggatcgngcgacttacaagtcggtacacgaacaaacgtagtcgacaacgacgaaccctccggagggccaaggacgtacaacccagtaccggaaccacgaacgacaacactccgacgacgccgaccggtctacagtcgacctggaagcgcgagagtactcgtacgacgacgccggcgttagttacgttacgtgtacggagtagacggtacggtacgggtttaattaggttttacgaaccgtttccggttaccctttcggttacggttaacgtaccggtacggggtaccgacgggttaccccgtccggg

SEQ ID NO: 197786 - DNA, 675 bp, Homo sapiens
  misc_feature: GYAE6OF02FF57F.39.81.H04.1.454.CMB.1.raw
  modified_base (276)..(276): a, c, t, g, unknown or other
  misc_feature (276)..(276): n is a, c, g, or t
  modified_base (485)..(485): a, c, t, g, unknown or other
  misc_feature (485)..(485): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttctggtggcagcaacaacaggtgcccactcccaggttcagctggtacagtctggagctgagatgacgaagccgtggggcctcagtgaaggtcctcctgcaaggcttctggttacctaccttaccaactatggtatcagttggtncgtacgacggccccgtggacaagggtcttggagtcggagtcgggtatggtatccgagcgtcttaacaagtcgggtaccacaacgtaaaactagtcgaccaacgacgaacccttcccggaacgggactaacggacgtacaacctacgtacgaacccaacacgtaacactacaccacgaacgccgacgacctacgatcggacctgaggacnccgtagacgtagtcgtacggacgacggtaccgtaccgttacgttaacgttacgtggtacgcgggaacgtaaggttacggaacgggttaactttaatttaaccgggaacgtttacccgggtttcccttaacgttttacgacccgttaacccgggttcggggaccccgtaacggggttaccccttaccgggg

SEQ ID NO: 197787 - DNA, 600 bp, Homo sapiens
  misc_feature: GYAE6OF02HH3EZ.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggtccctggacaagggcttgaggttggagtgggatggatcagcgcttacaattggtcacacaaactatgacacagaacctccagggcaggagtcaccagtacgaccacgagaacacactaccacgagaccacggacctacgacgtcggacctggaacggacgccgtagacgatccgtagaccggacgaccggaccgtagtacgttacgtagtacgacgaggtaggagtacggggtaaacttaggttttacggtacgtacggttacccttacgtttacgtaccgttaccggtggggtacccgtaacgggtacccgttacgg

SEQ ID NO: 197788 - DNA, 618 bp, Homo sapiens
  misc_feature: GYAE6OF02HOW11.39.81.H04.1.454.CMB.1.raw
  modified_base (345)..(345): a, c, t, g, unknown or other
  misc_feature (345)..(345): n is a, c, g, or t
  modified_base (382)..(382): a, c, t, g, unknown or other
  misc_feature (382)..(382): n is a, c, g, or t
  modified_base (399)..(399): a, c, t, g, unknown or other
  misc_feature (399)..(399): n is a, c, g, or t
tcagtcgcactagtcacgaccggtgctcgatttagtagtgtagattcgcgggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcgagtgaaggtctcctgcaaggcttctggttacacctttacaactatggtatcagttgggtgcgacaggcccctggacaagggcttggagtggatgggatggatcagcgcttacaagtggtcaacacaaactntgacacagaacctcgagggcagatcaacatcgaccanacgacacataccagacncgacggcctacgagtcggacctggaaggtacgcctggaagtatcgtacgaaccgaccgaccgggtccgttagtaacgttacgtcggtacggacgacggacgtaggtaacgggggtaaatttacggttttacggaaccgttcgggtttaaccccgttcgttttacggaaccgtttaccggttacggggggtacccctaacgggggtaacccttaccgggg

SEQ ID NO: 197789 - DNA, 637 bp, Homo sapiens
  misc_feature: GYAE6OF02HU9ZC.39.81.H04.1.454.CMB.1.raw
  modified_base (360)..(360): a, c, t, g, unknown or other
  misc_feature (360)..(360): n is a, c, g, or t
tcagtcgcactagtcacgaccggtgctcgatttagtagtgtagattcgcggggaaccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttcgtggttaccacctttaccaactatggtatcgtagttgggtgcgacgacggccccgtaggacgaagggtcttaggagtggagtgggatggatcgagctcttacaagtgtacacaacaactagngacacgacacctcgaggcagagtcacatacgaccagacgacacactacccagaacgccgacgtacctacagtcggacctaggaggaccgacctaggacgtactcgtgaaccggaccgtaccggccgttagttaacgttacgtcggtgacggagtaggtaggttacggggtaaatttacggttttacggaaccggtttacccggttaccctttacgtttaccggtaaccgttaccggggttaccggggtaacccgtaccggggtaacccttacccggg

SEQ ID NO: 197790 - DNA, 651 bp, Homo sapiens
  misc_feature: GYAE6OF02G6LL1.39.81.H04.1.454.CMB.1.raw
  modified_base (271)..(271): a, c, t, g, unknown or other
  misc_feature (271)..(271): n is a, c, g, or t
  modified_base (352)..(352): a, c, t, g, unknown or other
  misc_feature (352)..(352): n is a, c, g, or t
  modified_base (478)..(478): a, c, t, g, unknown or other
  misc_feature (478)..(478): n is a, c, g, or t
  modified_base (597)..(597): a, c, t, g, unknown or other
  misc_feature (597)..(597): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggctctggttacacctttacaactatgtatcagttgggncgacacggccctggacaagggcttgagtggatgggagtggatcgtaggcgtcttaacgaatcggtacacgtaacaaaactntacgcaacgaacgaacccgtaccgagggacaacgagtacaaccatacgacctacaacgacacaacgtacccgacgaacgccaacggcctaacaagtcggtaaccctggaacggaaccgtccgaganacgttacgacgaaccgaccgtacggaccgttcgtaagtttaccgttggagtaccgggaagtacgtacggtacggggtaaaattttacggtttcggtaaccggttccgttaacccgtttntttaccggtaccgttaccggttaccggggtaccgaccgggtaaccccgttcggg

SEQ ID NO: 197791 - DNA, 746 bp, Homo sapiens
  misc_feature: GYAE6OF02JYE4G.39.81.H04.1.454.CMB.1.raw
  modified_base (189)..(189): a, c, t, g, unknown or other
  misc_feature (189)..(189): n is a, c, g, or t
  modified_base (289)..(289): a, c, t, g, unknown or other
  misc_feature (289)..(289): n is a, c, g, or t
  modified_base (719)..(719): a, c, t, g, unknown or other
  misc_feature (719)..(719): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctgganctgagatgacgaagcctggggcctcagtagaggtctcctgcaggcttctggtacaccttacaactatggtatcgagttgggtgacgacacgggtccccgngggtaaccaagggggtctttaggaggtagggtaaggtggggtagtggaactcgagccggtacttaactaagttgggtaccaactaacgaaaacttacgtagaccaaaccgtaacggaaacccttaccggaaggggacaaggtaccggtaccaaccgtaacgtacgaaacccgaacgaacgaaccaaccaacgtacccgaaaccggtaccggaaccgtaacccgggtaaccctaacggtaaccggttacggaacccgtagggaacggtaccgtaccggtaaccggagtaaccgtacgtaacggaccggtaccggaaccggtccggttaacgttacgttacgtaccggtacggtacggaaggtaggtaacggttacgggtaaatttaggtttaccggtactacggttacccttgttacgtacggttaccggngggtaaccgtcgggtaacccgttccgg

SEQ ID NO: 197792 - DNA, 739 bp, Homo sapiens
  misc_feature: GYAE6OF02FPMPJ.39.81.H04.1.454.CMB.1.raw
  modified_base (288)..(288): a, c, t, g, unknown or other
  misc_feature (288)..(288): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtggggcctcagtgaaggtctccgtgcaaggcttctaggttaccacctttaccaacttagtggttatacgtggttggggtncgacgacggcccctggacgaaggggtcttaggacggtggacgtggggtactgggtatccgaggcgtacttaacgaagttggtacaaccgtaactaaactagtcgaccaacgaacgaacccgtacgaagggtacaaggacgttaccaaccgtacgtaccggaacccgacgaacgtacccaacgtaacgtacccgaacggacgaccggtaacccggaccctaacgtaacggtccgggtaaaccgtacgggacgggtaccgtccggtagtaacgtacctcgtacggaacgtaccgaccgggtcctttaggtaccgtttgtacgtacggacgaagtagggttaacggtacgggttaaatttcgggtttaccgaacggtttacccgttaccctttaggttaaccggtaccgtaaccgggttaccggggtaccggtaaccgggtaccttacccgggg

SEQ ID NO: 197793 - DNA, 697 bp, Homo sapiens
  misc_feature: GYAE6OF02JSQJ0.39.81.H04.1.454.CMB.1.raw
tcagtcgcactagtcacgaccggtgctcgatttagtagtgtagattcgcggggacccaaaaaccacacccctcccttgggagaatcccctagatcacagctcctcaccatggactggacctggagcatccttttcttggtggcagcaacaacaggtgcccactcccaggttcagctggtacagtctggagctgagatgacgaagcctggggcctcgagtgaaggtctcctgcaggcttcgtggttactaccttaccaactatggtatcagttggtgcgacgacggccccgtggacgaagggcttggaggtggagtgggatgggatcgaggccgtacttacgtaatgggttaccacaacaaaaccttagtcgacgaacaacggtaaacctccgagggtaccgaggacgtaccaccaagttacgaacccagacgtaacaactacctaccgaaacgcgaccgaccggacctaacagttaccggaccgtaggaacggaccggtacgcgaacgtattccgtacggtaaccgaaccgggtacccggttaccggtacggttacgtttaacgttcgtacgggacgtacgggaagtacgggttaacggggtaaatttcggtttacggtacgtttaccgggttaaccctttcgttacgtacggttaccgggtacggggacccggttaccgggtaccgttacccgggg

SEQ ID NO: 197794 - DNA, 711 bp, Homo sapiens
  misc_feature: GYAE6OF02GFQTK.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtcctcctgcgaaggtcttacgtggttacctacccgttttaccaactagtggtaatcgtaggttgggtgcgaacgcggtccccgtggaaccgaagggtcttgaggtggagtgggatggatcgaggctacttacgagttcggtaccacgaactaaactctacgacaacgaacgtaaccgtcggacgggacaggtaccgtaccaactacgtacgaaccaaccgaacgacaccctacgtacccgaaacgtaccggacgacccggtacctaacgtaaccgtacggaaccggtgggaacggaccgtacgtgaacggtctaacgtcgaaccgaccggtaccggtaccgttaaggttacttaacggtcggacgtaacggagtaaggtaccggtaagggttaacgtttagttaaccgttcggttacccggtttacctttcggtttaacgtacggttacccgggtacgggaccccgggttacggacccgtttaccgg

SEQ ID NO: 197795 - DNA, 764 bp, Homo sapiens
  misc_feature: GYAE6OF02HIBIV.39.81.H04.1.454.CMB.1.raw
  modified_base (286)..(286): a, c, t, g, unknown or other
  misc_feature (286)..(286): n is a, c, g, or t
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaacggcttctggttacacctttaccaactagtggtatcgagttcggtgaccgacncggccccgtggacgaagggcttggaggtggatgggatgggatcgaggcgtacttacaagttggtaccaacaacgtaaactatcgtaccaacgaacgaaccctacgacgggtcaagggtacgaaccgtaacctaagtaccgaacccgtaaaccaacggaacctaaccgaacgttaccccgaaccggaaccggtaccgaaccggtacccgttaaccgacggtaccgggtacccgtacggaacgggaccgtaccgtacggtaacgacctacggttaacgaacccggaaccgggtaccgggtaccgggttacgtttaacgtttaacccgtaggtacggtacggtacgggtacgggtaaggttaaccgggggttaaattacggttttacggtaacccggtttaccggtttaaccccgtttacgtttaccggttaacccggttaccgggtacccggggtaccgggtaacccgggttaacccggg

SEQ ID NO: 197796 - DNA, 589 bp, Homo sapiens
  misc_feature: GYAE6OF02FPCIL.39.81.H04.1.454.CMB.1.raw
  modified_base (319)..(319): a, c, t, g, unknown or other
  misc_feature (319)..(319): n is a, c, g, or t
  modified_base (391)..(391): a, c, t, g, unknown or other
  misc_feature (391)..(391): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctgggggcctcagtgaaggtctcctgcaaggcttctggttacacctttaccaactatggtatcagttgggtgcgacaggccccctggacgaagggcttggagtggatgggatggntcagcgcttacaatggtcacacaaactatgcacagaacctccagggcagagtcaccatcgacacagacacanccacgacgcaccggctacgataggacctggacggacgccgtagacgagtcctaggaccgaaccgacgggtccttaggttacttacgttggtcgacggtagacggtagtaacggggtaatttacggtttagtaccttcgggttaacccttcggtttacgaccgttacggtcggggtaccgtaccgggtacccttccggg

SEQ ID NO: 197797 - DNA, 707 bp, Homo sapiens
  misc_feature: GYAE6OF02F57ES.39.81.H04.1.454.CMB.1.raw
  modified_base (204)..(204): a, c, t, g, unknown or other
  misc_feature (204)..(204): n is a, c, g, or t
  modified_base (344)..(344): a, c, t, g, unknown or other
  misc_feature (344)..(344): n is a, c, g, or t
tcagtcgcactagtcacgaccggtgctcgatttagtagtgtagattcgcgggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaancctggggcctcagtgaaggtctcctgcaaggcttctggttacacctttaccaactatggtatcagttgggtgcgacaggcccctggacaagggcttggagtggagtgggatggatcagcgcttacatgtcacacaaactntgcacagaacctcgagggcagacgtacacatacgaccacaacgaccacactaccacgacgaccaccggacctacgacgtacggaccgttcggaaggtacgccgtaggtaacgtacgtttaagggaaccgtaaccggtaccgggtaccggttacgttaacgtttaccggttacggttacggtaccggaaggaacgggttaacgggttaaccgggggttaaacgttttaacggtttttaacggtaacccggtttaccggggtttaaccccttttacggttttaccggttaacccggttaccggggttacccgggggttaacccggtaacccgggggttaaccccggttaccgggttaacccccgg

SEQ ID NO: 197798 - DNA, 658 bp, Homo sapiens
  misc_feature: GYAE6OF02JOCNR.39.81.H04.1.454.CMB.1.raw
  modified_base (283)..(283): a, c, t, g, unknown or other
  misc_feature (283)..(283): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctccgtgcaaagcttcgtggttacctacctttaccaactagtggtacttcgaggttgggngtcgacgacggcccctaggacaagggtctgagtggagtggatggactcgagcgacttacgaagttggtaccactaacaactatggacaacgaacgtaacctcggaaggcaagacgtaccaactagacgtacacacgacacactaccaacggagaccgacgacctaacgacgtacggacgtggaacgtaccgacgtaggaactacgtcgaacgaaccggacggtaccggaccgttaacggttagtaccgtggtagaccggaagtaacgtacggttaacgggtaactttacggtttacgaaccgtttaccggttaccctttaggttccggtaacgttccggtaccggggtacccggaaccggttacccgttaccggg

SEQ ID NO: 197799 - DNA, 876 bp, Homo sapiens
  misc_feature: GYAE6OF02ITM9N.39.81.H04.1.454.CMB.1.raw
tcagtcgcactagtcacgaccggtgctcgatttagtagtgtagattcgcgggggacccaaaaaccacacccctccttgggagaatcccctagatcacagctcctcaccatggactggacctggagcattccttttcttggtggcagcaacaacaggtcgcccactcccaggttcagctggtacagtctggagctgagatgacgaagccgtggggcctcgaggtgaacggtctcgtgacaaggcttcgtcggtacctaccgttttacaactagtcgtatactaggttggtgcgacgcgcccgtaggacgtaacggtcttcgaggtggacgtgggtagtagggatcgtagcgtacttaacgtatcgggtacaaccggaactaaacgtagtacgacgtaacgtaaccgtaaccgtaccggaacgggttacgaaacggtacgtaacccaacgttaaacccgtacggtaaacccccgtagtaaacccggtaacccgaaaccgttaacccggtaacccggtaaaccgggtaacggaacccggttaaccccgggtaaacccgttaacccgtaacccgggttaccggggtaaacccgttaggggaaacccgggtacccggttaacggttaccggaacggtaccgttaccggaacgttaccccgggaaaccgtccgggtaaccgttaacgttacgtttaaaccgtggtaccggtaaacgggacggtaaccggttaccggggtaaagggtttaaaccgttgggtttaaccggtttacgggttaacccggttttaacccggtttcggtttaaccggtaccgggtttaccccggggttaaacggggggtaccccgttaaccggggggttaaccgtttaccccgggggg

SEQ ID NO: 197800 - DNA, 654 bp, Homo sapiens
  misc_feature: GYAE6OF02INGSW.39.81.H04.1.454.CMB.1.raw
tcagtcgcactagtcacgaccggtgctcgatttagtagtgtagattcgcgggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcgagtgaaggtctcctgcaaggcttctggttacaccttacaactatggtatcaggttggtgcgacacggccctaggacaagggtcttgacgtggagtgggataggactcgaggcgtacgttaacaagtcggtacaactaacaaacttagtcgacaacgaacgaaccctcgaggcagacgtacacagtcgacacgacgacactacgtaccaacgacgccaccggtacctaacagtaccggaccgtggaacggacgaccgtagaacgtctaccgcggaaccggaaccgtaccgggtaccgttaagttaccgttacgtacggtacggtacggaaggtaacggtacggttaccggggtaaatttcgttttaacggaccgtttacggtaccctttaggtttacgaccgttaccgggtcgggtaaccgtaccgggtacccttcggg

SEQ ID NO: 197801 - DNA, 651 bp, Homo sapiens
  misc_feature: GYAE6OF02FHQMM.39.81.H04.1.454.CMB.1.raw
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtcctcctgacaaggtcttctggttaccaccttttaaccaacttatggtatcgtaggttggtgcgacacggtcccctggacgaagggtcttggagtggagtgggagtggatcgagcgtcgttaacaagtggtaccaactaacaaactagtcgacgaacaacgtaacctcggaacgggacaggacgtaccacctaacgtacgaaccaaccgaacgacaacgactacccgaacggtaccgaccgaaccggcctaacgtacgcggaccgtagacggacgaccgtagacgacgtcgtacgaacggacgaccggtcttagttacgttacgtagtcgacggagtacggtagtaacgggtaatttaggtttacgaccggttacgttacccgttcgttagaccggttaccggcgggtacccgacggtacccgttcgg

SEQ ID NO: 197802 - DNA, 686 bp, Homo sapiens
  misc_feature: GYAE6OF02GLZ2F.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatctagttgggtgcgacgacggcccctggacaagggtcttggagtggagtgggatggatcagcgacttacatggtacacaacaaactagtcgactaacacgaaccctcgacgggacacggacgtacaaccgataccgaaccaacacgaacaacactaccaacgacgaccgaccggaccctaacaacgtacgggtaacccgtggaacgggacgtaccgtaggaacgtactcggtacgaacccgaaccggtaccggtccgtagttaacttacgtaggtacgtaacggagtaaggtacggttaacggggtaaacgtttaagttttacggtaccgttaacccggtttaacccttttacggtttaaccggtaaccggtttaacccgggaccgggggtaaccccggtaaccgggtaacccgttaccggg

SEQ ID NO: 197803 - DNA, 860 bp, Homo sapiens
  misc_feature: GYAE6OF02IR0WL.39.81.H04.1.454.CMB.1.raw
  modified_base (219)..(219): a, c, t, g, unknown or other
  misc_feature (219)..(219): n is a, c, g, or t
  modified_base (295)..(295): a, c, t, g, unknown or other
  misc_feature (295)..(295): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattcctttttcttggtggcagcaaacaacaggtgcccactcccaggttcagctggtacagtctggagctgagatagacgaagccgtggggcctnacgtgaacggtctcctgacaacggtcttgtacggttacctacctttaaccaatagtggttactagtaggttgggtnaccggtacaccggtccccgtagggaacggtaacgggtcgttaggacgggttaggtacgtagggggtagttagggaactccggaacggtcgtaaccccgtttaaacgtaacgttaccgggttaccaaaccgtaaaccgtaaaacttagtaccgacccgaaaccgtaacgtaaaccccgttaccggaagggtaccaacggtaaccgtaccgtaacgtaacggttaccgaaaccgaaccgtaacgaacccaaccgtaaccctaacccggaaaccggaaccgtaacccgggtaacccggacccgtaaaccgtacgggtaacccggtacccggttagggaaccgggtaaggttacccgaggtaactacggttaccgacgggtaacccgaaccggtacccgggttcgttaaagttacttaaacggtcgggtaacgaacgggtaacgaacggttaacggggtaacgggtttaaaccgtttaaggttttaaccggtacgttaccggttaaccttttcggtaccggttaacgtcccgggtacgggtacccgtaaccggggtacccttacccggg

SEQ ID NO: 197804 - DNA, 689 bp, Homo sapiens
  misc_feature: GYAE6OF02FGE1U.39.81.H04.1.454.CMB.1.raw
  modified_base (507)..(507): a, c, t, g, unknown or other
  misc_feature (507)..(507): n is a, c, g, or t
tcagtcgcactagtcacgaccggtgctcgatttagtagtgtagattcgcgggggacccaaaaaccacacccctccttgggagaatcccctagatcacagctcctcaccatggactggacctggagcatccttttctggtggcagcaacaacaggtgcccactcccaggttcagctggtacagtctggagctgagatgacgaagcctggggcctcgagtgaaggtctcctgcaaggcttctggttactacctttaccaactatggtatcaggttggtgcgacacggcccctggaaccaagggctttaggagtggtacgttggggatgggtaactcgaaggccgtacttacgaagtcggtacaacgaactaaaactgtacgactaacacgtaacctccgaagggctaacggaactaccgaacctaatcgaaccaccgaaggacctactaacgacccaacggacgacgaccgacctaacacgtcggacctggacggaacgtctaaggganacgtaccgtagaaccgcgaccggtccgtaggttacgttaccgtgtacggtacggaaacgtaggtacgggtaacgggttaaatttacggtttacgggaccttttaacccggggttaccctttaggtttaccgtaacggttacccgggttgggtaaccccggacgggtttaccgtaccccgggg

SEQ ID NO: 197805 - DNA, 644 bp, Homo sapiens
  misc_feature: GYAE6OF02JI83X.39.81.H04.1.454.CMB.1.raw
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgagcctggggcctcagtgaaggtctcctgcaaggcttcgtggttacacctttaccaactatgtatctagttggtgcgacaggcccctggacaagggcttggagtggatgggatgggatcgagcgtacgttacaagttggtccaacacaaaacgttatcgacgtaacaacgtaaccctcgaagggcaaggagtaccacgaatcgaacctacgaagaccaacactacccaaacggacgaccgacgggccctaacgagtacggacccgtaggaacgggacgtaccgtacgagacgtactacggaaccgacgacccggtacgtagttacgttacgtacggtacggacgaagtacggaggttaccggggaaatttggtttaacgtacgttcggttaccctttcgtttaacgacgttacggtcgggtacccgtacggtacccgttacggg

SEQ ID NO: 197806 - DNA, 710 bp, Homo sapiens
  misc_feature: GYAE6OF02HWDJ5.39.81.H04.1.454.CMB.1.raw
  modified_base (218)..(218): a, c, t, g, unknown or other
  misc_feature (218)..(218): n is a, c, g, or t
  modified_base (385)..(385): a, c, t, g, unknown or other
  misc_feature (385)..(385): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattcctttttcttggtggcagcaacaacaggtcgcccacctcccaggttcagctggtacagtctggagctgagatgacgaagccgtgggcctnagtgaaggtctccgtgacgaaggtcttcgtcggttactacctttaaccaactagtggtatcgtaggttgggtcgcgacgtacggcccgtaggacggaaggtctggaggtggagtgggattggactcgacgtccgactttaacgagttcggactaacaacgtaacgtntacgacaacgtaacgacctcggaggacgtaaggactacccacgaacgtacgaccgaacgtacgacctacactaccgaacggacaccgaccgcctacgacgtcggtaacgtaggacggtacgcgtaggactatacgacggaaccgaccggtacggtacccgttaggtaactttcggtacgtacgggacggtaacggtaagggttacgggtaaccgggtttaaagtttcggttttaaccggtcggttaaccgtttaacccgtttgtttaccggaccgttaaccggggtaccggggtaacccgggtaccgggtaaccggtttacccgg

SEQ ID NO: 197807 - DNA, 598 bp, Homo sapiens
  misc_feature: GYAE6OF02H0DHI.39.81.H04.1.454.CMB.1.raw
  modified_base (282)..(282): a, c, t, g, unknown or other
  misc_feature (282)..(282): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatcctttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcaacnggcccctggacaaggcttgagtggatgggatggatcgagcgcttacatcggtcacacaaactatgacacgagaacctcgagggcagactcaccatcgaccacagacacactccaacgagaccacgcctacatcggacctggacggacgccgtagagacgtctaggacggaccaccgggtccgttaggttaacttcgttggtcgcggagaaggtacggttacgggtaaattggtttttaccggaacgttcgggttaacccttcggttttacgtaccgttacggtaccgggggacccgtacggggacccttaccgggg

SEQ ID NO: 197808 - DNA, 637 bp, Homo sapiens
  misc_feature: GYAE6OF02FORMB.39.81.H04.1.454.CMB.1.raw
  modified_base (366)..(366): a, c, t, g, unknown or other
  misc_feature (366)..(366): n is a, c, g, or t
tcagtcgcactagtcacgaccggtgctcgatttagtagtgtagattcgcgggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtactcgagttgggtgcgacacggcccctggacgaagggtcttggaggtggagtggggaatggatcgaggcgtctttaacaagttggtacaacaacaaaactntgaccaacaacgaacctccgaagggcaggtacgtacaaccatcgaacccaacgagaacaccgactacccgaaacgcgaccgaaccggtccctaacgacgtacggaccgttaagggacggacgacccgttaggacgtacgtctacggacgacgaccggtccgttagtacttacgtgtgacgaaggtagacgtagggtaagttgtttagaccgttacgttacccttgtttacgtaccgttacggttccggggaccgtacgggtacccgtacgg

SEQ ID NO: 197809 - DNA, 635 bp, Homo sapiens
  misc_feature: GYAE6OF02HYRRV.39.81.H04.1.454.CMB.1.raw
  modified_base (492)..(492): a, c, t, g, unknown or other
  misc_feature (492)..(492): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatcctttttcttggtggcagcaacaacaggtgcccactcccaggttcagctggtacagtctggagctgagatgacgaagccgtgggcctcgagtgaaggtctctgcagcttcgtgtactacctttacaactagtggtactcgtaggttgggtgacgacgacggcccctaggacgtaagggcttggaggtggagtgggagtggatcgacgtcgacgttaacgaagtcggtacaacaactaactagtcgacacgaacgtacccgtagacgggacacggactaccacagtacgaccagacgaaccacgactaccgacgacgaccgaccgtacctacgaacgtcggaactaggacggacgtccgagacgntacgacgacgaccggacgtacgttagtacttacgtcggtagaccgaaggagtacggtaacgggtaatttaacggttcggaacggttccgttacttcgttaacggtaccgtcggacggggtaccgtaccgggtaccgtaccggg

SEQ ID NO: 197810 - DNA, 694 bp, Homo sapiens
  misc_feature: GYAE6OF02J3N1P.39.81.H04.1.454.CMB.1.raw
  modified_base (374)..(374): a, c, t, g, unknown or other
  misc_feature (374)..(374): n is a, c, g, or t
  modified_base (534)..(534): a, c, t, g, unknown or other
  misc_feature (534)..(534): n is a, c, g, or t
tcagtcgcactagtcacgaccggtgctcgatttagtagtgtagattcgcggggacccaaaaaccacacccctccttgggagaatcccctagatcacagctcctcaccatggactggacctggagctattccgttttcgtggtggcagcaacaacgaggtcgcccactcccgaggttcagctggtacagtcgtggacgctgagtacgtgaccgacgtccgtcgggcctacgagtcgtacgtcctacgtgacgtacgtcgttcgtacgttacctaccttacgacgtagtacgtacgtcgtacggtcgcgccgacgccgtaccgtagacgtacgtcgtaggagtcgtgagtacgtgtagcgacgtactacgtaacgngtacacctacgtactacgtgtacacgtacgacctaccgtcggacggtcaacgtacgtacctaaccgtagtaacccgacgtacgaaccgaccgaccgtaccgtaccgacgaccgtaccgtaccgtacgacgtaccgtacgtaccgacgtacgaccgtacgngaactaccgtcggtaacgacccgttagaccgttagttaaccgtacttcgggagtaccggtaaggacgtaacgttaacggttacgttacgttaccggtcgtaccgtccgtttacgtacgttacgaccggccggtaccggtcccgtaccgttccggtacccg

SEQ ID NO: 197811 - DNA, 656 bp, Homo sapiens
  misc_feature: GYAE6OF02FTE0M.39.81.H04.1.454.CMB.1.raw
tcagtcgcactagtcacgaccggtgctcgatttagtagtgtagattcgcgggggacccaaaaaaccacacccctccttgggagaatcccctagatcacagctcctcaccatggactggacctggagcatccttttctggtggcagcaacaacaggtgcccactcccaggttcagctggtacagtctggagctgagatgacgaagccgtggggcctcagtgaaggtcctcctgcaaggcttcgtggttacacctttaccaactagtggtatcgtaggttgggtgcgacgacggccccctaggacgaagggtcttgacggtggagtggggatgggatcgagtccgacttacgaattcggtacacaaccgaaactagtacgcaaccgaacggaaccctccgaaggggcaggacgtacaccgatccgaaccacgacggaacactaccgtaccgaacgtacgacccggtacgacctaactacgcgaacctagggaacggacgtccctaggaacgtacgttaccgagtaaccgaccgtacgggccgttagttacgttacgtcgtagtacgagggtacgtagtacgggtaatttggttaacgcggttaaccgtccgttagtttacgaccgttacgggtaccggcggttacggaccgtaccggg

SEQ ID NO: 197812 - DNA, 914 bp, Homo sapiens
  misc_feature: GYAE6OF02JXA82.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtgggcctcagtgaaggtctcctgacaaggtcttcgtggttaccaccgttttaccaacgttatcggtattccagttcgggtgaccgtacgaccggtcccctgggaacctaaggggccttggaagttcgggagtgggagtgggtatacggacggtccgtacctttaacgtaaagttcggggacctaaaccgtaaacccgttaaaaacgttacgttaacggaaccctaaccggtaaaaccggtaaaccccgttacccggaacgggggtcccgaaacgggtaacccgttaccgtaaaccccgtacgttaaccgggtaaacccccgttaaagaacccgtaaacccgtaaaccgtaacccgtttaaacccccggaaacgggttaacccgaaccggtaaaccccgggtacccgttaaacccgaaacggtttaacccgggtaaacccgttaaccgggaaagggtaacccggtaacccggttaggaaccggttagtaccccggttaacggaacccggaacccggtaccgggttacccgtttaaggttaaccgttttacgggccggtttacggaaccgggaagttaaccgggagggttaaccgggttaaagtttacggttttacggtaccgtttaaccggttacccgtttaccgtttacgggttacccgttacggggttccgggtaaccggttaacccgggtacccgtttaccccggg

SEQ ID NO: 197813 - DNA, 598 bp, Homo sapiens
  misc_feature: GYAE6OF02H679Q.39.81.H04.1.454.CMB.1.raw
  modified_base (445)..(445): a, c, t, g, unknown or other
  misc_feature (445)..(445): n is a, c, g, or t
  modified_base (450)..(450): a, c, t, g, unknown or other
  misc_feature (450)..(450): n is a, c, g, or t
tcagtcgcactagtcacgaccggtgctcgatttagtagtgtagattcgcgggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacacggcccctggacaagggcttggagtggatgggatgggatcgagcgcttacaatggcacacaaactatgcacagacctcgagggcagacgtcaccatcgaccacgacgacacactaccacgagccacggcctacagtcggacctaggacggacgccgtagacgntacgngaccgaccgccgggaccgtgtactttacgtcggtaggcggagtaggagttacggggtaaatttgttttacggacgtttaccgggttacccttcgtttacgtaaccgttaccgggtacgggggacccgtacggggtacccgttaccggg

SEQ ID NO: 197814 - DNA, 644 bp, Homo sapiens
  misc_feature: GYAE6OF02F13IR.39.81.H04.1.454.CMB.1.raw
  modified_base (277)..(277): a, c, t, g, unknown or other
  misc_feature (277)..(277): n is a, c, g, or t
  modified_base (314)..(314): a, c, t, g, unknown or other
  misc_feature (314)..(314): n is a, c, g, or t
  modified_base (351)..(351): a, c, t, g, unknown or other
  misc_feature (351)..(351): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtcctcgtgcaagtcttcgtgttactacctttaccaactatgtatcagttggngcgacacggccctggacgagggcttggagtgagtggntggatcgagcgactaacagtcggtacacaacaaactntcgacctaacacgtaacctccgaagggacaagaacgtacgaacctaagtcggaaaccacgaaacgacaaccacgtacccgaacgacgacccgacggacctaaccgaggtaccggacgtacggaacggcgtaccgagtacgactacgacggaaccgacgaccggtaccgttgtacgttacgtgtacgcgaagtcggaggttacggtaagtttgttacggtaacgttaccggttaccgtttacgtttcggtaccgttaccgggtagggtacccggtaccggggtaccttaccggg

SEQ ID NO: 197815 - DNA, 756 bp, Homo sapiens
  misc_feature: GYAE6OF02FK704.39.81.H04.1.454.CMB.1.raw
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtctcctgacaggtcttctggttaccacctttaccaacttagtggtactcgagttgggtgcgacgacggcccctggacgaagggtcttgagtggagttgggagtaggtatcgacggtcgtacttaacgaagtcggtaccaaccgaactaaacttactcgaccaacgacgaaccccgtaccgacgggtaccacgtacgtacccaaccgtacgtaccgaacccgacaacgaacctacaacgttccccgaaacggacgaccgtaacccggacccttaaccgacgttacgggaacccgttagggaacgggtaccggtaccgtagggtaacgtaccgttaccggtaacggacccgtaaccggtaaccgggtcccggtttaagtttaaccgttaaccgtggtaccggacgggtaaggtacggtaacggtaacggggtttaaatttacggtttacggtaaccgtttaccggtttaaccccttagtttaccggtaaccgttacgggtaccggggtacccggttacccggggtaaccccgg

SEQ ID NO: 197816 - DNA, 718 bp, Homo sapiens
  misc_feature: GYAE6OF02I0PHI.39.81.H04.1.454.CMB.1.raw
  modified_base (348)..(348): a, c, t, g, unknown or other
  misc_feature (348)..(348): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaacgccgtggggcctcaggtggaaggtctccgtgactaaggcttcgtgttaacctacctttaaccaactagtggtactcgtaggttgggtcgcgacgaccggcccgtaggaacgtagggtcttaggaggtggagtgggagtggtacncgtacgtccgtacttaacgtagttcggactaacgtaactaaactagtacgaccaacgtaacgaccctacggagggacacggtacgtacaccgtactaccgaacacgaacaacacctacgtacccgaacgacgaccgtaccgtacctaacgtacgtccggaccgtagggaaccgtacgtaccgtagacgtaccgtcgtaacgaccggtaccgtaaccgggtaccgttagttaaccgttacggtcgtacggtacgtaggacggttaacgggtacggttaaagtttcgtttaccggtaaccgttccggttaacccgtttgttaaccgtacggttaccgggacccgggtaacggtacccgggtaccgttaccgg

SEQ ID NO: 197817 - DNA, 682 bp, Homo sapiens
  misc_feature: GYAE6OF02F21NP.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacaccttttaccaactatggtatcagttgggtgcgacacggcccctggacaagggcttggagtggagtgggatggatcagcgcttacaatggtcacaacaaactatgcacagaacctccgagggcagacgtacaccatcgaccacaacgacacactacccaaccgaagccgaaccggtccctaacgtaacgtaccgggacccttaggaacgggacgtcccgtaggaacgacgttaccgtaggaacccggaaccgtaaccgggtacccgttacggttaactttaccgttgggtacggacgggtaaggaagtacgggtaaccggggtaaaattttaacgtttttacggaaccgtttaccgggtttaaccccctttgttttacggtaacccgttaccgggttacggggtaccccggtaaccggggtaaccccgttacccggg

SEQ ID NO: 197818 - DNA, 622 bp, Homo sapiens
  misc_feature: GYAE6OF02FXOSN.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttaccaccttttaccaactatggtatcagttggtgcgacaggcccctggacaagggcttggagtggatgggatggatcgagcgtacttacaatggtacacaacaaactatgacacacgaacctccgaggcagagtaccacatacgaccacacgacacactccacgacgccaccggcctacagtacggaccctagggacggacgccgtaggaagtactacgacggaacccggacgacccgggtaccgttagttaatttaccgttagtcggaccggtaagagtacggtacggggtaaatttaggttttacggaccggttacggttacccctttgtttacgaaccgttaccggtcgggggaccgtaccggggtacccgtacggg

SEQ ID NO: 197819 - DNA, 682 bp, Homo sapiens
  misc_feature: GYAE6OF02HFABK.39.81.H04.1.454.CMB.1.raw
  modified_base (254)..(254): a, c, t, g, unknown or other
  misc_feature (254)..(254): n is a, c, g, or t
  modified_base (271)..(271): a, c, t, g, unknown or other
  misc_feature (271)..(271): n is a, c, g, or t
tcagtcgcactagtcacgaccggtgctcgatttagtagtgtagattcgcgggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctctgcaggctctgtacaccttacaactntggtatctagttgggtncgacacggccctggacgaagggtcttggagtggagtgggatggatcgaggcgtcttaacaagtcggtacacgaactaaactagtcgactaacaacgaaccctccggaagggtcaaggacgtccaacgtatacggaccacgtacgacaacactacccgaacgacgccgaaccggtacctaagacgttacggacctagggacggtaactccgtagacgtactcgtacgaacgtaccggacggtccgttagttaacgttacgtggttaccgacggtacgtaaggtacgggttaacgggttaaatttacggttttacggaaccggtttacccggtttaacccgtttcggttttaccgtaacccggttacgggttcccgggggtaacccggtaacggggttacccccgttacgggg

SEQ ID NO: 197820 - DNA, 693 bp, Homo sapiens
  misc_feature: GYAE6OF02GH9BO.39.81.H04.1.454.CMB.1.raw
tcagtcgcactagtcacgaccggtgctcgatttagtagtgtagattcgcggggtgatcaggactcctcagttcaccttctcacaatgaggctccctgctcagctcctgggctgctaatgctctgggtcccaggatccagtggggatgttgtgatgactcagtctccagtcctcccgtcgcccgtcacccttggaccacgcccggtcctccactcctcctgctaggtctagtacaaacgtcctacgtatactattgatacggaaacctacctacttgtaagtttggttacagtacagtacggaccaggaccctaatccgtaccgaacggccgttaccttaagtttaacgttaacggtttccgtaaccgggtacttacggtcggggtacccaagacgtagtacgtcgacggtcggacgtagggtggacgaggacctacgttagtaacttacaccgtaactaagtaaactcgaacgacgggtaggggtacggtaggtcgtagggtacggtagtttacgggtttagggtttaacgttcgtacgtagtacgtaggaaccgaacggactacgtaccggtaccggtacccttaccgttacgttaccggttacggaaccgtacgggaaccgtagtccgagggtataaccgtaaccgtaacggtacgtcggtacgacgtaccaccgtactcgttcgttaccg

SEQ ID NO: 197821 - DNA, 656 bp, Homo sapiens
  misc_feature: GYAE6OF02HSZII.39.81.H04.1.454.CMB.1.raw
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacacggcccctggacaagggcttgagtggatgggatggatcgagcgcttacaatggtacacacaaactatgacacagacctcgagggcagacgtcacatcgaccacacgacacactccacgagcacggcctacacgtcggacctggaggacgccgtagaacgtactcgtacgaaccgtacgaccgggtccgttaggttactttacgttcggtaggaccgaagggtacgtacggttaccgggggtaaaatttcggtttttaccggaaccgtttaccgggtttaacccccgttttacggtttttaccggaacccggtttaaccgggttaccgggggggtaaccccgttaacccggggggtaacccccttttaccgggggg

SEQ ID NO: 197822 - DNA, 712 bp, Homo sapiens
  misc_feature: GYAE6OF02J2D0F.39.81.H04.1.454.CMB.1.raw
  modified_base (238)..(238): a, c, t, g, unknown or other
  misc_feature (238)..(238): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgagcctgggcctcagtgaggtctcctgcaggtcttcgngttacacctttaccaactgtgtatcgtagttggtgcgtacacggccccgtggaccgtaggcgttggagtggtagtgggatggactcgaggtcgtcttaacgagttcggacactaacgaactagtcacgacaacgaaccctacgacgggacacgtacgtacgaccaagtcgaacccgactaacggaccctaacgtactcccggaacgaacgtaccgacccggttaccaacgtacggtaaccggtaccgtagggaaacggccgtacgtacgggtaaggtacctacgggttacgaaaccggaccggtaacccgggaccggtttactttaaccgttacggtacggttaccggagtaaacgggtacgtaacgggtaagggtttaaaacttggtttttaaccgcggttaaccggtttacccttcgtttaacggacccgttacggggtaccgggtaacccgtacgggtaacccgttccggg

SEQ ID NO: 197823 - DNA, 717 bp, Homo sapiens
  misc_feature: GYAE6OF02GJGKV.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtcctcctgcaaggtcttctggttacacctttaccaactatggtatcagttggtgcgacgacggcccctggacagggtcttggagtggagtgggatggatcgaggtccgtacttaacgaagttcggtaccaaccgaactaaaacttactacggaccaacgaaccggtaaacccgtccggaacggggctaacggacgtaccaacccgataccggaacccaacgaacgacctaacactacccgaacgacgaccgaccggacctaacgagtacggaccaggacggcgaccgtaggacgtacgtaccgtacggaaccgacccggaccggtaccgttacggttaacgttaccggttgtacggaacggtaacgggacggttaacgggtaacggggttaaaattttcggtttaacggtaccgtttaccggttaacccgtttcgtttaacggtaaccggttccggggttacggggaacccgtacccggggtacccttaccggg

SEQ ID NO: 197824 - DNA, 672 bp, Homo sapiens
  misc_feature: GYAE6OF02HWKXF.39.81.H04.1.454.CMB.1.raw
  modified_base (261)..(261): a, c, t, g, unknown or other
  misc_feature (261)..(261): n is a, c, g, or t
  modified_base (303)..(303): a, c, t, g, unknown or other
  misc_feature (303)..(303): n is a, c, g, or t
  modified_base (321)..(321): a, c, t, g, unknown or other
  misc_feature (321)..(321): n is a, c, g, or t
  modified_base (570)..(570): a, c, t, g, unknown or other
  misc_feature (570)..(570): n is a, c, g, or t
tcagtcgcactagtcacgaccggtgctcgatttagtagtgtagattcgcgggggacccaaaaaaccacaccccctccttgggagaatcccctagatcacagctcctcaccatggactggacctggagcatcctttttcttggtggcagcaacaacaggtgcccactcccaggttcagctggtacagtctggagctgagatgacgaagcctggggcctcagtgaaggtctcctgcaggcttctggttactacttgccaactntggtatcagttggtgcgacaggcccctggacaagggcttggngtggagtgggagtggatnacgcgtacttacaatggtacacgaactaaacgttatacgacaaccgaacgtaacccgtaccgaacgggactaacggaacgttaccaacccgtaagttaccggaacccaacgaaacgaaccaaccaacgtaccccgacgacgaccgaccggacctaacgtacgtcggaacccgttaggaacgggacgtccgtacggtagaccgttcgtacggtaacccgacgacccgggtccgttacgtacgtttaccgnggtacggcgaaggacggtaggtacgggtaagtttagtttacgtacgttacggttaccttcgttacgtaccttacgggtcgggtaccggtacgggtaacccgg

SEQ ID NO: 197825 - DNA, 683 bp, Homo sapiens
  misc_feature: GYAE6OF02G421C.39.81.H04.1.454.CMB.1.raw
  modified_base (318)..(318): a, c, t, g, unknown or other
  misc_feature (318)..(318): n is a, c, g, or t
  modified_base (320)..(320): a, c, t, g, unknown or other
  misc_feature (320)..(320): n is a, c, g, or t
  modified_base (360)..(360): a, c, t, g, unknown or other
  misc_feature (360)..(360): n is a, c, g, or t
  modified_base (549)..(549): a, c, t, g, unknown or other
  misc_feature (549)..(549): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtctcctgcaaggcttctggttacacctttaaccaactatggtatcgtagttgggtgcgacgacggccctggacaagggcttgagtggagtggngnggatcgagcgtctacgaagtcggtacaacgaataaacgtntacggacaacgagaaaccctcgaacgggtacaaggacggtacaacctacgtacggaaccacgaagtaaccacgaactacccgaacgacggacaccgggtacctaagacgtacggtaacgtaggacggtacgtaccgtaggaagtactcgtacggaaccggtaaccgacgggtcccgttagtaacgtttntacgggtcgacgtagaacggtaggtaacggggtaaatttacgtttacggaaccgtttaccggttacccgttttcgttacggttaaccggttaccgggtacgggggacccgtaacggggttaccccggttacggg

SEQ ID NO: 197826 - DNA, 635 bp, Homo sapiens
  misc_feature: GYAE6OF02G3T5H.39.81.H04.1.454.CMB.1.raw
  modified_base (150)..(150): a, c, t, g, unknown or other
  misc_feature (150)..(150): n is a, c, g, or t
  modified_base (283)..(283): a, c, t, g, unknown or other
  misc_feature (283)..(283): n is a, c, g, or t
tcagtcgcactagtcacgaccggtgctcgatttagtagtgtagattcgcgggggacccaaaaaaccacacccctccttgggagaatcccctagatcacagctcctcaccatggactggacctggagcatccttttcttggtggcagcaanaacaggtgcccactcccaggttcagctggtacagtctggagctgagatgacgaagcctggggcctcagtgaaggtctcctgcaaggcttctggttacacctttaccaactatggtatctagttggtgccgacncggcccctggacgaagggtccttgagtggagtgggatggatcgaggcgctttaacgattggtaccactaaccaaacgtatgaccaacaacgaaccctccgaggggacacgagtaccaaccgtataccggaccaacgacgaccaacctactacccaacggacgtcccgaccggaccctaacgacgtcggacctaggaggtacgaccgtgacgtactacgttggacccgaacgccggtaccggtaggttattacgtagtgacgacgtagtaggacgggttaattgtttaggaccgttacggttacccttgtttacgaccttacggcggggtaccgtacgggtacccgttacggg

SEQ ID NO: 197827 - DNA, 724 bp, Homo sapiens
  misc_feature: GYAE6OF02FWBUY.39.81.H04.1.454.CMB.1.raw
  modified_base (157)..(157): a, c, t, g, unknown or other
  misc_feature (157)..(157): n is a, c, g, or t
  modified_base (364)..(364): a, c, t, g, unknown or other
  misc_feature (364)..(364): n is a, c, g, or t
  modified_base (375)..(375): a, c, t, g, unknown or other
  misc_feature (375)..(375): n is a, c, g, or t
  modified_base (466)..(466): a, c, t, g, unknown or other
  misc_feature (466)..(466): n is a, c, g, or t
tcagtcgcactagtcacgaccggtgctcgatttagtagtgtagattcgcgggggacccaaaaaccacacccctccttgggagaatcccctagatcacagctcctcaccatggactggacctggagcatccttttcttggtggcagcaacaacaggtncccactcccaggttcagctggtacagtcgtggagctgagatgacgaagccgtgggcctcagtgagtctctgcaggtcttcgtaggttactaccttacaacgtatcgtatgtaggttggtcgcgtacgcggtcccgtaggaacgagggtctaggaggtggtagtgggagtggtagtcgagcgtactaacagtgtacactacaactgtnactacacgacncggaggcagacgtcacgactacgaccacgacgactacgactaccgacggcgacgaccggcctaacgtacgaccggacggtggaacggtacnccggttagaacgttccgtacggtaccggaccggtaaccggtacccggggtccgttaagggttacttacccgggttagggtaaccgggtaacggtaacgggtacggtaaccggggttaacggggtaaacttttttcggttaaccgggtacggttttaccccgggttaaaccccttttgggttttaacccgggtaaccggttaaccggggggttacccggggtaaccccggttaacccgggggtaacccttttcccgggg

SEQ ID NO: 197828 - DNA, 737 bp, Homo sapiens
  misc_feature: GYAE6OF02GZXWS.39.81.H04.1.454.CMB.1.raw
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtgggcctcagtgaaggtctctgcagctctggttacacctttaccaactatgtatcagttgggtgcgacacggcccctggacgaagggtcttaggagtggatgggatggatcgagcgtcttacgaaagttcggtacaactaacaaaacttatcggacaacgaacgtaacccgtaccggaacgggtaccaaacggtaacggtaccaacccgtaacttaccgggaaaccctaaaccgaacggaaaccctaaccgaaacgttaccccgaaacggtaacggaacccgaaccgggacctaaacgacgtacgggtaccctaggaacgggtaccgccgttagggaacgtacgtaccgtgaacccggaacgaacccgggtccggttacgttaacgtttacgtgggttacgacggtaaggacgtaacggtaacggggttaaatttacggttttacgtacggttaaccggttacccttttaggtttaccggttaacgtaccggttaccgggggtaacccggtacggggtaacccgttacgg

SEQ ID NO: 197829 - DNA, 803 bp, Homo sapiens
  misc_feature: GYAE6OF02FYCFM.39.81.H04.1.454.CMB.1.raw
  modified_base (155)..(155): a, c, t, g, unknown or other
  misc_feature (155)..(155): n is a, c, g, or t
  modified_base (189)..(189): a, c, t, g, unknown or other
  misc_feature (189)..(189): n is a, c, g, or t
  modified_base (202)..(202): a, c, t, g, unknown or other
  misc_feature (202)..(202): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttctggtggcagcaacaacaggtncccactcccaggttcagctagtacagtctagganctgagatgacganccgtagggtcctacgagtaggaacggtccttcctagacgtaagtcctttacgtacggttacctaaccttttaacgaacgttagtacggttaactcggtaaggtttcgggtacgtaccgaacggtaccgtaccccgtagggaacgtaacgggtccgttaggtaacggttaggtaacggtgggtaacgtcgggttaacacgtaaccggtcggtaacttaaccaaggttaccggtaccaaaccgtaaactaaacgttacgtacggacctaaaacggtaccgtaaccgtacggaaccgggtacaaacggttacgtacccctaaacgtaacgttaaccgggaaaccctaccgaacgaacccttaaacgaaccctaacgggacgtaaccgacccgtaaccggtacctaacggtacggtacgtaacccgtagggacgtaccgtacgtaacgagtaccgtcgaacggacgtaaccgttcggaccttagttacgttagtagtaccgaaggtaacgtaggtacggtacgttaaagtttcgtaccggaccgtttaccggttaacttggttacggaacctttacgggacggtaaccccgtacggtccgtaccg

SEQ ID NO: 197830 - DNA, 731 bp, Homo sapiens
  misc_feature: GYAE6OF02JO8OT.39.81.H04.1.454.CMB.1.raw
  modified_base (195)..(195): a, c, t, g, unknown or other
  misc_feature (195)..(195): n is a, c, g, or t
  modified_base (202)..(202): a, c, t, g, unknown or other
  misc_feature (202)..(202): n is a, c, g, or t
  modified_base (259)..(259): a, c, t, g, unknown or other
  misc_feature (259)..(259): n is a, c, g, or t
tcagtcgcactagtcacgaccggtgctcgatttagtagtgtagattcgcggggacccaaaaccacacccctccttgggagaatccctagatcacagctcctcaccatggactggacctggagcatccttttcttggtggcagcaacaacaggtgcccactcccaggttccagcctggacagtctggagctgagtngacgacnccggtggcctcgatggagtcctctgacgagtcttgtagtacctaccttacaacgttntggttactcgtacggttggtcggtacgacgaccggtcccgcgggaacgacggtcgtacggaggttggaaggtcggggaattggagtcgtgaactcggacttacgaatacggtactaacgtaacaacgtactaggtaccaacctacgaacccgtccgaagggtcaacggacgtaacgaccgaacgtaccgaaccgaacgtacgacctaacgacgtaccccgaacggtaacggcccgaaccgggtacctaaccgaccgtacggacccgttaggaccggtacgacccgtagtacgacgttacggaccgaaccggtaccgtaccggtcccggttaagtaccgttacgtacggtacggacgtacgggaacggtaacggttacggggttaaactttccgggtttacgtaaccgtttacgggtacccgttcgttaacggtaccgttaccggtaccggggtacctacgggttaaccccgg

SEQ ID NO: 197831 - DNA, 619 bp, Homo sapiens
  misc_feature: GYAE6OF02FXD74.39.81.H04.1.454.CMB.1.raw
  modified_base (350)..(350): a, c, t, g, unknown or other
  misc_feature (350)..(350): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttacactatggtatcagttggtgcgacacggcccctggacaagggtcttgagtggagtggggatggatcgaggcgtacttacaagtggtccacacaaactntcgacacacgaacctcgagggcagagtcaccatcgacccacgaacgacacatacccacgacgacgaccggacctacagtacggacctaggacggacgaccgttagacgattacgacggtaacgaccgacgggccgttagtaacttacgtggtacgacggtaagcggtaaggttacggggtaaattttcgtttacggtaccgttaccggttaacccctttgtttacgtaccgttacggtcggggtaccccgaggggtaaccccgttcggg

SEQ ID NO: 197832 - DNA, 570 bp, Homo sapiens
  misc_feature: GYAE6OF02GY3S5.39.81.H04.1.454.CMB.1.raw
  modified_base (374)..(374): a, c, t, g, unknown or other
  misc_feature (374)..(374): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagccggtacagtctggagctgagatgacgaagcctggggcctcagtgaaggtctcctgcaaggcttctggttacacctttaccaactatggtatcagttggtgcgacaggcccctggacaagggcttgagtggatgggatggatcagcgcttacaatggcacacaaactatgacacagaacctcgaggcagacgtcaacagtnaccacacgtacacactccacgagcacggctacgataggactagagacgcctagacgatcgtagacgacacggcgtagtaacttacgtgtcgtagagtagacgtacggggtaaaattaggtttcgtaacgttacgggtaacccttacgtttacgaacgttacggttccgggaccgtaacgggtacccgtggtacccg

SEQ ID NO: 197833 - DNA, 666 bp, Homo sapiens
  misc_feature: GYAE6OF02IM1RM.39.81.H04.1.454.CMB.1.raw
  modified_base (290)..(290): a, c, t, g, unknown or other
  misc_feature (290)..(290): n is a, c, g, or t
  modified_base (379)..(379): a, c, t, g, unknown or other
  misc_feature (379)..(379): n is a, c, g, or t
  modified_base (424)..(424): a, c, t, g, unknown or other
  misc_feature (424)..(424): n is a, c, g, or t
tcagtcgcactagtcacgaccggtgctcgatttagtagtgtagattcgcgggggacccaaaaaccacacccctccttgggagaatcccctagatcacagctcctcaccatggactggacctggagcatccttttcttggtggctagcaacaacaggtgcccactcccaggttcagctggtacagtctggagctgagatggacgaagcctggggcctcagtgaaggtcctccgtgcgaacggtcttctaggttacctacctttaccaacttatggtactcgtaggttgggngtcgacgacggtccccgtaggacgaagggtcttggagtggagtggggatggactcgagcgtacttaacgagtggtacactaactaactncgacacgaacgaaccctcgaggacacgagtaccacagtcgaaccncgaacgaccacacgtaccaacgacgaccgaccggtacctaacgacgtaccgggacctagggacgacgaccttagacgtagttccgacgaccgaaccggaccggttacgttacggttaactttccgtaggtacgtacggagtagtacggtaacgggttaacttaggttttacgaccgttaccggttacccttacggttacgtaccgttaccggttcgggacccggtaacggtacccgttacgg

SEQ ID NO: 197834 - DNA, 785 bp, Homo sapiens
  misc_feature: GYAE6OF02HF9MO.39.81.H04.1.454.CMB.1.raw
  modified_base (696)..(696): a, c, t, g, unknown or other
  misc_feature (696)..(696): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctggagatggacgaacgccgtggggcctcgaggtgaacggttctccgttacgaacggtctttccgtagggtttacctaacccgttttaccaaacttacgtcggttataccgtaggtttcgggtgaccgtaaccgacggtcccccgtagggtaaccggaacgggtcgtttaggaacggttacgggtagttacgggggtacgtagggtaacgtaccgaacggtaccggttacctttaaacgtaaggtttacgggtacccaaaccgttaaccaaaaccgttagttaccgaccgaaaccgtaaccggtaaaccccgttaccggaacggggtaccgaaacggtacgtacccgaaacccgtacgtaccggaaacccaccgaacgacctaaccgtacctacccgaaccggaacggccccgtaccggtaaccctaacgacgttacggtaccgtagggtaccgaccggtcctaggacgtctacgtacgacgtaccgaccggtcgttagttacgtntggacaggagtacgagtacggtattacgttcgtacgttacgttacccgttgtagtaccttcgggcgaccgtacggtaccgtcgtacccg

SEQ ID NO: 197835 - DNA, 632 bp, Homo sapiens
  misc_feature: GYAE6OF02GTG5N.39.81.H04.1.454.CMB.1.raw
tcagtcgcactagtcacgaccggtgctcgatttagtagtgtagattcgcgggggacccaaaaaaccacacccctccttgggagaatcccctagatcacagctcctcaccatggactggacctggagcatccttttcttggtggcagcaacaacaggtgcccactcccaggttcagctggtacagtctggagctgagatggacgaagcctggggcctcagtgaaggtctctgcaaggcttctggttacacctttaccaatatggtatcagttgggtgcgacaggcccctggacaagggcttaggagtggagtgggattggatcgaggcgacttacaagttggtaccaacaacaaactatgacaacacgaacctacgagggccagacgtacacatcgaaccacacgacacataccaacgacgacgaaccgcctaacgactcgggacctaggaacggactaccgtagaacgatacaggaaccgacgaccgggtccgttaggttaaccgtttaccgtggttacggacgtaaggagttacggtaacggggtaaatttaggttttcgaacgttcggttaacccctttagtttacgaccgttaccggtacggggacccgtaacgggtacccgttacggg

SEQ ID NO: 197836 - DNA, 694 bp, Homo sapiens
  misc_feature: GYAE6OF02JUZRZ.39.81.H04.1.454.CMB.1.raw
  modified_base (236)..(236): a, c, t, g, unknown or other
  misc_feature (236)..(236): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctctgcaaggctntggtacaccttaccatatgtatcagttgggtcgcgacacggcccctggacaagggtcttggagtggagtgggactggatcgagtcgtcttaacaagtcggtacacgaactaactatacgcaacgacgaaccttaccgagggactaacgacgtacgaaccgtactacggaacccaacgacgtaaccactaactaccggaacgacggaccgaaccggtacctaacgacggtaccgggacctaagggacggacgtaccgtaggaacgtaccgtacgtacggaaccggaaccggaccgggtaaccgttaggttaacctttacgacgggttcggaaacggtcgggtaaacgtacgggtaagggttaaacctttaaggtttaccggtacgttaccggggttacccttaggtttacggtaccgttacgggtcggggaacccgggttaggtaccccggttaccggg

SEQ ID NO: 197837 - DNA, 700 bp, Homo sapiens
  misc_feature: GYAE6OF02IH9F3.39.81.H04.1.454.CMB.1.raw
tcagtcgcactagtcacgaccggtgctcgatttagtagtgtagattcgcgggggacccaaaaaaccacacccctccttgggagaatcccctagatcacagctcctcaccatggactggacctggagcattccttttcttggtggcagcaacaacaggtgcccactcccaggttcagttggtacagtctggagctgagatgacgaagccgtggggcctcagtgaaggtctcctgcaaggtcttctggttaccacctttaccaactatggtatcgtaggttgggtgcgacgcggcccctggacaagggcttagagtggagtgggatggatcgagtcgtacttacgaagtcggtacactaacaaactgtcgacacgacgaacctcgaaggcgagacgtaccacgtaacgtcgaaccacgaagaccaacactccgaacgacgacgaccgacctaacgagtaccggaccgtaggacggtaccgcgtaggacgtcgtacgacggtaccgaaccgtacgggttccgttaggttaacgttaccggttggtaacgggacgggtaacggaacggttaacggggtaacggggttaatttttacgggtttaacggtaaccggtttaccggttaacccgtttggtttaacggtccggttaacggttcccggggtaacccggtaccgggttaacccggttccggttaaccccgg

SEQ ID NO: 197838 - DNA, 795 bp, Homo sapiens
  misc_feature: GYAE6OF02GC6ZJ.39.81.H04.1.454.CMB.1.raw
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcaggtgaaggtctcctgcaaggtcttcgtggttacctacctttaccaaacgttagtggtatcgtaggttgggtgcgacgcggtcccctggacgaaggcttggagtggagtgggatggactcgaggaccgtacttaacgaagttcggtacaaactaactaaaacttgagaccgaacacgtaaccctaccggaacgggacaagtacgtaccaaccgtagtaaccgacccaacgtaacgaacccaacgtaaccgtacccgaacgaccggacccgaacccggtccgttaacgaacgtacccggtaccgtaacgggaacgggtaccgtaccgtaggtaacgtacgttacggtaaccggaacccgggtaccggtaacccggggttcccggtttaagtttaaccggtttacgttagggttcggaaccggtagtaaggggtacggtttaaccgggggtaaacttttaacggtttaccgggttaaacggttccgggttttaaccccgtttcgttttacccggttaacccggtttaccggggttaccgggggtaaccccggtaaccgggggttacccccgtttaccgggg

SEQ ID NO: 197839 - DNA, 735 bp, Homo sapiens
  misc_feature: GYAE6OF02HP79M.39.81.H04.1.454.CMB.1.raw
tcagtcgcactagtcacgaccggtgctcgatttagtagtgtagattcgcgggacccaaaaaccacacccctccttgggagaatcccctagatcacagctcctcaccatggactggacctggagcattccttttcttggtggcagcaacaacaggtgcccactccaggttcagctggtacattctggagctgagatagacgaagccgtggggcctcgagtaggaaggtctctgcaaggtcttctggttacctaccgtttaacaatactggttactcgtacggtttggggtcgaccggacgaacgggtcccccgtagggaaccggtaaggggtccttaggagggttagggaagtggggattagggactacggacgtcggtactttaacgtaaggtcggtaaccacgaacgtaaaacttagcgaccgtaaacaaccgttaaacccgtcgaacggggtacaaggtaacggtacccaacgtagtaccgaaaccacgaaacggacctaactacgtacccgaacgggaccgaccggacggtaacccacggtacgtaccggtacgtacgggtaacgaacgtcctaggaacgtcgttaccgaggacccgggtaacaccgggtcgttacttaacgttagtcggtacggaacgtagaggtacgggttaacggtaagtttaagttcggaattccgggtacctttagttacgtaccggtacggaccgggtacgccgggtaaccgtcgg

SEQ ID NO: 197840 - DNA, 657 bp, Homo sapiens
  misc_feature: GYAE6OF02HE82P.39.81.H04.1.454.CMB.1.raw
  modified_base (286)..(286): a, c, t, g, unknown or other
  misc_feature (286)..(286): n is a, c, g, or t
  modified_base (429)..(429): a, c, t, g, unknown or other
  misc_feature (429)..(429): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatcctttttcttggtggcagcaaacaacaggtgcccacctcccaggttcagctggtacagtctggagctgagatgacgaagccgtggggcctcagtgaaggtctcctgcgaaggcttgtggttacctacctttaccgaactagtggtatcgtaggttgggngacgacacggcccctaggaacgaagggcgtagacggttggacgtagggatggtatcgagcgtacttaacgaagtcggactaaccaacgtaaatacgtcgaccaacgtaacgaaccgtacggacgggataacgacgtacaaccngtacgaaccagaacgacacacgtaccaaccggacgtacaccgggtaccaacgtacgtaccggaaccgtaggacgtacgacctagacgtactacgacgaccgacgcggtacgtagttactcgtaggtcaacgaggagtacggtaacggtaaattcgtttaggaccgttacggtacccgtttgttaccggtactacgggttccggggaccgtaaccgggacccttaccgg

SEQ ID NO: 197841 - DNA, 732 bp, Homo sapiens
  misc_feature: GYAE6OF02GVHRK.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttaccacctttaccaactatgtatcaggttggtgcgacaggcccctggacaagggcttgagtggagtggatggatcgagcgtacttacaagtcggtaccacaactaaactagtacgacaacgaacggaaccctaccggacgggacacggtacgtaccaccatacgacccacacgtaccacgtactaccgaacggagtaccgaccggcctaacacggtacggtaacccgtggtaacggacgtaccgtagacgtaactcgtacggaaccgtaccggaccggtccggttacgttaacgtttaccggtagaccggtaacgggaacggtaaggtaaccgggttaacggggttaaaacttttacggtttttaccgggtaaacccgggtttaccggtttaaccccccgttttaaggttttacccgggaacccgtttttaaccgggggaccgggggtacccccggttaacgggggttaacccccggtttaccccgggg

SEQ ID NO: 197842 - DNA, 707 bp, Homo sapiens
  misc_feature: GYAE6OF02GZ8QU.39.81.H04.1.454.CMB.1.raw
  modified_base (354)..(354): a, c, t, g, unknown or other
  misc_feature (354)..(354): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaacgccgtggggcctcagtggaacggtccttcctgacgaggtcttcgtggttacctacctttaacctaactagttaggtatcgtggttggtgcgacgacgtcccgtaggacgaagggtctgaggtggagtgggtataggatcgagcgtacttanaacgtggtacaactaacgtaaacgtatacgactaacgaacgtaacccgtacgaacgggacgaaggtacgtaccgaacgtacgtaccgaaccacaacgaactaacgaacccgtaccggaacgacggtacccgaacggacctaacgcgtaccggacgtaacgggacgtacgtccgaaggtagtactccggacggaacccgtaaccggtaccggtaccgttaggtttaactacgttaggcggagtaacgggacggttacggtaacgggttaattttcgttacggtaccgttacggttacccgtttagttacgaccgttacgggaccgggtacccgtacggggttacccttaccggg

SEQ ID NO: 197843 - DNA, 609 bp, Homo sapiens
  misc_feature: GYAE6OF02FL9GM.39.81.H04.1.454.CMB.1.raw
  modified_base (353)..(353): a, c, t, g, unknown or other
  misc_feature (353)..(353): n is a, c, g, or t
  modified_base (471)..(471): a, c, t, g, unknown or other
  misc_feature (471)..(471): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggccctcagtgaaggtctcctgcaaggcttctggttacaccttttaccaactatggtatcagttgggtgcgacaggcccctggacaagggcttggagtggagtggagtggatcagtgcttaacaagtggtcacaactaaactangcaacagaacctccgagggcagacgtcaaccatacgaacccaacacgacaacactcccgacgacgcgaccggcctacagtcgggaaccctgggaaggacgccgtaggacgtataccgnggtaaccgaaccgaccggtccgttagttaacttacgtggttgacggagagtacgtaggggtaaatttagtttggaccgttcggttacccgtttgtttacgaccgttaccggttcgggacccgttagggacccttcggg

SEQ ID NO: 197844 - DNA, 729 bp, Homo sapiens
  misc_feature: GYAE6OF02GI7WJ.39.81.H04.1.454.CMB.1.raw
  modified_base (395)..(395): a, c, t, g, unknown or other
  misc_feature (395)..(395): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtggaaggtctccgtgcgaaggtcttcgttggttaacctaccttttaaccaacttagttggtattcgtaggtttggggtgccgacgtaccggccccgtggaacgagggtcgttagaggtaggagtggggtataggactacgacgcgtacttagaactcggtacaacgaaccaaacctntgaccaagaaccgaaccctcgaagggtacaacggtactacccgaacgtacgtaacgaaccaacgacgaacctaacgtaccctacccaacggacgacgtaacccgtacctaacgtacgtaccgggaaccgtacggaacggaccgtacgacgtaacgtactacggtaccggaaccgtaccggtaccgggtacccgttagttaactttacggcgttggaaccgtaaggtaggtaccgggttaggtaaacttttggtttacgaccgtttaccggtaccgttttccgttacgtacccggttaagggtcccggtaccggtaccggttaccgttacccggg

SEQ ID NO: 197845 - DNA, 676 bp, Homo sapiens
  misc_feature: GYAE6OF02J1OVV.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcaggtgaaggtctcctgcaaggtcttctggttacaccgtttacaacttatggtatcagttggtgcgacaggccctggaacaggtcttagcgtaggacgtggatggatcgagtcgtacttagaacttggtacactaacaaacttagacgacgaactacgaaccgtaccgagggacaaggacgtaccaacgtactacggaaacccataacgacaaccgtaacgtcccgaacggacaccggaccggaccttacgacgtggaaccctaggacggtactccgaaggacgaattccggagtaaccgaccgtaccgggtacccggttacgtacgttttacgcgttacggagtaacggaacgtacggttaacgggtaaacgtttacgttcggtaaaccgttcggttaccttaccggttttacgtaaccggttacggtacggggtaccgaacccgggttacccgttaccggg

SEQ ID NO: 197846 - DNA, 790 bp, Homo sapiens
  misc_feature: GYAE6OF02GORFG.39.81.H04.1.454.CMB.1.raw
tcagtcgcactagtcacgaccggtgctcgatttagtagtgtagattcgcggggtgatcaggactcctcagttcaccttctcacaatgaggctccctgctcagctcctgggctgctaatgctctgggtcccaggatccagtggggatgttgtgatgactcagtctccagtctccctgacccgtcacccttggaccaggccggcctccagtcctcctgcaggtctagtacaaacgcctcgtatactagttcgagtacggaaacctaccgttatttagaaactttggtttaccaagcgaggaacggcccgacggaccctaaattcccgtacccgtaaacgggtcctaaccctttaaagtttaacgttaaccggttttaccgtaaacccggggtacttccggttaaccggggtccccaagacgtacgtaattcgaacggcggtacaggtcgggtacacggactacgttagtaaaccttcaaccctagtaaagtaaaactacgtaacggacggtaacggggttacggaacgggtccggtagggtaacgggttacggtttaggggttttaagggggttttaacgtttaacggttcggttaaccgtagtaacggtaacgtaaacgggtaaacctaaccggtaaccggttcggtacccggttacccgttaaccgttacgggtttttacccggaaccggtaccgggtacccggtacgtacgggtaacggtaacggtaacggtaaccgtaacgtaacgtacggtacggtacgtacgtacctaacgtaccgttacgttccg

SEQ ID NO: 197847 - DNA, 740 bp, Homo sapiens
  misc_feature: GYAE6OF02HYFPO.39.81.H04.1.454.CMB.1.raw
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcaggtagaaggttctcctgcaaggtcttcgttggttaacctacctttaccaactagtggtatcgtagttgggtcgccgtacgacggtccccctgggaacgaaggggtccttaggaggtgggagtggggagtcgggataccgagcgtactttaacgaagtcgggtcaaccgaactaaacttatgaccaaccgaagtaaccctccggagggacgaagtacgtaccgaaccacgtacgacccgaacgacgaacctaacaacctaccgaaccgacgtaccgaccggtaacctacgtaacgtaccggaccgtacggaacggaccggtcctacggaagtccgtacgtacggaacccggtaacgaccgggtaaccgttcgttaacgttacgttggtacggaggtacgacggttagggtaacgggttaaacgtttcggttttaaccggtaccggttaccggtttacccttacggtttaccgttaccggttaccgggttacgggaacccggtaccggggttacccgttaccggg

SEQ ID NO: 197848 - DNA, 862 bp, Homo sapiens
  misc_feature: GYAE6OF02JTU7F.39.81.H04.1.454.CMB.1.raw
  modified_base (193)..(193): a, c, t, g, unknown or other
  misc_feature (193)..(193): n is a, c, g, or t
  modified_base (224)..(224): a, c, t, g, unknown or other
  misc_feature (224)..(224): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagtcctggtacacgtcgtggancgtagagatagacgaacgccgtcgggcctanaggtagagtctccgtgacgtaaggcttacgttcggtaaccttacccgttaaccaacttacgtaggttaatcgtaaggttgggtcggcaccgtacggtcccccgtaggtaacggaacgggtccgttaggtaacggttggtaaggttaggggacgttagggtaacgttaccgacggtacccgtaacgtttaaccgtaacgttacggtaacccgttaaaccggaaacttaaaacgtaccgttaccggaactaaaccggacccgtaaaacccgtaccggacgggtaaccgtaacggacgttaaccgaccaacggtaccgaccgaacgaacgtaacgacaccgttacccaacggtaacccgcgtaaacccgggactaaacgtaccgtaccgggtacgaacgggtacgaccggtaccgacgtacgtactaccggtcgtaaacccgtaccgacccggtaccgtttacggttaaaccttcggttaacgggtaacgttcgggaaaccgttaggtaaccgggttaacgggttagttaaacggtttttaccggaaaccgtttacccgtaaccccgtttggttaaccggtaccccggttaaccgggttaccggggtaacccggttacccgggtaaccgtttaacccgggg

SEQ ID NO: 197849 - DNA, 775 bp, Homo sapiens
  misc_feature: GYAE6OF02FKGPD.39.81.H04.1.454.CMB.1.raw
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcgagtcgaaggtcctcctgcaaggcttctggttacacctttacaactatgtactcaggttgggtgcgacacggcccctggacgaaggcttgaggtggagtgggatggatcgaggcgtacttacgaacttcggacacgaactaaactagtacgacaacgaacgaacctaccgaacgggactacggaactaccgaacctagtacgaacccagaacgaccactaacgtaccgaacggacgaccgacgtaccgtaaccgtaacggtcggtaacccgtgggaaccggtacgtcccgtaaggtaacgtactaccggtacggtaaaccggaccggtaacccgggttccgtttaacggtttaacggttttaccgtaccgggtacggtaacggggaacgggtaaaggtttaaccgggggtaacggggtttaaaagttttcgggttttaaccggttaaaccggggttttcccggtttaaaccccgttttcggttttacggttaaacccgggtttacccggggtacgggggttaaccccggtaacccggggggtttaaccccgttcccgggg

SEQ ID NO: 197850 - DNA, 929 bp, Homo sapiens
  misc_feature: GYAE6OF02ISDXB.39.81.H04.1.454.CMB.1.raw
  modified_base (576)..(576): a, c, t, g, unknown or other
  misc_feature (576)..(576): n is a, c, g, or t
tcagtcgcactagtcacgaccggtgctcgattttagtagtgtagattcgcgggggacccaaaaaaccacacccctccttgggagaatcccctagatcacagctcctcaccatggactggactggagcatccttttcttggtggcagcaacaacaggtgcccactcccaggttcagtctcggtacagtctggagctagagatgacgaagccgtaggggcccttacgaggtagaacggtcgttacccgtgaccgtaaagggtcctttaccgttacggtttaacctaaccccttttaaaccgaaaccgttagtacgggttaacttaccggtagggtttacggggttcgtaccggaaaccgcccgggtacccccgtaggggtaacccgaaaggggttccttaacgggaggttacgggaggttgggggagttacgggaacgttcgaacgggccgttaacgttaccaaaggttccggtacaaacgtaacaaaacctttagcgtacgaaacaaccggttaaccctaccgggagggaacgtacgtaacgtacccgaacgaaactcccggaaaccaacgggaaanaccctaacctaaccgaaccccgaaacgggacgaaccgtaacccggtaccgtaaccgtaacgttacccgggaacgttcgggaaacggtacccttcggtaacggtaacggttaactaccgtaagggaacccggtaacgtaacccgggtacgtttacgggtttaaccttacggtttcggtaaccgggtaacgggtaacgaaggggttacgggttaaaacggggttaaagtttaacggtttttaccggaaacgggtttaccggtttttaaaccccggtttgtttaaccgttaacgggttttaaccccgggacgggggttaaccccggggttaaccggggaccccggtttaaccgggg

SEQ ID NO: 197851 - DNA, 679 bp, Homo sapiens
  misc_feature: GYAE6OF02I1BXO.39.81.H04.1.454.CMB.1.raw
  modified_base (217)..(217): a, c, t, g, unknown or other
  misc_feature (217)..(217): n is a, c, g, or t
tcagtcgcactagtcacgaccggtgctcgatttagtagtgtagattcgcgggacccaaaaaaccacacccctccttgggagaatcccctagatcacagctcctcaccatggactggacctggagcatcctttttcttggtggcagcaaacaacaggtgcccactcccaggttcagctggtacagtctggagctgagatgacgaagccgtggggcctnagtgaaggtctcctgcaaggtcttctggttacaccttacaactatggtatcaggttggtgcgtacgacggcccctggacgaagggtcttggagtggagtggggagtggatcgagcgtacttagaagtcggtacaccaataaacttatcggacaacgaaacaccgtcgaagggacagacgtaccaacagtacgaaccgactaacgacacctaaacgtaccaaacgcgtacccgaaccggacctaacgtagaccgtaaccgtaggacgacgtaccgtagaacgggttactcgtacggaacgtaaccggacggtaccgtagtttaacgtcgtaaggtcggaacggaagtacggtaggtaaaccgggtaaattttacggttacgtaaccggttacgtttaccccgttagttttaaccgacgttacccggggttacgggaccggtaaccgggtaaccccgttacggg

SEQ ID NO: 197852 - DNA, 672 bp, Homo sapiens
  misc_feature: GYAE6OF02IZI8N.39.81.H04.1.454.CMB.1.raw
  modified_base (325)..(325): a, c, t, g, unknown or other
  misc_feature (325)..(325): n is a, c, g, or t
  modified_base (566)..(566): a, c, t, g, unknown or other
  misc_feature (566)..(566): n is a, c, g, or t
  modified_base (572)..(572): a, c, t, g, unknown or other
  misc_feature (572)..(572): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacacaggtgcccactcccaggttcagctggtacagtctggagctgagatgacgaagcctggggcctcgagttggaaggtctcctgtcaaggtcttactggttacaccttttaccaactagtcggtattcgaaggttggtcggacgacgtaggcccccgtagggacaagggtcgttaggnggttaggagttgggaagttcggaatccgaaggccgtacgtttacaaacggtggtaccacgtaacctaaacgtatcgacgaacagaaccgtccgagggtacacggtacgttaccaacgacgttacgaaccgaacgacgacgtacacgtaaccgacgacgacgcggtacacctagcgtaacgtgaggtacaccgtagtagacgtgtaccggaagaccgtacggcccgttagtacgttaaacgnggtacncgggtaacgagtacgtacgggtaaatttcgtttacggtaacgtcgttaaccgtcgttttacggaccgttacgtcgggtaacgacccggtaacgtttccgg

SEQ ID NO: 197853 - DNA, 708 bp, Homo sapiens
  misc_feature: GYAE6OF02GN48B.39.81.H04.1.454.CMB.1.raw
  modified_base (386)..(386): a, c, t, g, unknown or other
  misc_feature (386)..(386): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctgacgtgaaggtctccgtgacaaggtcttcgtaggttacctaccttttaacaacttagtaggttatcgtaggttgggtgcgtaacgacggtccccgtaggaacgaagggtcttggaggtggagttaggggatggatcgagtcgacttacaagtcggtacacgaactaaaactntcgaactaacgacgtaacccgtcgaagggacaggtacgtaccaactagtaccgaaccaactaacgaccgaacaccgtacccgaacggaacgtaccgaacccggacctaacagtaccggaccgtaggaacggcgaccgttgaacgtagttaccgaggtaacccggaacgaccgggtaccgttaagttaacgttacgtcggttacggacggtaagacggttaacgtaacgggtaaattttaggtttaaccgtacggttacccgttacctttacgtttacgtaccggttaaggccgggttaccgaaccgggtacccgttaccggg

SEQ ID NO: 197854 - DNA, 692 bp, Homo sapiens
  misc_feature: GYAE6OF02FWZBC.39.81.H04.1.454.CMB.1.raw
  modified_base (325)..(325): a, c, t, g, unknown or other
  misc_feature (325)..(325): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttggtgcgacaggcccctggacaagggcttgagtgagtgggatggatcagcgcttanaatggtacacactaaactagtgacacgaacgaaccctcgacgggcaacggacgtaccaaccagtacgaacccaacgagaccaactacgtaccaacggacgaccgtaaccgggaccctaacgaacgttacggaaccttacgggaacggaccggacccgttaggaacgtaacgttccgtacggtaacccgggaacgtacccggggtaccgttacggtttaacgtttacggtacggtacggaccggtaagggtaacggtacggttaaccggggtaaatttacgttttcggaaccgtttaccggttacccctttacgtttacgaccggtttaaccggtcgggggaccctaacggggtaccccttaccgggg

SEQ ID NO: 197855 - DNA, 701 bp, Homo sapiens
  misc_feature: GYAE6OF02FSJG1.39.81.H04.1.454.CMB.1.raw
tcagtcgcactagtcacgaccggtgctcgatttagtagtgtagattcgcgggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacacggcccctggacaagggtcttaggaggtggagtgggatgggatcgaggcgctttacaagttcggtacaactaacaaactagtgacacaacgaaccctccgaaggggcaacggaacgtaccaaccgagttaccggaaacccaacgaacggaacccaacctaacgtaccccgaaacggtaacggacccgtaacccgggaacccttaacgaacgtacgggacccgttagggaacgggtacgtccgtaggaacgtacttcgacggtaaccgaacgaccgggtccgtacgttacgttaacgtcgtacggacgagtacggtaggtacggggtaaatttggtttaacgtacccggttcggttaacccctttgtttacggtaccgttaccgggtacggggacccgttaacggggtaccccttaccggg

SEQ ID NO: 197856 - DNA, 815 bp, Homo sapiens
  misc_feature: GYAE6OF02HYPSH.39.81.H04.1.454.CMB.1.raw
tcagtcgcactagtcacgaccggtgctcgatttagtagtgtagattcgcggggacccaaaaaaccacaccctccttgggagaatcccctagatcacagctcctcaccatggactggacctggagcatcttttcttggtggcagcaacaacaggtgcccactccccaggttcagctggtacagtctggagctgagatgacgaagccgtggggcctcagtgaggtctctgcaaggcttcgtaggtacctacctttacaactatcggtatacgtaggttgggtacgcgacgacggaccccgtggaacgagggtccttggaggtcggtaggtggggtaacgttggggaactacggacggtaccgtccgtttaaaccgaacgttcgggtaccaacgaaaccgtaaactagtcgaactaccgtaacgaaccctaccggagggacctaaggacgtaccaaccgagtaccgaacccaagtaaccgtaacctaaccgaccgtaacccgaaccggtaacggaccctaaccgggtaccctaaacgtccgggtaccggtaaccgtacgggtaacgggacgtcccggttagaccgggtaaactccggtaaccggaaccggtaaccggtacccggggtaccgtttaacggttaactttccgggttacgtacgggtaaccggtagggtaacgttacggggtttaccgggtaaaacgttttaccgggtttttaacggaccgtttaccccgggtttaacctttcggttaccgttaaccgggtacccggtttaccggggaacccggttaccggggtaaccccgttacccgggg

SEQ ID NO: 197857 - DNA, 708 bp, Homo sapiens
  misc_feature: GYAE6OF02GLHOM.39.81.H04.1.454.CMB.1.raw
  modified_base (311)..(311): a, c, t, g, unknown or other
  misc_feature (311)..(311): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtggggcctcagtggaaggtctcctgcgaaggtcttcgtggttacacctttacaactatggtatctaggttgggtgcgacacggcccctaggacgagggcttggngtggagtgggatggactcgaggcgtacgttacgaagtcggtaccaacgtaacgtaaactagtacgactaacgacgtaacccgtaccgaggggaccgaaggtacgtaccgaaccgtagtacggaaccacgaacgaccgaaccaacgtccgaacggacgaccggaacggtacctaacgacggttaacggaccgtacggacggacgccgtaggaactattacgacggaaccggaaccgtaccggtccgttagtacgttacgtaggtcgacgaagggacggttagggtaacgggttaaaacgtttggtttaccggtacgttacccggtttaacccgtttccggttacggtaccgttaaccgggtccggggtaccggttaacccgggacccggtttaacggg

SEQ ID NO: 197858 - DNA, 616 bp, Homo sapiens
  misc_feature: GYAE6OF02JZQ8Y.39.81.H04.1.454.CMB.1.raw
  modified_base (238)..(238): a, c, t, g, unknown or other
  misc_feature (238)..(238): n is a, c, g, or t
  modified_base (301)..(301): a, c, t, g, unknown or other
  misc_feature (301)..(301): n is a, c, g, or t
  modified_base (313)..(313): a, c, t, g, unknown or other
  misc_feature (313)..(313): n is a, c, g, or t
  modified_base (341)..(341): a, c, t, g, unknown or other
  misc_feature (341)..(341): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatcgacgaagccgtggggcctcgagtgaaggtctcctgcaaggntctggttacaccttacaagtatggtatcagttggtgcgacgaggccctggacgaaggctgagnggagtggatgancgagcgcttacagtgtacacaacaactngcacacgacctccgaggacagtacgacaactagtacgaccaacacgacaaccacgtacccgaacggtaacgaccgaacggtaccctacgaacgtacggaacctagggaacgggtacgccgtagagacctacggtacgacgtacgaaccggtccgtacgttaacttcgtacggtgacgggtataggtacggttagggttaaattcggttaacgtacgttaaccggttcttaccgttagtaccgtaccggttacgggccgtaaccgggtaccgtcgg

SEQ ID NO: 197859 - DNA, 746 bp, Homo sapiens
  misc_feature: GYAE6OF02IPZBS.39.81.H04.1.454.CMB.1.raw
  modified_base (343)..(343): a, c, t, g, unknown or other
  misc_feature (343)..(343): n is a, c, g, or t
  modified_base (381)..(381): a, c, t, g, unknown or other
  misc_feature (381)..(381): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcattcctttttcttggtggcagcaacaacaggtgcccactcccaggttcagctggtacagtctggagctgagatgacgaagccgtgggcctcgaggtgaacgtctcctgacgaggtcttcgtggttacctacctttaccaactagtggtatcgtaggttgggtcgcgacgacggccccgtggacgaaggtctaggaggtggagtgggagtggatacgngcgtacttaacgtagtcggtacaaccgaactaaacgtncgacaacgacgtaaccgtccgagggacacggtacgtaccacgaataccgacctaacgaccgaacacacgtaaccgacgacgacgtaccgacctacgtaacgtcggaacgtagggtacggaccgtccgtaaggacgttacgaccgtacggaacccgtaacggtacccgggttacgttaaggttaaccgtttacggtacgggtacggaacgggtaacggtaacggggtaacgggtttaaagggtttaacccgttttacggttaaccggttaccggtttaacccggttaacccgttttggtaacccgggttacgggttacccgggtaccgggggtaacccgggttaaccgggttaccccggttacccg

SEQ ID NO: 197860 - DNA, 696 bp, Homo sapiens
  misc_feature: GYAE6OF02GVNCZ.39.81.H04.1.454.CMB.1.raw
  modified_base (189)..(189): a, c, t, g, unknown or other
  misc_feature (189)..(189): n is a, c, g, or t
  modified_base (259)..(259): a, c, t, g, unknown or other
  misc_feature (259)..(259): n is a, c, g, or t
  modified_base (343)..(343): a, c, t, g, unknown or other
  misc_feature (343)..(343): n is a, c, g, or t
  modified_base (388)..(388): a, c, t, g, unknown or other
  misc_feature (388)..(388): n is a, c, g, or t
  modified_base (524)..(524): a, c, t, g, unknown or other
  misc_feature (524)..(524): n is a, c, g, or t
  modified_base (529)..(529): a, c, t, g, unknown or other
  misc_feature (529)..(529): n is a, c, g, or t
  modified_base (564)..(564): a, c, t, g, unknown or other
  misc_feature (564)..(564): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctgganctgagatgacgaagccgtggggcctcagtgaaggtctctgcaggtcttcgtcggtactaccttacaactntgtactcgtaggttgggtgcgacgaccggaccccgtggaacgaacgggtccgttaggaggtgggagttgggagtagggtatcgnggccggtacttaactaagtcggtactaaccaacgtaaacttacgngacccaacgacgtacccgtaccggagggacgaagtacgtaaccactacgtacgaacccacaacgaccaactaccaccggaacgaccggccgaccgacctaacgacggtaccggacgtaggaccggtacgtcgacgngtacngaccgacgacggtccgtacgttacgttacttacgngtacgacgtaagggcgttaaggtaaccgggtttaagtttaaccggtttgtaacccggtttacgttacccgtttagtttacggtaacccggttccggggtacgggaacccggttacccggtacgttccccggg

SEQ ID NO: 197861 - DNA, 592 bp, Homo sapiens
  misc_feature: GYAE6OF02GLL72.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtaatcagttgggtgcgacaggcccctggacaagggcttgagtggatgggatggatcagcgctttacaagtggtcacacaaactatgacacagaacctccagggcagagtcaaccatcgaccaacagacacatccacgagcacggcctacatacggacctggaacggacgccgtaggagactcgtacgaccgaccgaccgggtaccgttagttacttaaccgtgtacgacgtagagtacgtacggggtaaattagttttaggaaccgttcggttaaccccttgtttacgtaccgttacggtacggggaccgtaacgggaacccgttacggg

SEQ ID NO: 197862 - DNA, 648 bp, Homo sapiens
  misc_feature: GYAE6OF02HOZQ7.39.81.H04.1.454.CMB.1.raw
  modified_base (190)..(190): a, c, t, g, unknown or other
  misc_feature (190)..(190): n is a, c, g, or t
  modified_base (335)..(335): a, c, t, g, unknown or other
  misc_feature (335)..(335): n is a, c, g, or t
  modified_base (371)..(371): a, c, t, g, unknown or other
  misc_feature (371)..(371): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctgganctgagatgacgaagccgtggggcctcagtgaaggtctcctgacaggcttctgttacacctttacaactagtgtatctaggttgggtcgacgacgacggccccgtaggaacgaacgggtcttaggaggtggaagtgggtatggaancgagcgtacttaacgagtcggacaacaactaaactntacgacaacacggtaaccctcggagggacagaccgaccaactagacgaaccaacgacgaacactacaccgacgacgaccgaacccggctaacgacgtaccggaccgagggacggacgtcgtaggagtactcggacgaccgaaccggaccggtacgttagttacttacgtggtacgaggtaagtacggagggttaacggttaacgtttgtttacggtacttaaccggttccttagttacggaacgtttccggacgggtaccgacgggttcccgtccgg

SEQ ID NO: 197863 - DNA, 762 bp, Homo sapiens
  misc_feature: GYAE6OF02I9WJT.39.81.H04.1.454.CMB.1.raw
tcagtcgcactagtcacgaccggtgctcgatttagtagtgtagattcgcgggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgagccgtgggcctcagtgaagtctctgcaggtcttctggttaccaccttacaactagtgtatcgtaggttgggtgtcgacgaccggcccctagggaacgtaggggtcgttacggagggtaggaggtagggtagtacgggtagtaccgacggtccgtacttaacggaagttccggtacaacgaaaccgtaaacgttagtacgaccgtaaacgaaccgtaaacccgtaccggaagggactaaaacggtaccgtaaccgtaaaccgtaccgtaccgtaaaccccgaaacgtaaccggtaacctaccgtaaccgtacccgaacgtaaccgaccgtaaccggacctaacgtacgaccgggtactagggaaccggtacgacgttacgacgtactacggtacgaaccggccgtaccgggtcgttaaaggttctttaaccgtggtaccgacgggtaagacgggtaacggttacgggtaattttacggtttaccgggtacttacccgggtttacccttggttacgtaccgggttacgggtaccgggaccggtaaccggtcccgttacggg

SEQ ID NO: 197864 - DNA, 654 bp, Homo sapiens
  misc_feature: GYAE6OF02INJ13.39.81.H04.1.454.CMB.1.raw
  modified_base (281)..(281): a, c, t, g, unknown or other
  misc_feature (281)..(281): n is a, c, g, or t
  modified_base (299)..(299): a, c, t, g, unknown or other
  misc_feature (299)..(299): n is a, c, g, or t
  modified_base (350)..(350): a, c, t, g, unknown or other
  misc_feature (350)..(350): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttaccacctttaccaactatggtatcagttgggtgcgacngccctggacaaggcttgngtggagtggggatgggatcgagcgcttaacaagtcgcaacaactaaactangacaacacgaaccctcgagggcaggacgtacaccagtcgaccacgaacgaacaccaactaccacgacgacgacccggtacctacgaagtcggaccgtaggaacgggtacgccgtacgagtactaccgtaggaaccggaccgtaacgggtccgttaacggttaacgttaacgttcgtgggtaacccggtaggacggtacgggtacggggttaaagtttagtttacggaccgtttacggtaccccttttagttaccggtaccgttacgggtaacggggtaccggtaccgggttacccggtaccggg

SEQ ID NO: 197865 - DNA, 740 bp, Homo sapiens
  misc_feature: GYAE6OF02H80VA.39.81.H04.1.454.CMB.1.raw
  modified_base (342)..(342): a, c, t, g, unknown or other
  misc_feature (342)..(342): n is a, c, g, or t
  modified_base (557)..(557): a, c, t, g, unknown or other
  misc_feature (557)..(557): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaaacaacaggtcgcccactacccaggttcagctggtacagtctggagctgagagtcgacgaacgtccggtcggggcctcgacgtggaacggtcctacgtcgacgaggtcttcgtcgtactaccttacactatggatccgtaggtggtcgcgtacgacggtcccgaggacgagggtcgttaggacggtaggtaaggngggtagtacggtagtacgtcggaccgttacgttaacgtaacgtcggtacaaaccgtacaaacgttataccgaacaaccgtaacgaccgtaccggaacgtacgagtaccgtaccaactaacgtaacgaccgacgaacgactaacgcctaccggaacgaaccggacgaaccggttaccacggtaacggtaccggtaacccgtagggacgttaaccgngttaccggaacggttacacgggttaaccgaaaccgggtaccgtacccgggtacccgtttaggtaacccgtttcggtaggacggtacggacggaacgtagggtaacggttacgttagttaaccggtcgttacgttacgttactacggttacggtaccgggcggtacccggacggttacgtccgg

SEQ ID NO: 197866 - DNA, 789 bp, Homo sapiens
  misc_feature: GYAE6OF02GOEER.39.81.H04.1.454.CMB.1.raw
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgagccgtggggcctcgagtgaacggtctccgtgacaaggtcttcgtggttactacctttaccaacttagtggttactcgtaggttgggtgcgacgtcggccccgtaggacgaacgggtcttaggaggttggtagttcgggttccgtactaacgaaccctaacaaaccgtatccgtacccgagtaaaccggttccgagggtacacggtaacgtcccaaccgtagtaaccgaccgaacacccgaacgacctaacgtacccgaacgggaaccaacgtaccgtaccgtaacagttaacggaaacgttacggacgtaccgtacgtaccgtagggtacttaacggtttacggaaccggtaaccgacccggtaacgtacgttacgttaagtttaccggtacggtaccggtcggtacgttccgttaccgttacccgaaacgttaaccgtaggtacggttaaggtaaccgggtaaaccgggtttaaacgggttacggtaaccggtttacgggtacccggggtaaccggttaaaccgggtacccgtccggttaacccggtacccgttccggtaccgttacccgtccggttaacccccgg

SEQ ID NO: 197867 - DNA, 641 bp, Homo sapiens
  misc_feature: GYAE6OF02GEHHS.39.81.H04.1.454.CMB.1.raw
  modified_base (285)..(285): a, c, t, g, unknown or other
  misc_feature (285)..(285): n is a, c, g, or t
  modified_base (375)..(375): a, c, t, g, unknown or other
  misc_feature (375)..(375): n is a, c, g, or t
  modified_base (407)..(407): a, c, t, g, unknown or other
  misc_feature (407)..(407): n is a, c, g, or t
  modified_base (417)..(417): a, c, t, g, unknown or other
  misc_feature (417)..(417): n is a, c, g, or t
  modified_base (421)..(421): a, c, t, g, unknown or other
  misc_feature (421)..(421): n is a, c, g, or t
  modified_base (478)..(478): a, c, t, g, unknown or other
  misc_feature (478)..(478): n is a, c, g, or t
tcagtcgcactagtcacgaccggtgctcgatttagtagtgtagattcgcgggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcaggtgaaggtcctcctgcaaggtcttcgtagttacacctttaccaactatggtactcgtagttgggtnaccgacgacggtcccctggaacgaacgggtcttcggaggtggagtggggagtcggatcgagtcgtacgttacaagtgtcaacaacaactncgacaacacgacctcgaggcagacgaccaacngtacgaaccncganacctacactaccgacagccacgcctacgagtccgaccgtaggacgacgcctagatcngcgtaccgacgccgtacgtagttacgtcgtgacggtacgaagtacggtacggtaacgggtattttaacggtttaccggaactttccgggttaccgttttaacggtacggtaacccgtttacggggtacccgggtaacggtaccccgggttacgttaccccggg

SEQ ID NO: 197868 - DNA, 731 bp, Homo sapiens
  misc_feature: GYAE6OF02I2H5N.39.81.H04.1.454.CMB.1.raw
  modified_base (271)..(271): a, c, t, g, unknown or other
  misc_feature (271)..(271): n is a, c, g, or t
  modified_base (303)..(303): a, c, t, g, unknown or other
  misc_feature (303)..(303): n is a, c, g, or t
tcagtcgcactagtcacgaccggtgctcgatttagtagtgtagattcgcggggcacccaaaaaccacacccctccttgggagaatcccctagatcacagctcctcaccatggactggacctgagcatccttttctggtggcagcaacaacaggtgcccactcccaggttcagctggtacagtctggagctgagatgacgaagcctggggcctcagtgaaggtctctgcaagcttctggtacacctttaccaactatggtatcaagttgggntcgacaggccctcggacaggctcgagtcgganggatggatcgagcgacttacgaatcggtactacaaccgtaaactacgtagtccaacaaggtaacccgttaccgaacgggtaaccgtaggtaaacggtaccctaaaccgaacttacggaacccgtaacgtaaacggaaccgtaacccaacggtaacccctaaaccgggtaaccgaccggtaacccgggtcccgttaaacctaacgtaccgggtacccgttaacggaacgggaacggtacccgttaacggacggtaaccgttaccgttacggaaccgaacccgtaaccgggtacccgggtaacgtttaacgttaacgtacggttaggtacgaacggtaggtacggttaccggggtaaattacggttttagaaccgtcgtttaacccgtcctttacggaactacggtacgggtccgaaccgggtaacccgg

SEQ ID NO: 197869 - DNA, 701 bp, Homo sapiens
  misc_feature: GYAE6OF02F8EYF.39.81.H04.1.454.CMB.1.raw
  modified_base (400)..(400): a, c, t, g, unknown or other
  misc_feature (400)..(400): n is a, c, g, or t
tcagtcgcactagtcacgaccggtgctcgatttagtagtgtagattcgcgggggacccaaaaaccacacccctccttggggagaatcccctagatcacagctcctcaccatggactggacctggagcatccttttcttggtggcagcaacaacaggtgcccactcccaggttcagctggtacagtctggagctgagatgacgaagccgtgggcctcgagtgaaggtctctgacaggtcttcgtggttaccaccgtttacaacgtatggtatcgaggttcggtacgcgaacgtacggtcccctggaacgtaggggtcttaggaggttcggaagtggggtatgggtataccgaggtcgtaccttaacgtaaacgttggtaacctaacgtaactaaaacgttntacggaccaaccggtacaacccgtacgggacggaccgtaacggtagtaccaaccgtacgtaccgaacctaacgaacgaccaacgtacgtaccgtacggaacgtaccgaccggacctaacgacgtacgaccgttacggaacggccgtcgtacgtagtaacgtaccggtacgaccgtaccggaccggtaccgttaggttacttacgtgacgtaacgaggactagggtacgtaagtttacggttacgtacgtacgtccgttattccggtacggtccgtacggggtacctaccgggtactccggg

SEQ ID NO: 197870 - DNA, 774 bp, Homo sapiens
  misc_feature: GYAE6OF02JNCDX.39.81.H04.1.454.CMB.1.raw
tcagtcgcactagtcacgaccggtgctcgatttagtagtgtagattcgcgggacccaaaaaccacacccctccttgggagaatcccctagatcacagctcctcaccatggactggacctggagcatccttttcttgggtggcagcaacaacaggtgcccactcccaggttcagctggtacagtctggagctgagagtggaacgaagccgtggggcctcgaggtgaggtctcgtgacaggtctcgtagtacctaccttaccactagtgtatcgtaggttgggtcgacgaacgtcggtaccccgtaggacgtaagggtcttaggaggtaggtacgtaggggtagtcgggtataccggtaacggaccgtacgttaacgtaggttacggacaaaccgtaactaaaacgtcgtacggacctaaccgaaaccgtaacccgtaccgtaagggaccgtaacggtaaccgtaccgaaccgtaacggtcggaaaccctaaccgaacgaaaccgtacctaaacgtacccggaaacggaccgtaaccccggtaccggtaaaccctcggtaaccggttaccgaaccggttacgggaaccggtacgtcgaacgggtaacgtacgtcaacgggaaccgtaccggtccggtacgtacttaacgtcgttcgacgaacgggacgtaacggacggttaacgtttaagtttacgttaccgtaacggttaccgtacctttcgtaaccgtcgggttaacccgggtacggaaccgggttacccggtaccgttaccgg

SEQ ID NO: 197871 - DNA, 658 bp, Homo sapiens
  misc_feature: GYAE6OF02IN0Q6.39.81.H04.1.454.CMB.1.raw
  modified_base (356)..(356): a, c, t, g, unknown or other
  misc_feature (356)..(356): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgagcctggggcctcagtgaaggtctccgtgcaaggcttctggttacacctttaccaactatggtatcgagttgggtgcgtacacggcccctgggacaagggcttggagtggatgggactggatcagcgtcttaacaagtggtcaacacgaaaactgngcaacacgaacctccgaaggggcaaggtactacgaacatcgaaccacaggaacctacaacgtcccaacggaacgtacgaaccgtcctaacgacgttacggacccttaggaacggtacgaccttaggacgtacgtcctaggaaccgacgtaccgggtacgttacggtaacgtttactcggttcggacggtaagacgggtagtaaaccgggggtaattagtttttagtaccggttacggtaccctttacggttttagaccgtttaacgggtacggggtaccgtaacggggtaccccttacgggg

SEQ ID NO: 197872 - DNA, 610 bp, Homo sapiens
  misc_feature: GYAE6OF02HVQ4N.39.81.H04.1.454.CMB.1.raw
  modified_base (423)..(423): a, c, t, g, unknown or other
  misc_feature (423)..(423): n is a, c, g, or t
  modified_base (482)..(482): a, c, t, g, unknown or other
  misc_feature (482)..(482): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactccccaggttcagctggtacagtctggagctgagatgacgaagcctggggcctcagtgaaggtctcctgcaggcttcgtggttacctacctttacaactatggtatcgagttgggtgcgacacggcccctggacaaggcttgagtggatgggatggatcgagcgcttacaagttggactacaacgtaaactatagacacagaacctcgaggcagacgtacacctagcgaccacacgacacactcgacgacgcacggtcacgncggacctgacggagccgtagagtacgtctcgaacgaccgtaccgcgtagtcgtttaacnggttagaccggaagtacgtaggtacggggtaaatttcggtttacgtacgttacggtttaaccccgtttagtttaccggtacgttaaccggttacggggtaccccggtacgggttaaccccgttacggg

SEQ ID NO: 197873 - DNA, 668 bp, Homo sapiens
  misc_feature: GYAE6OF02F2NR4.39.81.H04.1.454.CMB.1.raw
  modified_base (371)..(371): a, c, t, g, unknown or other
  misc_feature (371)..(371): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgagccgtggggcctcagtgaaggtctcctgcaaggcttctggttactacctttacaactagtggtactcgaggttgggtgcgacgacggtcccctagggaccgagggtcttaggagtggagtgggatggatcgaggccgtacttaacgagtcggtacacgaactaacgtancgacacgacgtaacctccggaggcagacgtccaacgactacgaccacgagacacactaccacggacgccgtaaccggacctaacgacgttaccggaaccgtgggaacggtaccggtcgtacggaacgtacgttccggtacggaaccgtacggtacccgggtaccgttaggttacctttaccgggttgacggtacggacgtaagtacgggtaacgggaacttttaggttacggtacgttaccggttccttacggtttacgaccgttagggtccggaccggttacggtaccgttaccgg

SEQ ID NO: 197874 - DNA, 633 bp, Homo sapiens
  misc_feature: GYAE6OF02FF9WM.39.81.H04.1.454.CMB.1.raw
  modified_base (244)..(244): a, c, t, g, unknown or other
  misc_feature (244)..(244): n is a, c, g, or t
  modified_base (366)..(366): a, c, t, g, unknown or other
  misc_feature (366)..(366): n is a, c, g, or t
  modified_base (413)..(413): a, c, t, g, unknown or other
  misc_feature (413)..(413): n is a, c, g, or t
tcagtcgcactagtcacgaccggtgctcgatttagtagtgtagattcgcgggggacccgaaaaccacacccctccttgggagaactcccctagactcacacgctcctcaccatcggactggacctggagcatcctttcttggtggcagcaacacaggtgcccactcccaggttcaggctggacagtctggagctgagatgacgaagcctggggcctcagtcgaggtctcctgactaaggcttcnggttacacctttaccaactatcggtatcacgttggtgccgacgaggcccccgttggacccaaggggccttggacgtggatggatcgggatcagcgcttacaagtggactacgacaaacttgngaccacacggaaccttccgagggcagtacgtccaacgctggacccanagaccactacaccaccgagactacgggaccacacgtgaacccgttgacgggtacaccgttcgaacgttgaccttagaccggacctaacgggggtccccgttagttaacgttccgagttacggactacggagacgtaaccggggtattaacgtttcgaaccgttcgggtaccctttagtcgtacgtacccggttgggaccccgtacgggtaaccccttggg

SEQ ID NO: 197875 - DNA, 749 bp, Homo sapiens
  misc_feature: GYAE6OF02FVRXI.39.81.H04.1.454.CMB.1.raw
tcagtcgcactagtcacgaccggtgctcgatttagtagtgtagattcgcgggggacccaaaaaccacacccctccttgggagaatcccctagatcacagctcctcaccatggactggacctggagcatccttttctggtggcagcaacaacaggtgcccactcccaggttcagctggtacagtctggagctgagatggacgaagccgtggggcctcagtgaaggtctcctgcaaggcttctggttacacctttacaactatggtatcgtagttggtgccgacgacggtcccctggacgaagggtcttaggaggtcggagtgggatgggaatcgaggacgtctacaagtcgggtacaactaacgtaaactatcgactaacacgtaaccctccgaagggacaggtacaccaacagtaccgaacctacgacgactacactaccgacggacgtacccgacgacccgttaacgtacgtaccggaaccgtaggaacggtaccggtccgtaagtaacggtacgttaccggtaacggaaaccgaccggtaccgggttaccgtaacggtttaacctttacggggtcggtttacggaacggtacgggtaagtaccgggttaaacggggttaaacgttttacggtttaaccgggttaaccgttacccgggtttacccgtttaccggtttaacgggttaccgtttaaaccccggggttggggttaaccccgggtaaccggggttacccccggttaccgggg

SEQ ID NO: 197876 - DNA, 844 bp, Homo sapiens
  misc_feature: GYAE6OF02GN1ZJ.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagacaaacaacaggtcgcccactccgaggttcaggctggtacagtcgtgggagcgtaggagatacggaacgaaggtccggtcggggccttcgaaggtcggaacgggttcctaccgtacggacgtacggtccgttcgttacggttacctacccttttaaaccgaactttacggttacggtacgttacgttagggtttggggtcgaccggaccggtaccggtccccggtagggaacccgtaggggtcttacggagggttacggggtaggtagggggtaacgttcgggaacttcccggacggtaacgttaccgtttaacggaacgttttacggaacccgtaaccggaaaacttaaacgtacgtaacggaacgaaaccgtaaccggaaacctccggaacgggtacgaacgggtactacccaaaccgttacgaaccccgaaccgtaaacgtaacgaaccctaccgaacgtaaccgacgtacgacccggacggtacctacgggacgtaccggtacgtacgggacgtacggcgtacgacgtcgtaccgaacgaccggtaccgtcgggtacttaacgttacggtacgttggaacggcggtaagtacggtacgggtaagtttacgttaacgttaccggttaacgttccggttaacttcggtaaccgttacgggtcggtaaccgggtacccggtacggtacccgggttacg

SEQ ID NO: 197877 - DNA, 652 bp, Homo sapiens
  misc_feature: GYAE6OF02JHK2U.39.81.H04.1.454.CMB.1.raw
  modified_base (469)..(469): a, c, t, g, unknown or other
  misc_feature (469)..(469): n is a, c, g, or t
  modified_base (482)..(482): a, c, t, g, unknown or other
  misc_feature (482)..(482): n is a, c, g, or t
tcagtcgcactagtcacgaccggtgctcgatttagtagtgtagattcgcgggggacccaaaaaccacacccctccttgggagaatcccctagatccacagctcctcaccatggactggacctggagcattccttttcttggtggcagcaacaacaggtcgcccactcccaggttcagctggtacagtctggagctgagatggaacgaacggccgtcggggcctacgaggtgaacggtctcctgcgaaggcttcgtcgttacctaccgttacaactgtggtatcgtaggttggtcgcgacgacgcccgtaggacgaggtctggagtggagtggactggactcgagcgtacttacgatcggacaacgaactaactagtacacgacaacgtacctcgaggacagacgacctacgacgtacgaaccacacgaccacgtactaccgaggaaccgcgaccgactacagacgaccnggtaacgcgtacngacacgctaacgaccggacacgggttcctagtttacgtcgtacggtacggaacgtaggaccgggtaggttaaccgggtaatttttcggtaccggtacgtttaccggtacctttcgttaaccggtacggtttaccgggaccggggtaaccggtaccgggttcccgtaacgg

SEQ ID NO: 197878 - DNA, 639 bp, Homo sapiens
  misc_feature: GYAE6OF02F9UAM.39.81.H04.1.454.CMB.1.raw
  modified_base (404)..(404): a, c, t, g, unknown or other
  misc_feature (404)..(404): n is a, c, g, or t
tcagtcgcactagtcacgaccggtgctcgatttagtagtgtagattcgcgggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttggagtggagtggggatgggatcgaggccgtacgttaacaagttggtccaaccgacaaactacgtcgcaacgacgaaccctccgagggacaacgacgtccaaccntacggacctaacgacgaaccacactacccagacgacaccgggactaacgagtccggacctaggacggtacgccgtaggaacgctcgtacggaaccgaaccgaccggtaccgttagttaacgtttcgaggtggaccgaagtacggtacgggtaacggtaaatttcggtttaagaccggttcggttacccttgtttcgaccgttacgggtcgggaccgtaccgggtaccttaccggg

SEQ ID NO: 197879 - DNA, 663 bp, Homo sapiens
  misc_feature: GYAE6OF02HB7N3.39.81.H04.1.454.CMB.1.raw
  modified_base (481)..(481): a, c, t, g, unknown or other
  misc_feature (481)..(481): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtggggcctcgagtgaaggtcctcctgacaaggtcttcgtaggttacctaccctttaccaacttagtggtacttcgtaggttgggtgacgacgaccggcccctaggaccaagggtcttgaggtggagtggggatggatcgagcgtacttacagtcgtacacaacaatgcgacaacacgaacctcggaggcagtactacacgagtacgaccaacacgaccactactccgaacgtacgaccgaccgactaacgaggtacgaaccgtggaacggtacncccgtaagagtacgtacgtacgggaaccgaaccggtaccgggtacggttacgttaacgtttccgtaggtacggacggaagtaacgggtagggttaacgggttaaatttcggtttacgacggtttccgttaccgttcgtttacgtaaccgtggtaccggggtacccgtacgggtacccgtcgg

SEQ ID NO: 197880 - DNA, 706 bp, Homo sapiens
  misc_feature: GYAE6OF02F2ZFL.39.81.H04.1.454.CMB.1.raw
tcagtcgcactagtcacgaccggtgctcgatttagtagtgtagattcgcgggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaggcttcgtggttacacctttacaactatggtatcaggttggtgcgacgaccggcccctggacgaaggggtcttggaggtggagtggggatgggatcgaggtcgacttacaagttggtacactaacgtaaactatacgacaacgaacgtaacccgtaccgtaacgggctaacggtacgtaccgaacgtacgtaccgaacccgaactaacggacctaacctaacgtacccgaacggaccgtaaccggacccggtacctaacgacgtacccgggacgtacgggacgacgtcccgtagacgactccgtaacgaccggtaccgaccgggtaccttacggttacgttacgtgggtacgaccgggtacgaagggtacggtaaccggggttaatttaacgtttaggtacccgttaccgggttaccttttcgtacgttaccggtacggtaccgggtaccggtaaccgggtaccgtacccggg

SEQ ID NO: 197881 - DNA, 746 bp, Homo sapiens
  misc_feature: GYAE6OF02F870S.39.81.H04.1.454.CMB.1.raw
tcagtcgcactagtcacgaccggtgctcgatttagtagtgtagattcgcgggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggtctctggttacaccttaccaactatggtatctaggttggtgccgacgacggtcccctaggacgaacgggcgttggaggtaggacggtaggggtagtcgggtatcgacggcgtacgttaacgaagttcgggtacaacgtaacgtaaactacgtagaacctacgaacgtaacccgttaccggaacgggacgaacggtaacctaccgtaaaccctaacgttaaccggaaccccgtaaacgaacggaacccctaacgaacccgtaacccggaaccggtacggaacccggtaacccgggtaccctaacggtacgttaccggaaccggtaggtacggaccgtcgtaacggacgtactacgacggaaccgaccggtccggtccgttagttacgttcgtacgtcgacgacgtaggtacggtaagggttaacgtttaggttacgttccggttaccggttacctttacggttaacgttacgttaccgggtacggacccggtacgggtacccgttccggg

SEQ ID NO: 197882 - DNA, 625 bp, Homo sapiens
  misc_feature: GYAE6OF02FPLJ0.39.81.H04.1.454.CMB.1.raw
  modified_base (419)..(419): a, c, t, g, unknown or other
  misc_feature (419)..(419): n is a, c, g, or t
  modified_base (492)..(492): a, c, t, g, unknown or other
  misc_feature (492)..(492): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggccttcgtggttaccacctttaccaactatggtatcgtagttgggtgcgacgacggcccctggacaagggtcttaggagtggagtgggatggatcgacggcgtacttaacaagtcggtaccgacaactaaactatgacgacgaacgtaaccctcgagggacagtacgtaccaccagtcgaaccanacgaacacgatacccgagacgacgacggacctaacgagtccggaccgtaggacggacgcccgtagactacgtntacggacacgtaccggtcgtagtagttacgtcggtgtacggagagtggtaaggtaaacgtttcgtttagtaaccgttcggttacccttagtttcgaccgtttacggtccgggtacgtaccgggacccttcggg

SEQ ID NO: 197883 - DNA, 766 bp, Homo sapiens
  misc_feature: GYAE6OF02HPTM7.39.81.H04.1.454.CMB.1.raw
tcagtcgcactagtcacgaccggtgctcgatttagtagtgtagattcgcgggggacccaaaaaaccacacccctccttgggagaatcccctagatcacagctcctcaccatggactggacctggagcatccttttcttggtggcagcaaacaacaggtgcccactcccagtttcagctggtacagtctggagctgagatgacgaagccgtgggcctcgagtgaagtctcctgcaaggtcttctggttaccaccttaccactagtggtatcgaggttggtgcgtacgacggccccgtggacgagggtcttggaggtggtacgtggggagtagggactcgacggtccgtacgttacgaagttacggtactaaccgaaaccgtaaacgtagtacgaacctaccgaaacgtaaccctaccggaacgggacgaacggacgtaccgaaaccgtacgtacccgaaacctaaccgaacgtaaccacccgtaactaacccgaaacggaccgaacccggaacccggtaaccgttaaaccgacggttaacccgggaccgttaacgggaacgggtacgtaccggtaggtaaacgtacgtaccggtacggaccggaaccgtaccgggtccgttacgttaacgttacgtcggtacgacggagtacggacggttacggtaaacgtttggttttacaacgggttttaccgttaaccccgtttacgtttacggtaaccgttacgggtaccgggtaacccggtaccgggtacccggtttaccgg

SEQ ID NO: 197884 - DNA, 901 bp, Homo sapiens
  misc_feature: GYAE6OF02HD6AP.39.81.H04.1.454.CMB.1.raw
  modified_base (687)..(687): a, c, t, g, unknown or other
  misc_feature (687)..(687): n is a, c, g, or t
tcagtcgcactagtcacgaccggtgctcgatttagtagtgtagattcgcggggcaacccaaaaaccacacccctccttgggagaatcccctagatcacagctcctcaccatggactggacctggagctattccttttctggtggcagcaacaacaggtgcccacgtcccaggttcagccgtggtacagtctggagctgaagactggaacgaagccgtgggccctcgagtgaacggttcctccgtagacgaacggtcgttcgttacggttaacctacccttttaaccgaacttagttacggtattaccggttaggttcgggtacgaccggtaacccgaccgggtacccccctagggaaccgtaacggggtcgtttaaggaggttaggggtacgttacggggtaacggttaggaaccgtacggtacggtaccggttaccttaaaacgtaacgttacggttaacccaaaccgttaaaactaaacgttagaaccgtaaccaacccggtaaaccgtaacccgtaaccgggtaaacggtacggtaaaccggtaacgtaaccccgtaaaccctaacgaccgtaaaccgaaccgtaaacgacccgtaaacccgtaaccctacccgaaacccggtaccggacccgtaaaccggtaaccctaagtaccggtaccggtaacggtaggaacggggaccnccggtaaagtacgtacgttaccgacgaacccgggtaccgacggtaccggtttaaggttaccgttacgtacggtaacgtccgggaagttaccgggtaacggttaacggggttaattttaaccggttaacggttaccgttacccggttttaaccgtcggtttaaaccggttccggtaaccgggtttaccgggtacccggtttaacccggtacccgg

SEQ ID NO: 197885 - DNA, 713 bp, Homo sapiens
  misc_feature: GYAE6OF02HUL0C.39.81.H04.1.454.CMB.1.raw
  modified_base (176)..(176): a, c, t, g, unknown or other
  misc_feature (176)..(176): n is a, c, g, or t
  modified_base (498)..(498): a, c, t, g, unknown or other
  misc_feature (498)..(498): n is a, c, g, or t
  modified_base (642)..(642): a, c, t, g, unknown or other
  misc_feature (642)..(642): n is a, c, g, or t
  modified_base (681)..(681): a, c, t, g, unknown or other
  misc_feature (681)..(681): n is a, c, g, or t
tcagtcgcactagtcacgaccggtgctcgatttagtagtgtagattcgcggggacccaaaaaccacacccctccttgggagaatcccctagatcacagctcctcacatggactggacctggagcactcctttttcttgggtggcagcaaacaacaggtgcccactccccaggttcngctggtacagtctggagctgagactgacgaagccgtggggcctacgaggtcgaaggtcctcgtcgacgtaaggtcttcgtacggttactaccgtttaacaactagtcgtaatacgtaggttcgggtcgacgtaccggtacggccccgtcgggaacgtaagggcgtttaggacggtaggaggtcgggaagtggactacgtggaccgtactttaaccgtaagttcggtaacctaacctaaacgtaaattactacggaacctaaccgtaaacggaaccccgttaaccggagggtacgaaaccggaaacgttccaaaccggttaanaccggtaaacccaaacgtcgaaacccacctaaacctaccgtacggaaccgaccgacgtccaaacgtcgacggtacgtaacggtacggacgttccgagtaacgtgtagacgaacgtcgacgtacgtagtacttacggtgcgaagngtaacgagtacgttattagttaacgcgtacgttacgttnaggtacctaggtacggccgtacggtactccgg

SEQ ID NO: 197886 - DNA, 586 bp, Homo sapiens
  misc_feature: GYAE6OF02GB6H5.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcgagttgggtgcgacaggcccctggacaagggcttggagtggatgggatggatcgagcgtcttaacaagttcggtacacaacaaaactatgcaacagaaccctccgagggcaaggacgtacacctatcgaaccacgagaccacactccaacgagcaccggcctacgagtcggacctggacggacgccgtagagactcgagaccgacgaccggtccgtagtacttacgtgtgacgagacgtagtacgggtaaattgtttacggacgttcggttacccttcgtttacgacgttaccggtcgggaccgtaccgggtacctccgg

SEQ ID NO: 197887 - DNA, 654 bp, Homo sapiens
  misc_feature: GYAE6OF02F2Q7R.39.81.H04.1.454.CMB.1.raw
  modified_base (335)..(335): a, c, t, g, unknown or other
  misc_feature (335)..(335): n is a, c, g, or t
  modified_base (352)..(352): a, c, t, g, unknown or other
  misc_feature (352)..(352): n is a, c, g, or t
tcagtcgcactagtcacgaccggtgctcgatttagtagtgtagattcgcggggacccaaaaaccacacccctccttgggagaatcccctagatcacagctcctcaccaatggactggacctggagcatccttttcttggtggcagcaacaacaggtgcccactcccaggttcagctggtacagtctggagctgagatgacgaagcctggggcctcgagtgaaggtctcctgcgaaggcttcctggttacacctttaccaactatggtatcgagttggtgcgacgacggcccctggacagggcttgagtggagtgggatggatcgagcgtacttanagtggtcacacaaactntacgacaacacgaacctcgagggtacagtacgaccacacacgaccacacgacctaacgactacccgaacgtacgacgacccggtcctaacgcggtaccggtacctaggaacgggacgcccgttagaacgtactacgtacggaccggaacgtaccggggtaccgttacggttaactttaccggtcgtacggacgacggtaaggtacggtaacggggtaattttacggtttacgtaccggttacggttaccccttggttacgtacggttaccggtacggggaccgtaccgggtaccttaccggg

SEQ ID NO: 197888 - DNA, 654 bp, Homo sapiens
  misc_feature: GYAE6OF02JRGM3.39.81.H04.1.454.CMB.1.raw
  modified_base (181)..(181): a, c, t, g, unknown or other
  misc_feature (181)..(181): n is a, c, g, or t
  modified_base (261)..(261): a, c, t, g, unknown or other
  misc_feature (261)..(261): n is a, c, g, or t
  modified_base (306)..(306): a, c, t, g, unknown or other
  misc_feature (306)..(306): n is a, c, g, or t
  modified_base (315)..(315): a, c, t, g, unknown or other
  misc_feature (315)..(315): n is a, c, g, or t
  modified_base (320)..(320): a, c, t, g, unknown or other
  misc_feature (320)..(320): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacngtctggagctgagatgacgagccgtcgggcctcagtgaggtctcctgcgaagctcgtgtacctaccttacactgtgactntaggtggtcgcgacacggccgtaggacgaggtcgtgacggtaggngtggatggngtcgngcgtactacgtagtcggtacaacgtaacgtaactagtcgacaacgaaccgtacccgtacggacgggacaacggtacgtaccgactaagtaccgaaccaccgtaacgactaacgacaccgtacggaacgacccgaacccggtcaaacgacgtacccgacgtcggaacgtcgtacggacgtacgcgttaaccacgccgaaccggtacgtccgttaagttaaccgttcgacggtcgagacggtaaggtcggtaacggttaattacgggtttacgccggtaccgttaccgttagttccggtacgtacggtacgggcccgtaacgggtacccgttccgg

SEQ ID NO: 197889 - DNA, 665 bp, Homo sapiens
  misc_feature: GYAE6OF02I2OCZ.39.81.H04.1.454.CMB.1.raw
  modified_base (213)..(213): a, c, t, g, unknown or other
  misc_feature (213)..(213): n is a, c, g, or t
  modified_base (252)..(252): a, c, t, g, unknown or other
  misc_feature (252)..(252): n is a, c, g, or t
  modified_base (362)..(362): a, c, t, g, unknown or other
  misc_feature (362)..(362): n is a, c, g, or t
  modified_base (370)..(370): a, c, t, g, unknown or other
  misc_feature (370)..(370): n is a, c, g, or t
  modified_base (444)..(444): a, c, t, g, unknown or other
  misc_feature (444)..(444): n is a, c, g, or t
  modified_base (628)..(628): a, c, t, g, unknown or other
  misc_feature (628)..(628): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttctggtggcagcaacaacaggtgcccatcccaggttcagctggtacagtctggagctgagatgaacgagcctggggcctnagtcgagtctcctgcagcttctgttacactttaccaatnggtactcagttcggtgcgacgacgcccctggacgaggcttaggacgtggagtcgggtaatggtactcgacgcggtacttagtaaactggtactaaccgaactaaacgtanaccggtanaccgaagtaacccgtcccgaagggcgaacgtactaccgtaaccgacttaccgaaccaccgtaaaggcctaaacnccgtaaccgaaccgaccggtacaacccgggtaccctaaacgtaccgtaccggtaacgttcggaagggcttacccgtaaggacagtacctggaaccgtacgaaccgtccgttagttactacgtgtacgacgagtacggacgtaagggtactttaagttcgtacgttacggttaccttgttaccgnggttacctaccgggaccggtaccggtaccggttaccg

SEQ ID NO: 197890 - DNA, 658 bp, Homo sapiens
  misc_feature: GYAE6OF02F9086.39.81.H04.1.454.CMB.1.raw
  modified_base (388)..(388): a, c, t, g, unknown or other
  misc_feature (388)..(388): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagcctggggcctcagtgaaggtcctcctgacaaggtcttctggttacaccgtttaccaactatggtatcaggttggtgcgacacggcccctaggacgaagggtcttggagtggagtgggatggatcgacgtcgtactttaacgagtacggtacaacaacaaacgtatcgaccaacgacgtaacccncggacgggcaggtacgaccacagtcaaccacagaacactacaccgacgacgccgaacgccaacgacgtcggactaggacgacgtccgtagacgtacgtcgtaccggacggaccgtccggggtcgttaacgttacggtttacgtcggtaggtaacgagtaaggtaccgggttaagggtaaacgttttgttacgtaccggttccgttaaccgttttgttaaccggtacggttccgggtacggggtaccgtaaccgggtacccgttaaccggg

SEQ ID NO: 197891 - DNA, 662 bp, Homo sapiens
  misc_feature: GYAE6OF02FSTC9.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtggaaggtctccgtgcaaggcttcgtggttactacctttaccaactatggtatcagttgggtgcgacgacggcccctagggacaagggcttggaggtgggagtggggagtgggatcgaggccgtcttaacaagtcggtcaaccaactaaactagtcgacaacgaagaaccctccgagggacagactcacatgaccacacgacacacaccacgacgccgaaccggtcctaacgagtcggacccgtaggaacggacgccgtagacgtataccgtacggaacggacccgacgggtcctggttaacttcgtaggttcggacggaaggtagtacgggttaacggggtaaattttacggtttacgtaacggttcccggtttaacccttacggttttaccggacgtttcgggttaccggggaccggttaacccggggtacccgttaccgggg

SEQ ID NO: 197892 - DNA, 721 bp, Homo sapiens
  misc_feature: GYAE6OF02JTC60.39.81.H04.1.454.CMB.1.raw
  modified_base (351)..(351): a, c, t, g, unknown or other
  misc_feature (351)..(351): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttcgtggttaccacctttaaccaactatggtatctagttgggtgcgtacgcgcccctaggaccaagggtcttgagtggagtgggatggatcgcgcgcttaacagtgtacgacaanaacctatcgacacgaacgaacctcgaggacagtacgtacaaccagtacgaacccacacgtaacacgtacgtaccctaacggacgtacccgaacggtaccctaacgtacggtacgggtaccgtaggttacggacgtccctaaggaaccgtagtacgtacgaaaccggtaccgtacccgggtcccgttaaggttaccgttaccgttgggtaccggtaacgggaacggttaacggtacgggttaacgggttaaaccttttaggttttacccgggaagttttaccccgggtaaccgtttaccgtttacggggtaacccgtttaacgggttcccgggggtaaccggtaacccgggttaacccccggtttcccggg

SEQ ID NO: 197893 - DNA, 611 bp, Homo sapiens
  misc_feature: GYAE6OF02HLGJP.39.81.H04.1.454.CMB.1.raw
  modified_base (104)..(104): a, c, t, g, unknown or other
  misc_feature (104)..(104): n is a, c, g, or t
  modified_base (193)..(193): a, c, t, g, unknown or other
  misc_feature (193)..(193): n is a, c, g, or t
  modified_base (213)..(213): a, c, t, g, unknown or other
  misc_feature (213)..(213): n is a, c, g, or t
  modified_base (273)..(273): a, c, t, g, unknown or other
  misc_feature (273)..(273): n is a, c, g, or t
  modified_base (332)..(332): a, c, t, g, unknown or other
  misc_feature (332)..(332): n is a, c, g, or t
  modified_base (406)..(406): a, c, t, g, unknown or other
  misc_feature (406)..(406): n is a, c, g, or t
  modified_base (409)..(409): a, c, t, g, unknown or other
  misc_feature (409)..(409): n is a, c, g, or t
tcagtcgcactagtcacgaccggtgctcgatttagtagtgtagattcgcggggacccaaaaaccacacccctccttgggagaatcccctagatcacagctcctnaccatggactggacctggagcatcctttcttggtggcagcaacaacaggtgcccactcccaggttcagctggtacagtctggagctganatgacgaagcctggggcctnaggtgaagtctcctgcaaggcttctggttaccaccgtttaccaatatgtatctagttggncgacaggccccttggacaagggcttgacgtggactgggatggaatcgtagcgtacttanaattcggtacacaactaaactgtcgcaacgtacgaacctccgagggacagtacgtacaccgatgacacagacanacnccgacgagacgaccgaccttacgacgtacggaccgtagtaacgggacgaccttggaacgtgtaccgttaggaaccgaacggaccgggtccgtagttacgtaacgttgtacgagggattaggacgttacgggtaattacgtttcgacgttacgtacccgttgttacggtactaggtccgggtacctacggtaccccgttaggg

SEQ ID NO: 197894 - DNA, 709 bp, Homo sapiens
  misc_feature: GYAE6OF02IQI64.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggccctcagtgaaggtctcctgcaagcttctggttacccattcacctacctttgctctcagtctgggttgccgtaccgaacggccccccgttgggaaccgaacgggtcgtttggacggtgggtagttcggggtttccgtcgtaaccgaaacctaaccaaaacccagttccgaccctaaggaaagttccccgaagggccagtacgacacatcgaaccacagacacactccgaccggactacgacgaccctacgaatacggaactgacgacacgcgtgagtacgtttacgacgtacgaccgaccgtatacggttattaaccgtgtacgggtagtaccggttcttaccgttcggaccctaaaacgttcgtaacgttcggggttaacgaaacggttaaaagggggttttacccggtaacgtttacccgggacgggggtacccgtaaccggggttaaccccggttaccggtacccggtaacccggttacccgtcccgttaacccgg

SEQ ID NO: 197895 - DNA, 710 bp, Homo sapiens
  misc_feature: GYAE6OF02G7SPN.39.81.H04.1.454.CMB.1.raw
  modified_base (457)..(457): a, c, t, g, unknown or other
  misc_feature (457)..(457): n is a, c, g, or t
tcagtcgcactagtcacgaccggtgctcgatttagtagtgtagattcgcggggacccaaaaaccacacccctcttgggagaatcccctagatcacagctcctcaccatggactggacctggagcattccttttcttggtggcagcaacaacaggtcgcccactcccaggttcagctggtacagtctggagctgagatgacgaagtccgtggggcctcgagtaggaacggtctcctgacgaacggtcttcgtacggttacctaacctttaccaacgtataggtactcgtaaggttgggtacgacggtacgtacggcccgttaggaacgtaacgggtcgttaggaggtaggtacgtgggtagtaggtactacgaggtccgtattaacgtaagtcggtaacaactaactaaaccgtatcgaactaacgaacgtaccgtcgaacggacagtactactaacnctaacgaccgacgaacgacctacgactacgaacggtacacccgtaacggcctaacgtagtaccgtacggtaggaacgtacgtaccgagagtactcggaacgtacggacccggtaccggtacgttacgttaacgtcgttacggacgtacgaagtacggttaggtaaggttacgtttagttacgtaccggtacggtttaccgttcgttaaggtaccgtaccgggtacgggtacccgtaaacggttcccggtacgg

SEQ ID NO: 197896 - DNA, 675 bp, Homo sapiens
  misc_feature: GYAE6OF02F28AG.39.81.H04.1.454.CMB.1.raw
  modified_base (363)..(363): a, c, t, g, unknown or other
  misc_feature (363)..(363): n is a, c, g, or t
tcagtcgcactagtcacgaccggtgctcgatttagtagtgtagattcgcggggacccaaaaaccacaccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttcgtggttacaacctttacaacctatggtatcgagttcgggtgcgacacggtcccctggacaagggcttgagtggacttggggatgggattcagcgtcttaacagtggcacgacaaactatcgcaacngaaacctccgaagggcaagagtaccacatcgacaacacgacacgatccgacgacgtacgacggtcctaacgagtcggaaccgttggaacgggagcccgtaggacgtacgtacgttcgaaccggacaccggggacccgttacggtttacttacgtacggtaggttcgaacggtacgtacgggttaaccggggtaaaaagtttcggtttaagttaacccggttaacccggggtttacccgttacggttttacgggtacctttaccggggtaacgggggttaccccggtaacgggtaacccggttaaccccgggg

SEQ ID NO: 197897 - DNA, 653 bp, Homo sapiens
  misc_feature: GYAE6OF02FTP3J.39.81.H04.1.454.CMB.1.raw
  modified_base (353)..(353): a, c, t, g, unknown or other
  misc_feature (353)..(353): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatccagttggtgcgacaggcccctggacaagggcttgagtggagtgggatggatcgagcgtcttaacaagtggtacacaactaaaactntacgcaacacgaaccctccgaagggcagtacgtacaaccatacgaaccacaacgacacactaccacgacgaccgacggacctaacgacgtacgggacccttggaacgggacgtaccgtaggaacgtactcgtacggaaccgaccgaccgggtccgttagtacgtttacgtggtcacggagacggtaggtaacggggtaaatttaacgtttacggtaccgtttaccggttaccctttacggtttacggtacccgtttacgggtaccgggggtacccgtaaccggggtaccccgttaccggg

SEQ ID NO: 197898 - DNA, 640 bp, Homo sapiens
  misc_feature: GYAE6OF02FUL2E.39.81.H04.1.454.CMB.1.raw
  modified_base (263)..(263): a, c, t, g, unknown or other
  misc_feature (263)..(263): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaggtcctctgcaagcttctgtactaccttacaactatgtatcngtcggtgcgacgacggccctaggacgtagggtcttcggagtggagtgggtatggatcgaggccgtacttaacagtcgtcaaaccgaactaaacgtagtcgactaacgacgtaacccgtacggacggacaggactaccactagtacgaaccagacgtaccactactaccgaagcgaccgtccggacctagacgtacggaccctggaaacgtcgacgtagacgtctacgaccgtaacggcgtaccgggtacttatacgttacgtcgaaggcgaaggtaccggtagtacgggttaaatttggttaccgtaacgttacccggttactttacgttacggtacccggtacgggtaccgggacgtaacccgggttactaccggg

SEQ ID NO: 197899 - DNA, 668 bp, Homo sapiens
  misc_feature: GYAE6OF02GHWP9.39.81.H04.1.454.CMB.1.raw
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccagttcagctggtacagtctggagctgagatgacgagcgtgggcctcgagtgaaggtctccgtgacgaggtcttcgttaggttacctacctttaaccaacttatggtatcgtaggttggtcgcgacgaccggccctaggaacgaacggtcgttacggtaggtcggaggtgggtaagtggtactcgaggtcgtacttaataagtcggtacaactaaactaactgtacgactaacaaccgaacccgtcgaacgggtagacgacgtaccaacgacgtaccgaccgaaactaaccgacctaacgaacctaccgaacgtaccgaccgtacccgactacgacgtaccgacgtggaacgtcgcctagactacgtcgacgacgtacgcgtacgttagtagtcgtacgtacgacgagtacgtagggttaacggtaagtttacgttacggtacgtttacccgtcgtttcgttacgacgttaccgggccggaccggtacggtaccgttaccggg

SEQ ID NO: 197900 - DNA, 690 bp, Homo sapiens
  misc_feature: GYAE6OF02HIFGC.39.81.H04.1.454.CMB.1.raw
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtagaacggtctcctgacaaggtcttcgtggttactaccctttaaccaacttagttggtattcgtaggttgggtcgacgacgacggtcccctaggacgtaagggtcgttaggaggtggtagtggggtagtggactcgaggtccgtacttacgaagtcggtacaacaactaaactgtacgactaacgaacgtaaccctaccggaagggacaaggtacgtaccgaacctaacgtaccgaaccctaacgaacgaaccaaccgtaacccgtacccgaacggtaaccgacccgaaccgtacctaacgaacgttcggaaccgttaggacggacgaccgagtacacgtcgacgacgacgacggtcgtacgttatacgtgcgacgagacgtacggtacgggtaatttcggttacgtacgttaccggttaccgtttcgttacggtaccgttacgggtacgggacccggttaacggtacccgg

SEQ ID NO: 197901 - DNA, 680 bp, Homo sapiens
  misc_feature: GYAE6OF02F3NUC.39.81.H04.1.454.CMB.1.raw
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcgagtgaaggtctcctgcaaggcttctggttactacctttaccaactatggtatctagttgggtgacgacaggcccctaggaccgaagggcttggagtggagtggggatggatcaggcgcttaataagtggtaccacaacaaactagtgaccaacacgtaaccctccgagggacaacggagtaccaaccgatacgaacccacaacgaaccaccaactaccgaacggagaccgaccggtacctaacacgtacggacccgtagggaacggacgccgtagaagacgttccgtacggaccgtaaccggacgggtacccttaggttaacctttaacgtggtacggaccgaacgggaaggtaggttaaacgggtaaagttttaacggtttagaccggtttaccggttaccctttactttacgggtaccgttacggtacgggggtaccccgtaacggggtacccctttacggg

SEQ ID NO: 197902 - DNA, 736 bp, Homo sapiens
  misc_feature: GYAE6OF02HBZRE.39.81.H04.1.454.CMB.1.raw
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctgggagctgagatgacgaagccgtggggcctcgagtgaaggtctctgcgaaggtcttcgtcggttacctaccctttaccaactagtggtatcgtaggttgggtgccggacgacggcccctagggacaagggtcgttagaggtggaggtgggagtgggatcgacggtccgtattaacgtaagtcggtaacaaccaaacgtaaacctagtcggacctaaacaaccgtaaccctccggaaggggaccaacggaccgtacaaccgtaagtacgaacccacgaacgtaaccaactaactacccgaacggacgacccgtaccggacctaacgaacgtcggaccgtaggacggacgccgtaggacgtacgtcctacggaccgtaccggacggtccgttagtttacgttacgttgggtccgaaggacgtaaggtacggttaacggggttaaagtttagttttaaccgggtacgttacccggtttaacccgtttacgtttaccggtaacggttaccgggttacccggggtaccggtaccggggttaacccgttacccggg

SEQ ID NO: 197903 - DNA, 648 bp, Homo sapiens
  misc_feature: GYAE6OF02I4Z4Q.39.81.H04.1.454.CMB.1.raw
  modified_base (346)..(346): a, c, t, g, unknown or other
  misc_feature (346)..(346): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaaggcttctggttactaccttacaactatggtatcgagttgggtgcgacgacggccctggacaagggcttgagtggagtggggatgggatcgagcgtcttacaagttggtaccanaactaactatcgactaaccaacgaacctcgagggcaaggatccgaacactcgaaccacgagacaacactaccgaacggacgaccgaaccgggaccctaacgtaccgacggaccgttaggaacggacgtccgtaggaacgtcgtactcgggaaaccgtacggacccggtaccgttacgttacgtttacgtgtacggacgacgggaaggtacgtaacggggtaaatttaacggttttcgaacggtttacggttacccttggtttacgacgttacgggtcggaccggtacgggtacctacccggg

SEQ ID NO: 197904 - DNA, 692 bp, Homo sapiens
  misc_feature: GYAE6OF02JD5DR.39.81.H04.1.454.CMB.1.raw
  modified_base (264)..(264): a, c, t, g, unknown or other
  misc_feature (264)..(264): n is a, c, g, or t
  modified_base (270)..(270): a, c, t, g, unknown or other
  misc_feature (270)..(270): n is a, c, g, or t
  modified_base (276)..(276): a, c, t, g, unknown or other
  misc_feature (276)..(276): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaagcttctggttacaccttacaactatgtatcgngttggngcgacncggccctggacaagggcttagagtggagtgggatggatcgagccgtacttacgaagttcggacctaacaacctaaacgtatcggaccaacgacgtaaaccctccgaaggggccaacggtacgtccaaccgacgtacgaaccacgaacgaaccacctaactacccgaacggaacgccgtaaccggacctaacgagtccggaccttagggaacggtcaccgtagagtacctcgacgaacgaccgtaccgggcgttagttacgttacgtggtacggtacggagtaaccggtagggttaaccgggtaaattttacggtttacgtaaccggtttacccggttaccccgtttagtttaccgggtaacccgtttaccgggtacccggggtaccccggtaacccggggtacccctttaccgggg

SEQ ID NO: 197905 - DNA, 631 bp, Homo sapiens
  misc_feature: GYAE6OF02F217A.39.81.H04.1.454.CMB.1.raw
  modified_base (194)..(194): a, c, t, g, unknown or other
  misc_feature (194)..(194): n is a, c, g, or t
  modified_base (279)..(279): a, c, t, g, unknown or other
  misc_feature (279)..(279): n is a, c, g, or t
  modified_base (400)..(400): a, c, t, g, unknown or other
  misc_feature (400)..(400): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcattccttttcttggtggcagcaaacaacaggtcgccccactccccagttcagctggtacagtctgganctgagatgacgaagccgtgggcctcgagtgaagtcctctgacagtcttcgtgtacctacctttaacacttatgtatcgtgttggngacgacgacgccgtggacgacggtctgaggtggagtgggatggactcgaggtctcgtaacagtcgtacacaagtaactactcgacaacgtacgtaccgacgaggacgacgtacacaaccgntacgaccacacgacacactaccgacgtacgacgaccgtcacgaagtccggacgtggaaccgagtaccgtagacgccttacggaacgtccgaaccgtcggtacctcggttacttactcggacgtacgtgggagtacggttaggtaaaccgtttgttacgtaaccggttcgttaaccgtttcggttaacgcggtttacccggtaggtacccgggttacgtaccggtttccggg

SEQ ID NO: 197906 - DNA, 725 bp, Homo sapiens
  misc_feature: GYAE6OF02H4F9G.39.81.H04.1.454.CMB.1.raw
  modified_base (617)..(617): a, c, t, g, unknown or other
  misc_feature (617)..(617): n is a, c, g, or t
tcagtcgcactagtcacgaccggtgctcgatttagtagtgtagattcgcggggacccaaaaaccacacccctccttgggagaatcccctagatcacagctcctcacatggactggacctggagctacgttccttttcgttggtggcagcaacgacaggtcgacccactcccgaggttccagcgtggtacagtcgtaggagtctaggacgatacgacgaacgccggtgggacctgagtggaagtcctcgtgcgtaggtcttgtacgtaccttacctttaaccaagtagtaggtactcgtaggtcggtgaccgtacggtaccggcccgttaggacgtacggtcggtaggtacgtcggaggtacgggacgtaggatcgacgtacgtagttaacgagttcggaaccgtaactaaccgtataacgtagaccgtaacgaccgtaaccgcggtacgacggtacgacgtaccacgtaactacgaaccgacagtaaccactacgaccgtacgaacgccgacgtacgtacgcggtacgtaccgtacggaggtacccgacgtagtacgactaccggttaacggaccgaacgtcggtacgtagttcgtaaacgtccggtaggtaaccgnggttaacgcggtttaaacggttcgttaacgttaaccgcggtttaaccgttaccgttacgttacgtaccgggtacggtacccgggagtttaacccggtacggttcccgg

SEQ ID NO: 197907 - DNA, 689 bp, Homo sapiens
  misc_feature: GYAE6OF02HP460.39.81.H04.1.454.CMB.1.raw
  modified_base (482)..(482): a, c, t, g, unknown or other
  misc_feature (482)..(482): n is a, c, g, or t
tcagtcgcactagtcacgaccggtgctcgatttagtagtgtagattcgcggggacccaaaaaccacacccctccttgggagaatcccctagatcacagctccctcaccatggactggacctggagcatccttttcttggtggcagcaacaacaggtcgcccactcccaggttcagctggtacagtcgtggagctgagatgacgaagccgtcgggcctcgaggtgaaggtctccgtgacaggtcttcgtacggttaacctaccttaacctaagtagtggttactcgtaggttgggtcgcgtacgccggtcccgtaggaacgtagggtcgttaggaggtaggtacggtggtaagtcggtataccggacgtacgtactttaacgacgttacggtacaaccgtaacgtaaacgtgtacgaacgtaacgaacgtaacccgtcggtaacgggctaaacggacgttaccaccgtagtaccgaacccganaaccggacacgtacgtaccgacggtaccacgtaacggctaacgcgtaccggacgtaggacgacgacggtagtagtacgtacgtaccgaacggtacccgaccggttacgttagtaccgttagtcggagacgagacgtacggtagttacgtagttaccgtcgtacgttaccttgtactacggcggttacggacgtacgggtaccttcgg

SEQ ID NO: 197908 - DNA, 712 bp, Homo sapiens
  misc_feature: GYAE6OF02IEY48.39.81.H04.1.454.CMB.1.raw
  modified_base (332)..(332): a, c, t, g, unknown or other
  misc_feature (332)..(332): n is a, c, g, or t
  modified_base (339)..(339): a, c, t, g, unknown or other
  misc_feature (339)..(339): n is a, c, g, or t
  modified_base (347)..(347): a, c, t, g, unknown or other
  misc_feature (347)..(347): n is a, c, g, or t
  modified_base (355)..(355): a, c, t, g, unknown or other
  misc_feature (355)..(355): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtaggggccttcgagtggtaacggccttccgtgcaaggtcttcgttcggtttacctaccctttaccgaactacttggtatcgtagttgggtgcgtaccgacggcccgttagaacggaggtcgtggngttaggngtgggagngcgtacgngcgtacttacaagtcggtacaactaaccgtaaatacacgtacaaccgacctaccgtaccgtaacgggctaacggtactaccgaaccgtacgtaacggaccaaccggaacgaaccctacctaaccgaaccgaccggtacgaaccggaccggtacctaacgacgtacggtacggcgaacggagtcgagtacacgttccgcgacgtaccggacgttccgtaggttaacgttccttagggcgtagtaacgggtacgtacgggtaacggttaaagtttcggttaccggtacgttttccggtaccctttagttcggtaacggttaccgggtaacgggcccggttaacggtacccgttacccgg

SEQ ID NO: 197909 - DNA, 766 bp, Homo sapiens
  misc_feature: GYAE6OF02I30NS.39.81.H04.1.454.CMB.1.raw
  modified_base (156)..(156): a, c, t, g, unknown or other
  misc_feature (156)..(156): n is a, c, g, or t
  modified_base (400)..(400): a, c, t, g, unknown or other
  misc_feature (400)..(400): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcttggtgcagcaacaacaggtncccactcccaggttcagcctggtacagtctaggagctggagtatcgacgaacgcctcggggccttcaaggtgaacggttctccgtgaccgaaggtcttcgtacggttacctacccttttaccacgttaacgtgtagtacgtaggttcgggtgaccgaaccgtacggacccccttagggaaccgtaagggtcttacggaggttggtaaggtggggtactgggatacgacggtcgtacggtttaanagttacggtcccaaacgtactaaaacttgtcggacctacgaacgtacctaccgagggacttaagcgtaacccacatacggaccaccgaagaaccgactaacctaccgaacgaacgacgaaccggacctacgtaacgacggtaccggcggtacgggaaccgtaccgtaggtaaccgagttaccgacgggaccgttaacccgacgggtcccgtttaaggacgttttaacgcgggttcgaggacgtacggtacggttaacggttaacgtttaggtttaaccggtacggttaacccggttacctttaccgggttttaagacccggttttaccgggacgggtaacccggtaaccggttacccgtaaccggg

SEQ ID NO: 197910 - DNA, 703 bp, Homo sapiens
  misc_feature: GYAE6OF02HTK9Q.39.81.H04.1.454.CMB.1.raw
  modified_base (227)..(227): a, c, t, g, unknown or other
  misc_feature (227)..(227): n is a, c, g, or t
  modified_base (446)..(446): a, c, t, g, unknown or other
  misc_feature (446)..(446): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtcgcccactcccaggttcagctggtacagtctggagctgagatgacgaagccgtgggcctcagtgaaggtcncctgacaggcttcgtaggttacacctttacaacttagtggtatcgtaggttgggtgacgaacgacggaccccgtaggacgaaagggtcttaggaggtggacgtggggatggatcgagcgtcttaacgaagttcggtacctaacaacaaaacgtactagaccgaacaacgtaaaccctaccggagggaccaaggtacgtacaaccaagtacgacccgaanaacgtaaccaacacgtacccaacgtacgaccgaccgacctaacagtacggaacctcggacggtaacgctaggagaacttaccgtcgaacgacgacccgggtaccgtacgtaacgttacgttggacggtcgaaggtaacggacggttaacggggtaaacgtttttacggtttaacggtaccgttaccggttaaccctttcggtttacgtaaccggtaaccgggtacggggtaacccgtaccgggtacccgttaccggg

SEQ ID NO: 197911 - DNA, 725 bp, Homo sapiens
  misc_feature: GYAE6OF02IMXSW.39.81.H04.1.454.CMB.1.raw
  modified_base (387)..(387): a, c, t, g, unknown or other
  misc_feature (387)..(387): n is a, c, g, or t
tcagtcgcactagtcacgaccggtgctcgatttagtagtgtagattcgcgggggacccaaaaaaccacacccctccttgggagaatcccctagatcacagctcctcaccatggactggacctggagcatccttttcttggtggcagcaaacaacaggtgcccactcccaggttcagctggtacagtctggagctgagatgacgaagccgtggggcctcgagtgaaggtctcctgcaaggtcttctggttacctacctttaccgaacttagtggtatcgtaggttgggtcgacgacgcggtccccgtaggacgaggtcttggaggtcggagtaggggattgggatcgacgcgtacttaacgaagtcgggtacaacgtaacaaaacgtnacgtacaacgtacgtaaccctccgaagggcacggaacgtacctaaccgactacgaacctaacgaacgaacaacgtcctaaccgaaccgtacgaacccggaaccgtcctaaaccgtggtaacggacctacgggacgtacgtacgtaaggtacgtacgtacgtacggaaacgaccgggtaccggtcgttaacgtttaactccggtacggtggaccggtaaggtacgtacgggttacgggtaaacttttggtttaaccgacggtttacccgttaccgtttaaccggttacgtaaccggttaggggtcccggggaccgttacccgggtaccggttacccggg

SEQ ID NO: 197912 - DNA, 729 bp, Homo sapiens
  misc_feature: GYAE6OF02I2CHE.39.81.H04.1.454.CMB.1.raw
  modified_base (544)..(544): a, c, t, g, unknown or other
  misc_feature (544)..(544): n is a, c, g, or t
tcagtcgcactagtcacgaccggtgctcgatttagtagtgtagattcgcgggggacccaaaaaaccacacccctccttgggagaatcccctagatcacagctcctcaccatggactggacctggagcattccttttcttggtggcagcaacaacaggtcgcccactcccaggttcagctggtacagtctggagctgagatgacgacgcgtcgggctcgagtagaacggttcctccttacgaaggtcttcgtacggttactacctttacaacttagtgtatcgtaggttcgggtacgcggacgtaccggtcccgtaggaaccgaagggtcgttggaggtagggtaagtgggtaagtcggacgttcgacgtcgtacgttaacgaagtttcggaccaactaacgaaattcggacgacctaacgaaccgtaaacctccgggaaggtacgaacggtactaaccaaccgtaagaccgaaccgaactaagaaccacgtacaccgaacggacgtaccgaccgtactacgacgtacgacggtacgacggtacncgtagactacgacgtacggaaacgtccggtacgggtaccgtttagtaacgttcgtacgtcggacgtagaacggttaagttacgggaattttaccgggttcggtaaaccggtttcggttaccctttaacggtctaaccgggtttccggtacgggttacccgtaacgggttcccgtaggttccccgg

SEQ ID NO: 197913 - DNA, 646 bp, Homo sapiens
  misc_feature: GYAE6OF02IRAFF.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtgggcctcgagtgaaggtctctgcaagcttcgtagtacaccgttacaactctggtatctagttgggtgcgacacggccctggacgaacgggtcttaggacgtaggagtacggggtatggagtcaggtccgcttaacgagtcggtcaacacgaaactagtgactacgaacgtaaccctcgacgggtacaacggtaacgtccaacgaactccgaaactaccgaacgaactacgactaacccgacgacgaccgaacgtcctaacgacgtacggaccgtaaggacggcgaccgttgacgtagtccgtagaccgtaacgccggtacgtcgtacgttacgtgtacgagacgtaggagtaccgggtaattacggtttcgaacgttcggttaccttacgtacgttaaccggtacggtacccgggtacggtaaccggtaccgttaccgg

SEQ ID NO: 197914 - DNA, 562 bp, Homo sapiens
  misc_feature: GYAE6OF02GC56S.39.81.H04.1.454.CMB.1.raw
  modified_base (409)..(409): a, c, t, g, unknown or other
  misc_feature (409)..(409): n is a, c, g, or t
  modified_base (434)..(434): a, c, t, g, unknown or other
  misc_feature (434)..(434): n is a, c, g, or t
  modified_base (440)..(441): a, c, t, g, unknown or other
  misc_feature (440)..(441): n is a, c, g, or t
  modified_base (472)..(472): a, c, t, g, unknown or other
  misc_feature (472)..(472): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactccccaggttcagctggtacagtctggagctgagatgacgaagcctggggcctcagtgaaggtctcctgcaaggcttctggttacacctttaccaactatggtatcagttgggtgcgacaggccccctggacaagggcttgagtggatgggatggatcagcgcttacaatggtcacacgaaaactatgacaactagaaaccctccaaggggcaaggtagtcaaccgatgacctacagacacatcacgngcacggcctacgatggacctgagancctgannctgacacacggcctggtattactgtagcganagagtccgggaaattagttttgaacttacggtacccgttacgttagtaaccgttaccggttaggggaccctacggggaacccttaccggg

SEQ ID NO: 197915 - DNA, 708 bp, Homo sapiens
  misc_feature: GYAE6OF02FJ0SY.39.81.H04.1.454.CMB.1.raw
  modified_base (358)..(358): a, c, t, g, unknown or other
  misc_feature (358)..(358): n is a, c, g, or t
tcagtcgcactagtcacgaccggtgctcgatttagtagtgtagattcgcggggacccaaaaaaccacacccctccttgggagaatcccctagatcacagctcctcacccatggactggacctggagcatccttttcttggtggcagcaacaacaggtgcccactcccaggttcagctggtacagtcgtggagctgagatgacgaagcctggggcctcagtgaaggtctcctgcaaggcttgtggttacaccttttaccaactatggtatcgaggtttggtgcgacaggcccctggacaagggcgttgacgtggatgggataggtatcgagcgtcttagaacgtggtacacacaaactntcgacacgtacgaacctcgacgggcacgtacgtacaccactacgaacccaacgacgaccgtaacaacgtaccgaacggacggtaccgaccgggtaccctaacgaaggttaccggtaaccgttagaacgggacgtaccgtcggaacgtacgtcgtacgaaccggaccgtaccgggtaccgtttgtaacgtttacctacgggtcgtaacggacgtaacggtacgggttacgggggtaaactttacggttttaacggtaccgtttaccgggttaaccccgtttcgtttaccgggttacctttaaacccgggtacgggggaacccccgttaacgggtaaccccgttacccgggg

SEQ ID NO: 197916 - DNA, 670 bp, Homo sapiens
  misc_feature: GYAE6OF02HIWO8.39.81.H04.1.454.CMB.1.raw
  modified_base (351)..(351): a, c, t, g, unknown or other
  misc_feature (351)..(351): n is a, c, g, or t
  modified_base (365)..(365): a, c, t, g, unknown or other
  misc_feature (365)..(365): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatcctttcttggtggcagcaacaacaggtgcccactcccaggttcagctggtacagtctggagctgagatgacgaagccgtggggcctcgagtgaaggtctctgcaaggcttcgtgttactaccttaccaactatcggtatcgtagttgggtcgcgacacggcccctgggacgaagggtctgagtggagtggatgagcagctactacatgtacacgaactaactangacacgaccgaacnccgtaggcgaacgacgtacacatacgaccaacagaaccacgtactaccgacgaacgcgtaccggcctaacgacgtcggtaacccgtaggacgtacgaccgtagaacgtcgtacggtcggacgtaccggaccggtacggtacgttacgttacgtacggttacgacggtaacgtaggacggttaacggggttaaacgtttcggttttaacggttacccggtttaacccggtttaacccgtttcggtttaccgtaaccggttaccggggtacccggggtaacccggtaccggggtacccgttaccggg

SEQ ID NO: 197917 - DNA, 747 bp, Homo sapiens
  misc_feature: GYAE6OF02HYUG5.39.81.H04.1.454.CMB.1.raw
  modified_base (160)..(160): a, c, t, g, unknown or other
  misc_feature (160)..(160): n is a, c, g, or t
  modified_base (184)..(184): a, c, t, g, unknown or other
  misc_feature (184)..(184): n is a, c, g, or t
  modified_base (404)..(404): a, c, t, g, unknown or other
  misc_feature (404)..(404): n is a, c, g, or t
  modified_base (614)..(614): a, c, t, g, unknown or other
  misc_feature (614)..(614): n is a, c, g, or t
tcagtcgcactagtcacgaccggtgctcgatttagtagtgtagattcgcggggacccaaaaaccacacccctcttgggagaatcccctagatcacagcctcctcaccatggactggacctggagcattccttttcttgggtggcagcaacaacagggtcncccactccaggttcagctggtacngtcgtggagctggagatcggacgagcccgtggggcctcgaggtaggacggtctcgtcggaccgtaaggtcctttacggtacggttaacctaacccgttttaaccaagttacggttaggttactaccggttagggtttgggtcgacgacgtaccggtcccgtaggacggtaggtcgttaggaggtcggagtaggtagtcggatacgcggtactacgttaangttacggactaaccgaactaagtctcgaccaacgtacaacgtcggaggactacgtacgtaccacgagtccggaacacgtacaacgtacacctaccgacgggaccaccggtacctaaccaacgtccggaacggtacccaggggaaacggccctagggtagtaatccgtacggacgtacccggacgtacggtcccgtttaagtacccgttancgggtacgaccgtagacgggtaccggttaacgggtttaattccgtttaagggtcccgttaccgttacccggtttagttacccggtaacggtaccccggttaggggaaccccgtttcgggacccgtttacccgg

SEQ ID NO: 197918 - DNA, 611 bp, Homo sapiens
  misc_feature: GYAE6OF02FNQAI.39.81.H04.1.454.CMB.1.raw
  modified_base (258)..(258): a, c, t, g, unknown or other
  misc_feature (258)..(258): n is a, c, g, or t
  modified_base (274)..(274): a, c, t, g, unknown or other
  misc_feature (274)..(274): n is a, c, g, or t
  modified_base (303)..(303): a, c, t, g, unknown or other
  misc_feature (303)..(303): n is a, c, g, or t
  modified_base (325)..(325): a, c, t, g, unknown or other
  misc_feature (325)..(325): n is a, c, g, or t
  modified_base (393)..(393): a, c, t, g, unknown or other
  misc_feature (393)..(393): n is a, c, g, or t
  modified_base (515)..(515): a, c, t, g, unknown or other
  misc_feature (515)..(515): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttactacctttacactntggtatcgaggttggngcgacgacggcccctaggacagggcttgngtggagtgggatggatcaggcnttacagttggtacacaactaactgtacgacacgacgaacctcgagggcagctacacatcgaccacganacacataccgacgacgccgacggcctaacgagtacggaccgtaggacgacgtaccgttaggacgtaaccgttccgtaaggacccggaacggtacccgggtacggtttacgtacgtttaccgnggttacggacgtagacggtaggtaacgggtaatttacggttagacgttacgttaccttgttacgacgttacggtcgggactaccgggtcctaccgg

SEQ ID NO: 197919 - DNA, 723 bp, Homo sapiens
  misc_feature: GYAE6OF02IX0Y8.39.81.H04.1.454.CMB.1.raw
  modified_base (149)..(149): a, c, t, g, unknown or other
  misc_feature (149)..(149): n is a, c, g, or t
  modified_base (271)..(271): a, c, t, g, unknown or other
  misc_feature (271)..(271): n is a, c, g, or t
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaanaacaggtgcccactcccaggttcagctggtacagtctggagctgagatgacgaagcctggggcctcagtgagtctctgcaggtcttcgtgtaccactttaccaatatggtatcgtagttggngtcgacgacggtcccgtaggacgtaacgggtcttaggacggtggacgtgggtacgtggacgtcgacgtcgtacttaacgaagtggtacaacaacctaaacgttagtaccgacgaacgtaacgaacccgtacgggacgacgtaggtaccgtacgaacctaacgtaccgaaccaacgacgtaaccgactaacctaccgtaacggaccgacgaccgtacacgtaccgtacggacgttacgagggtaccgcgtaaggcctaggccgtaacgggaaccgtaccgggtacgggttacctaggtttacctacggttacggcggtaagggaacgtagttaaccggttagggttaaacgttttacggtttaccgtaaccggttttacccggtttaacctttccggtttaaccggaccggttaacccgggtccggggtaaacccgttaccgggttaccccgg

SEQ ID NO: 197920 - DNA, 831 bp, Homo sapiens
  misc_feature: GYAE6OF02F246N.39.81.H04.1.454.CMB.1.raw
  modified_base (189)..(189): a, c, t, g, unknown or other
  misc_feature (189)..(189): n is a, c, g, or t
  modified_base (216)..(216): a, c, t, g, unknown or other
  misc_feature (216)..(216): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttctggtggcagcaacaacaggtcgcccactcccaggttcagctggtacagtctggngctgagatgacgacgtccgtgggctcngtagaaggtctctgacaggtcttcgtaggttactacctttaccaacgttatggtacttaccgtaggtttgggtacgccgtaaccgtacgggtacccccgttagggaacccgtaaaagggggttccttagggtacgggttacgggtaagttacgggggtaatacgggtaacttacggtaaccggtacgtaacccgtttaaacgtacgggttacgggttacccaaaccgtaacccggttaaaaattaccggtacggtaccccgaacgtaaacccgggtaacccgttcggaaaccggggactacgggtaaccggttacccaaacggtaacgttacccgtaaacccggaacaacggtaacccgtaactaaccgttacccgaaccgaacccgtaccgaaccggttacccgtaacgtaacggttaccggaaccggtcgtaaacggcgtaccggtagtaaccgacgtccgaacgtaccgaccggtaccggtacgttacgtaacgtttcgtacggttacgacggtagacggtacgtacgggttaacttcgttaccgtacggttaccgttacccgttacgttaccgtaccggttaggcccggtaacggtacggtacccgtccgg

SEQ ID NO: 197921 - DNA, 672 bp, Homo sapiens
  misc_feature: GYAE6OF02I4FC6.39.81.H04.1.454.CMB.1.raw
  modified_base (375)..(375): a, c, t, g, unknown or other
  misc_feature (375)..(375): n is a, c, g, or t
  modified_base (414)..(414): a, c, t, g, unknown or other
  misc_feature (414)..(414): n is a, c, g, or t
  modified_base (422)..(422): a, c, t, g, unknown or other
  misc_feature (422)..(422): n is a, c, g, or t
  modified_base (485)..(485): a, c, t, g, unknown or other
  misc_feature (485)..(485): n is a, c, g, or t
tcagtcgcactagtcacgaccggtgctcgatttagtagtgtagattcgcgggggacccaaaaaccacaccccgtccttgggacgaatcccctagatcacagctcctcaccatggactggacctggagcatccttttctggtggcagcaacaacaggtgcccactcccaggttcagctggtacagtctggagctgagatgacgaagcctggggccctgagtgaaggtctcctgcaaggcttctggtacacctttacaactatcggtatcgaggttggtgccgtaacgacggtccccgtaggaccgaagggtcttggaggttcggagttgggagtggattcgaggtcgtactttacgatcggtacaacgacaaactntacggactacgacgaacctcgaagggacagactcgaacntcaccganacgacacactaccgacgacgcgaccgaccgtacacgtacggaccgtaggacggacgaccgagngaacgtccgtaacgaaccggaccgtaccgggtccgttacggttaacttccggtaacgtcggacggtaacggtaggtacggttaagggtaaccgttacgttttaccggacggtttacccggttaacccgtttcgtttaacgtaccggttaccgtaccgggtaccggtaaccggtaccccgttaacggg

SEQ ID NO: 197922 - DNA, 711 bp, Homo sapiens
  misc_feature: GYAE6OF02JP390.39.81.H04.1.454.CMB.1.raw
  modified_base (193)..(193): a, c, t, g, unknown or other
  misc_feature (193)..(193): n is a, c, g, or t
  modified_base (202)..(202): a, c, t, g, unknown or other
  misc_feature (202)..(202): n is a, c, g, or t
  modified_base (226)..(226): a, c, t, g, unknown or other
  misc_feature (226)..(226): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctgtacagtctggagctganatgaagacncgtcggctcgagagacgtcctcgngacgtagtcttcgtacgtaccttacctactaatagttcgtatgtaggttggcgtacgacgtaccgtccgtacgaagacggtgtaggacgttaggtaggtaggtagtaggtacgtacgtccggggacttaccgtaaacgtggtacggtacctaacaaacgtaacttaggcacgaacgtaaccgtaaccgacggtacggaacacggacgtacctacgtacgtaacgaaccgaacgacgaacgactacgaccccgaagccggaacgaccggtacctaacgtacggtaccgtacggtacggacggtaccgtcgtacgaagtcgtaaccggtacggaaccgtaccggaccggtaccgttaagtactacgttggacgacggtaagtaggacgggttaacgttacggttaacgtttaccggtaacggtccgtttaaccgtttcgttaacgtacgtaccgggtaccggaccgggttaccggtaaccggttccg

SEQ ID NO: 197923 - DNA, 682 bp, Homo sapiens
  misc_feature: GYAE6OF02FWR2L.39.81.H04.1.454.CMB.1.raw
  modified_base (358)..(358): a, c, t, g, unknown or other
  misc_feature (358)..(358): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtgcagcaacaacaggtgcccactcccaggttcagctggtacagtctggagctgagatgacgagccgtggggcctcagtgaaggtctcctgcaggtctctggttacacctttaccaactatggtatcgagttgggtgcgacgacggcccctggacgaacgggtcttggagtggagtgggatggatcaggccgtacttacaagtcggtacacaacaaactntgaccacacgaacctacggaggacgagacgtccaacgtactacgaccacgacgacactactacccgaacgacgacgacccggacctaacgacgtacggaccgtaggaacggtcgaccgtagacgtacttcggacgtaccggaaccgaccgggtaccggttacgttaacgtttacgtaggtacggagggaacgtacggtagggttaccggggttaaagttttacggtttacgttaacggttacccggtttaacccctttcggttttaccggtaccgttaaccgggttccggggaacccggttaccggggtacccgtttacccggg

SEQ ID NO: 197924 - DNA, 609 bp, Homo sapiens
  misc_feature: GYAE6OF02HMDY1.39.81.H04.1.454.CMB.1.raw
  modified_base (343)..(343): a, c, t, g, unknown or other
  misc_feature (343)..(343): n is a, c, g, or t
  modified_base (382)..(382): a, c, t, g, unknown or other
  misc_feature (382)..(382): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacagcccctggacaagggcttgagtggatgggatggatcagcgcttacaatggtacacacaaactntgcacagaacctccgagggcagacgtcaccatgacccanacgacacataccacgagcacggcctaacatcggacctggaacggctcccaggacgtatccgtcggaaccgaccgaccgggccgttaggtaacgttttacgtcgggtacgacggtagacgggtacgttacggggtaaatttacgttttcggaacgtttccggttaaccccgtttcgtttaggtacccgttaggttaccgggggtacctaccggggtaacccctacggg

SEQ ID NO: 197925 - DNA, 726 bp, Homo sapiens
  misc_feature: GYAE6OF02HK1E6.39.81.H04.1.454.CMB.1.raw
  modified_base (399)..(399): a, c, t, g, unknown or other
  misc_feature (399)..(399): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtcgcccactcccaggttcagctggtacagtcgtggagctgagatgaacgagccgtgggcctcagtgaaggtctcctgacgacgtcttcgtacggttaacctaccgtttaccaattagtaggttactccgtaggttgggtcgacgaccgacggtcccctagggaaccgagggtcttaggaggtgggtagtcggggattggatcggacgcgtactagtagtcggtaacaactaactaacgtacgtanaccgaacgaacgtacccgacggaacgggacgtaagaaccgtaccaactacggtaaccaaccgacgaaccgtaacaaccgtaccgtaccgaaccggaaccgtaccggtaaccggaaccctttacgaaaccggttcggaaccggtacggaacggccgtacctaggactcgtacgtacggaccggacgtaccgggtgtttagtaaccgttagtaggtacggaacgaggtaacgggtacgttaacgggttaattttacggtacgtaccgttacgtttacccgttagtacgtaccgggtaggtaccgggtaaccggtccggtaccgtaccgg

SEQ ID NO: 197926 - DNA, 567 bp, Homo sapiens
  misc_feature: GYAE6OF02G1WC8.39.81.H04.1.454.CMB.1.raw
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcgagcgcttacaatcggtcacacaaactatcgcacagaacctccgagggcagacgtcaccatcgacccacacgacacactccaacgagcaccggcctacacgtcggacgtggaggacgcctagacgatctgaccgacgacggtccgtagtacttactgtcgacgagacgtagtacgggtaattgtttagacgttcggttaccttcgtttacgtaccgttacggtcgggaccgtacgggtaccgttacggg

SEQ ID NO: 197927 - DNA, 944 bp, Homo sapiens
  misc_feature: GYAE6OF02JQWAZ.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgccactccaggttcagctggtacagtctggagctgagatgacgacgtccgtgggcctcgaggtagaacggtctccgtgacgtaggtcttcgtacggttacctacctttaaccaacgttagtaggttactacgtggtttggggtcacggtacgacgggtccccctaggaccggtaacgggttctttacggaccggttagggtaggtaccggggtaagttcggggtaacctacggtaccggtaccggttaccgttaaacgtaacggttcccgggttaacccaaaccggtaaaccgttaaaaccgtttacggtaaccggtaacccgtaaacccgtaaccggttaaacccccggttaccggaaccggggtacgtaaccggttaaaggtacccgtaaaccgttacggtaaacccggaaacccgaaccgggtaaccgtaaaccctaacccgtttaaacccgtacccggtaacggaacccggaccggtaaccccggaccggttaacctagggttaccccgggtaacggtaccgggtaacggttaacccggccgtttaacgggtaaccgtacgttaacccggtacggacccggtaaaccgggtacccggtacggttaaccgttaacggtttaccgtacggtacccggtaaacgtacgggaacggttaccggtaacggggggttaaacctttaacggttacccggttaaggtacccggtttaacccgtttacgttacccggtaacccgttacggggtacccggtaaccgggtacccgggttaacccgggttacccgg

SEQ ID NO: 197928 - DNA, 816 bp, Homo sapiens
  misc_feature: GYAE6OF02IDA6C.39.81.H04.1.454.CMB.1.raw
  modified_base (568)..(568): a, c, t, g, unknown or other
  misc_feature (568)..(568): n is a, c, g, or t
  modified_base (678)..(678): a, c, t, g, unknown or other
  misc_feature (678)..(678): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagacaacaacaggtgacccactcccaggttcagctggtacagtctggacgctaggagatggacgagccgtgggggtcctacgaggtacggaagggttccttacccgttagaccgtaacggttcccttttaccgttacgggtttaaccccttaaacccctttttaaccccgaaaacgttaacgtttacggggttaacttaccggtaacgggttttgggggtaccggaaccggtaacccggtaacccggggtccccccgttaacgggggtaaccggtaaacgggggttccgttttaggaacggggttaggggtaacgggtcggggggacgtttacgggactaccggtaccggtcggttaccgtttaaacgtaacgtacgggtaccgtaaaccaaaccgtaaacttagacgtaccacgaaccgtaaccncgtacgggactaggactaccactaagtaccgaccaatacgaactacacgaccaacggacgccgacgtaccagtaacgtacgacgtagacgggacctcgtacgaagttacncgtaacgtcgaccgtacggtcgttagttacgttagtggtacgagtacggtagtacggtaacggtacgtttagttaccgtaacgtcgttaccttagttacgtacggtaccggtacggtacccggtaggtacccgtaccg

SEQ ID NO: 197929 - DNA, 807 bp, Homo sapiens
  misc_feature: GYAE6OF02HTXVF.39.81.H04.1.454.CMB.1.raw
  modified_base (157)..(157): a, c, t, g, unknown or other
  misc_feature (157)..(157): n is a, c, g, or t
  modified_base (181)..(181): a, c, t, g, unknown or other
  misc_feature (181)..(181): n is a, c, g, or t
  modified_base (373)..(373): a, c, t, g, unknown or other
  misc_feature (373)..(373): n is a, c, g, or t
tcagtcgcactagtcacgaccggtgctcgatttagtagtgtagattcgcggggcccctagatcacagctcctcaccatggactggacctgagcatccttttctggtaggcagcaacaacaggtcgcccatcccaggttcagctggtacagtctgganctgagatgacgagccgtgggcctnagtgaggtctcctgcaggcttcgtaggttacaccgtttaccaatgtacggtaatccgtaaggttggacgccgtacgaccggcccctagggaaccgaagggtccttagaggtaggagtggggatgggtactacgacgggttcctacgtttaaacacggttcggtacctaaccgaaacctaaaccttggtaacnccgaaaacgtacgttaaaccccacggtaaggggtaccaaaggtccgtttacccaacgttacgaccggaaccaacacggaaccacgtaacctacccgacggaccgacgtacccggttaccaagtaccgtcggtaaccgtcggtaacgggtaccgtcgttaacggaactacgtccgtaacggaacccgacggtaccggttaccggtaaacgttacggtttaaccgcgggttaacgacgggttaacggaacgggttacccggttaaggggttaaacgtttacgttttacggtaaccgtttcccgggttacctttaccgttaacggtaccggtttaaccggtccggggttaaccgtacccgggttaacccggtacggttacccccggtagttaaccccggttccgtaacccggtaccggttacccccggtaacccggg

SEQ ID NO: 197930 - DNA, 712 bp, Homo sapiens
  misc_feature: GYAE6OF02I3XLU.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaagtctcctgcaaggcttcgtgtactacctttaccaactatgtatcaggttggtgcgacacggccctggacaaggcttagagtggagtgggatggatcgagcgtactacgagtcggtacaactaacgtaaatgtagacctaacgaacgacccgtaccgaagggactaaggacgtaccaacgtacgtacgaacccgtacaaccggtacaaaccgaccgtaccgaaccggtacgacccgtaccggacctaacgtacgtaccggaccgtaacggacggtaccgaccgtacggaaagtcctaccgtaccggtaacgacccgttaccgggtaccgttaggttaacgttaccgttacggaccggtaacggtaaggtaacggttacggttaacggggtaatttacgggtttaacggtaccgtttaccgttaacccgtttacgttacggtacccgttaaaccggtccggggtaacccgtaacggggtacccgttaccggg

SEQ ID NO: 197931 - DNA, 726 bp, Homo sapiens
  misc_feature: GYAE6OF02FTDU0.39.81.H04.1.454.CMB.1.raw
  modified_base (336)..(336): a, c, t, g, unknown or other
  misc_feature (336)..(336): n is a, c, g, or t
  modified_base (343)..(343): a, c, t, g, unknown or other
  misc_feature (343)..(343): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaggcttctgttacacctttacactatgtatcagttgggtgcgacaggcccctggacaagggcttgagtggatgggatggatcagcgctacatggtcacacaaactngacacanaacctcgaaggcagagtcaccatcgaaccacgacgaaccactaactcccgaacgaacgtaccgaaccggtacctaacgacgttacgggaccccgttagggaacggggtacgtaccccgttagaacgggtaacttaccggtacgggtaacccgggaaccgtaacccggggtcccggttacgggtttaacgttttaacccggttaggttacggtaccggaacgggtaagggtaacggggtttaacgggggaaaagtttttacggttttaaccggttaaacccgggtttccgggtttaaccccttttacggttttacggtaacccggtttaaccgggttacccgggggtacccggttaacccgggggtaacccggtttaccccggg

SEQ ID NO: 197932 - DNA, 762 bp, Homo sapiens
  misc_feature: GYAE6OF02GJLYR.39.81.H04.1.454.CMB.1.raw
  modified_base (326)..(326): a, c, t, g, unknown or other
  misc_feature (326)..(326): n is a, c, g, or t
  modified_base (366)..(366): a, c, t, g, unknown or other
  misc_feature (366)..(366): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgagccgtgggcctcagtgaggtctcctgcaggcttcgtaggttaccaccttaaccactagtggtatctaggttggtgcgacgacggccctggacgaggtcgttggagtggagtggagtcggatacgngtcgtcttaacgtagtacggtacaacgtaactaaacgtanacggactaaccgaaccgtaacccgtaccgggaacggtacgaacggtaccgtacccaacgtaccgtaccgaacccaacgtaacgacctaacgtaaccctaccgaaccggaccgaaccgacccggtaccaacggtaacgtaccggtaccggtaggaacggtaccgtacgtacggtaacgtcgttaccggtaccggaccggtaaccggtaccgggtccgttaacggttaaccgtttaacggtcggtaacggaacggtagggttaacggtagggttaacgggttaacgttttaacgggttacggttaaccgggttaccgtttacccggtttacggttaccgtaacgggttcccggggtaaccggggttaacccgggtaaccggtacccggtttacccggg

SEQ ID NO: 197933 - DNA, 674 bp, Homo sapiens
  misc_feature: GYAE6OF02IUMU4.39.81.H04.1.454.CMB.1.raw
  modified_base (280)..(280): a, c, t, g, unknown or other
  misc_feature (280)..(280): n is a, c, g, or t
  modified_base (466)..(466): a, c, t, g, unknown or other
  misc_feature (466)..(466): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgagccgtggggcctcagtgaaggtctcctgcaaggcttcgtcggttaccacctttaccaactagtggtatcgaggttggngcgacacggtcccctaggacgaagggtccttaggaggtggagtaggggatacgggatcgagccgtcttaacaagtggtacaacaactaaacgtactcggacctaacgaacgaacccctacggaggacaaggtacgtaccacgatacgaaccacgagaccacactaccacgacgccacggacctaanacgtcgaacctggacggacgctaggacacgtcacgacgacgaccggtctagttaactcgtggtacgacgtaggtaacgagggttaaccgggttaatttaccggtttacggaaccgtttacccggtttaacccgttaggttttaacccgaccgggtttaaccgggtaccggggttaacccggtaaaccggggttaaccccgttaccggg

SEQ ID NO: 197934 - DNA, 829 bp, Homo sapiens
  misc_feature: GYAE6OF02GFS8U.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttctggtggcagcaacaacaggtgcccactcccaggttcagctggtacagtctgggatctgagtagtgaacgacgtccggtcgggcctacgtaggtacggtaacgtcctaccgtcgacgtaacggttccttcgttacgttaccttaaccctttaccgaacgttagtcgtatacggtaggttggtcgacgtacggtcccggtccgtaggaacggtacggtcgttaggtcggtaggtaggtacggggtagtacggtactacggacggtccgttaaccgttaacgacggttaccgtaccaacccgtaaaataaccgttcgtaccgtaaccgaaacgtaacccgggaacccttaccggggacgggtaaccgtacggtaaccgtaacccctaacggtaaccgtaacccgtaaaccccaaccggaacctaacccgtaacctaaccccgtaccggaacccggaccgaacccggaccccggttaccctaaagggtccgtaacccggtacgttaacgggacgtacccgtcggtagaacgtctaccggcgtaacccgacggtacccggtagtttactacgttcgtgttacggaaggtacgttacggtaacggggtaacgttaagttttcgttacggtaaccggttccgtttaccgtttacgtacgtaccgtacggggtcggtaacccggtacccggtcggttaacccg

SEQ ID NO: 197935 - DNA, 710 bp, Homo sapiens
  misc_feature: GYAE6OF02G4UKU.39.81.H04.1.454.CMB.1.raw
tcagtcgcactagtcacgaccggtgctcgatttagtagtgtagattcgcgggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcgagtgaaggtctcctgcaaggtcttcgtggttacctacctttacaactatggtatcgaggttgggtgccgtacgacggtcccctaggacgaaggggtccttaggacgtgggagtgggactggatcgaggccgtacttaacgaagtcggttacaacctaacgtaaaactagtagacctaacacggtaaccctaccggacggacgaaggtacgtaccaaccgtagacggaacctacgaacgaccaacactacccgaacggaacgtaccggaaccggacctaacgtacgtacggaacctaggacggtaccgccgtagacgtacgtacgtacgtaaccgacgacccggtacgtagtttaaccttaacgtcggtacggaccgtaggtaacggtacggttaacggggtaactttaagttttaccggacggttaccgttaccccgtttgtttaaccggtaccgttacgggtacccggggtaccgaccggggttaccctaccggg

SEQ ID NO: 197936 - DNA, 693 bp, Homo sapiens
  misc_feature: GYAE6OF02GN3GC.39.81.H04.1.454.CMB.1.raw
  modified_base (230)..(230): a, c, t, g, unknown or other
  misc_feature (230)..(230): n is a, c, g, or t
  modified_base (252)..(252): a, c, t, g, unknown or other
  misc_feature (252)..(252): n is a, c, g, or t
  modified_base (266)..(266): a, c, t, g, unknown or other
  misc_feature (266)..(266): n is a, c, g, or t
  modified_base (508)..(508): a, c, t, g, unknown or other
  misc_feature (508)..(508): n is a, c, g, or t
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactccaggttcagctggtacagtctggagctagagatggacgaagccgtgggcctcagtgagtctctganagcttctgttacacttacaatnggtatgtagttggngcgacacggcccgtaggactagggcttagagtggagtgggatggatcgacggtcacttaagagtggtacaacgtaactaacgttacgtacgacgtaacgaccgtacctacgggaacggtcgaacgtaacggtccaaccgtagtacgtaacccaacgtaacggacctaacgtacttaccccggaaggtaccgacccgaccggtaccctaacgtacgtacggttacccgtaggaaccgggtacnccggtagtagaccgtacgaccgaacggtaccgtaccgggtaccgttacgttaacgttcgtacggttcgaacgggtaggaccggtagggttaacgggtaaaacttttcgggttaacgtccgttaaccggtttaccctggtttacggtaagggttcccgggacgggtacccgtaaccggggtacccg

SEQ ID NO: 197937 - DNA, 638 bp, Homo sapiens
  misc_feature: GYAE6OF02HLZKU.39.81.H04.1.454.CMB.1.raw
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtctcctgcaaggcttctggttacacctttacaactatggtatcagttggtgcgacgaggcccctggacaagggcttgagtggagtgggatggatcgagcgtacttacgaagtggtcaacgaactaaaactagtacgacaacgtaacgaaacccgtccgaagggtcgaaggtaacgtaccaacccgagttacggaacccaacgtaacgaacctaacgtacttacccgaaacggacgaccgaaccgggtacctacgaacgtacggacctaggtacggacgtccgtagacgtactacgtagaccgtacgaccggtacgtagttattacgtgtacgacgagtagagtaacgggtaattacgtttacgacgttcgtaccgttgttacgtacgttacggtacggtacgacggtacccgg

SEQ ID NO: 197938 - DNA, 726 bp, Homo sapiens
  misc_feature: GYAE6OF02FU02T.39.81.H04.1.454.CMB.1.raw
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtcctctgcaaggcttctggttacacctttaccaactatggtatcgtaggttgggtgcgacacggtcccctaggaacgaagggtcttaggaggtggagtggggatgggactcgagccgtacttacgaagttcggtacaacgaacctaaactgtacgaccaacgaacgtaaccccgtcggacgggacaacggtacgtacccaacctaagtaccgaaccctaacgaacgacactaacacccgaacgacgccggaaccggacctaacgacgtacggaccgtaggaacggacggtaccgtaggaacgtacgttaccgtaacgggaaccgtaaccggtacccgggtcgttaacgttaacgttaccgtggtaacggcgtaaggacggttacgggtaacggggtaaattttacggttacgtaaccgttacccggtttacccttacggtttacggtacccggtttaacccggggtacgggaacccccggttaacgggtaccccgttccggg

SEQ ID NO: 197939 - DNA, 761 bp, Homo sapiens
  misc_feature: GYAE6OF02JS7OG.39.81.H04.1.454.CMB.1.raw
  modified_base (212)..(212): a, c, t, g, unknown or other
  misc_feature (212)..(212): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgagcctgggcctnagtgaggtctacctgcaggcttctggttactaccttaccaactgtggtatcgtaggttggtgcgtacgtacggccccgttaggacctaagggtctttgggacggttggagtagggtagtagggtatacggaggtccggtactttaaccgaagttcggtacaaccgtaactaaacgtatcggacaaccgtaactaacccgacgaagggacgagtacgtaccaaccgtagtaccgaaaccaccgaacgtaacaccgaacgtacccgaaaggaccgacccaccgggttaaccctaacggtaacgtaccggtaaccggtggtaaccgggtccgtacggacgtaaagcccgtttagaccggaaaccggtcccgaaacccggtcggttagtaacgttttaccggtgttacgggaaccgaagtaacggggttacgtaaacggggtttaaatttacgggttttaacgaccggttttaccggtaccccttttaggtttaaccgtacccggttacggggtaccggtaccgggttaaccccgggtactttaaccccgggg

SEQ ID NO: 197940 - DNA, 670 bp, Homo sapiens
  misc_feature: GYAE6OF02F40KI.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgacaaggtcttctggttaccacctttaccaactatggtatcgagttggtgcgacacggcccctaggacgaagggtcttaggaggtggagtgggatggatcgagcgtacttacagtcggtacacaactaaacttagtacgaccaacgaacgtaaccctccgaagggcaagacgtaccacatacgaccacacgacacataccgacgacgaccgaccgacctacgacgtacggaccgtaggaacggaccgtccgtagacgtacgtaccgacggaaccggaccgtaccgggtaccgttacggttactttacggtcgtacggtacgtaaggacgttacgggtaacgggtaaacttttaggtttacggtaacgtttacccggttacccgtttagtttacgtaccgttaccgggtacggggtacccggtaccggggtaccttacccggg

SEQ ID NO: 197941 - DNA, 710 bp, Homo sapiens
  misc_feature: GYAE6OF02IZ5A8.39.81.H04.1.454.CMB.1.raw
  modified_base (334)..(334): a, c, t, g, unknown or other
  misc_feature (334)..(334): n is a, c, g, or t
tcagtcgcactagtcacgaccggtgctcgatttagtagtgtagattcgcggggcccctagatcacagctcctcaccatggactggacctggagcattccttttcttggtggcagcaacaacgaggtgcccactcccaggttccagcgtggtacagtctaggagctagagatgacgaagccgtcgggcctcagtgaagtcctccgtgcgaaggtcttcgtacggttacctaaccttttaaccaacttagtaggttactcgtaggtttcgggcgtaccgaccgaccggtccccgtaggaacggagggtctaggagtagggagtagggtgtacggtnacgagtccgtaactaagagttcgacaaactaacgtaaaacctagtcaacgtaacgtaaccgaccgtacggacggacgaacgtaccgtccaactacggtacgaacctaaaccgtaacgaacaccaaccgtacccgaacggaccgtaccgaccgtcctaaacgacgtaggtacccgaaggtcgaactcgaggtactacgttaccgacgaaccggacggaccggttcgtaagtttacgtaggtcggtagaaccgaaggttacgaagggttaacggtaaattttggtaacgttacccgtacgttacccttgtacgtacggtcgtccgggaactccggtactcggtacctccttcgcccgtaactcccggactaaccccgg

SEQ ID NO: 197942 - DNA, 764 bp, Homo sapiens
  misc_feature: GYAE6OF02GKCXW.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtcgcccactcccgaggttcagctgtacgagtctggagctgagagtggacgaacgtccgtacgggggcctcgtaggtaggtaacggtccgtccgtcgacgtaacggtccttcgttacggttaacctacccttttaaccaaacttagtacggtactcgtaggttggtgtaccgagaccggtccccgtaggacgaaggtcttggaggtaggagtagggtacgtgacgtacgcgcgtacttacacgtgactacaaccgtaaatacgacgacaaccgtaacgtaaccgtaccggacggacgaaacggtacgaccgaactaaccgtcgaaccaaccgaacgtaacaaccgtaacaccgtaccgaacggtacccgaccggtaaccaacggacctacggaccgtaggaccggacctccgaagcgtaagaccggtacgaccgtaacggcccgttaacgtagtttaaccgtgtacgtacgacggtacggtagttaccgggtaaaggttagtttttaacggtcgggttaaccggttaccggtaaccccgttttaggttacgtacccgggttttaacggggccccgggttaacccgggtaaccgggttaccccgttaccggg

SEQ ID NO: 197943 - DNA, 554 bp, Homo sapiens
  misc_feature: GYAE6OF02GM8P7.39.81.H04.1.454.CMB.1.raw
  modified_base (428)..(428): a, c, t, g, unknown or other
  misc_feature (428)..(428): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaactatgcacagaacctccgagggcagacgtcaccatgaccacagacacatccagagcacggcctacatcggacctggaggacgcctaganactcgtagacgacgacgggccgtagtacttactggagcgagagacgtcgggaaattgtttagacgttacggttacccttgtttacggacttaccggtacgggggaccctacggggaccccttcggg

SEQ ID NO: 197944 - DNA, 723 bp, Homo sapiens
  misc_feature: GYAE6OF02HY1U9.39.81.H04.1.454.CMB.1.raw
  modified_base (465)..(465): a, c, t, g, unknown or other
  misc_feature (465)..(465): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtcgtggagctgagatgacgaagccgtggggcctcgaggtgaaggttctcctgcgaaggtcttcgttacggttaccacccttttaaccaactagtaggtacttcgtaggtttggggtactcggacgacggccccgtgggaacgaagggtcgttaggaggtggagtgggagtagggatcgaggcgtcttacgaagttggtacacaacaaacgtatacgacaccaacaacccgtcgagggtacaggacgtacgacctagtaccgaaccacgacgaactaactacncccgaacgacgaccgtaccggaacctacgacgtccggtaccgtacggacggacgtcgaggtagtactccggaggaaccggtaccgtcccgggtaccggttcgttaacgttccgttacggtcggtaacgacgggtaaggttacggtaacggggtaagtttaacgtttccgggtaaccgtttacccggttaccgtttaccggtttcgttaaccggttaccgggtaccggggacggtaccccggggttacccgttaccggg

SEQ ID NO: 197945 - DNA, 665 bp, Homo sapiens
  misc_feature: GYAE6OF02J0H9Z.39.81.H04.1.454.CMB.1.raw
  modified_base (183)..(183): a, c, t, g, unknown or other
  misc_feature (183)..(183): n is a, c, g, or t
  modified_base (270)..(270): a, c, t, g, unknown or other
  misc_feature (270)..(270): n is a, c, g, or t
  modified_base (373)..(373): a, c, t, g, unknown or other
  misc_feature (373)..(373): n is a, c, g, or t
  modified_base (449)..(449): a, c, t, g, unknown or other
  misc_feature (449)..(449): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagcgtaggtacngtctggagctgagatgacgaagccgtgggcctcagtgagtctcgtgcagcttctgtacaccttacactatcggtatcgtaggttggngacgacgacggacccgtaggtacgaacgggtcttggaggttggagtgggtagtggagtcgaggtccgtattaacgaagtcggtacaaccgtaacaaattcganactacgacgaaccgtacggagggtacaacggatccaactacgacgaaccacgacgaacacgaacctaccgacgacnccggaaccgtacccgtaagacgtacgggtaccccgaagggaacgaccgtccgggtaaggtaacctacgttacgacgggtaacccgacgttaaccggggtccttaagggttaacccttggacgttaccggagacgtaagggtacgtaaggttacgtttacgtgtacgtacgttacttaggttacgacgtaccggcgggtactaaggtcccgttacgg

SEQ ID NO: 197946 - DNA, 848 bp, Homo sapiens
  misc_feature: GYAE6OF02HU24G.39.81.H04.1.454.CMB.1.raw
  modified_base (146)..(146): a, c, t, g, unknown or other
  misc_feature (146)..(146): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatcctttttcttgggtggcngcaaacaacgacggtcgcccacctcccaggttcagcgtaggtacagttcgttggagcgtagagagtagaacggaacgccggtacggggcctacgtacggtaggtaacggttcctccgtcgacgtacgtcttcgttacggttaccttaccttaacctaacttagtaggtctcgtaggttcgggtacgcgacgaccggtacccgtaggtaacggtagggtcgttggaggtaggtacggtaggggtagtgggtaacgtcgacggacgttacgttaacgacgtacggtactaaccgaaactaactacgtacgacaacgtaaaccgtaacccgcggaacggacgtaacggacctacgtaccgtaacgtaaccgacccaaacgtacgaaccgaactaccggtaacccgaaggcccggtacgaacccgacgtaaccggacgtaccgggtactaacggggacgtaccgtacgtaaggacgttacgtaccggaccgtaccgggaaaccggttaccggtacggtttaacttacgtttacgggttcggacggtaacgggtagggtaacggtaacgggttaaacgggtttaaggttttaaccggtttagggtttaaccccgtttacggtttaacccggtttacgttaaccggttacccgggttaccgggtacccgggggtttaacccggtacccgggtttaaccggtaccccgg

SEQ ID NO: 197947 - DNA, 788 bp, Homo sapiens
  misc_feature: GYAE6OF02JGR7A.39.81.H04.1.454.CMB.1.raw
  modified_base (653)..(653): a, c, t, g, unknown or other
  misc_feature (653)..(653): n is a, c, g, or t
tcagtcgcactagtcacgaccggtgctcgatttagtagtgtagattcgcgggggacccaaaaaccacacccctccttgggagaatcccctagatcacagctcctcaccatggactggaccgtggagcattccttttcttggtggcagcaacaacaggtgcccactcccaggttcagctggtacagtctggagctgagatgacgtaagccgtggggcctacgaggtagaacggtctccgtagcgaaggtcttcgtggttacaccgtttacaacttagtggtactcgtaggttgggtcgaccgacgaccggtccccgttagggactaaggggtctttaggagttaggacgttagggattacgggactcgacggtaccgtacgttttaacgaagttcggtaccaacgtaacgtaaaacgttcgaccggtaaccaaccggtaaccggtaaacccgttccggaacggggtaccaacgggttaacgttacccaacccgttaacaccggaaacccacgtacgaacctacgtaacgtacccgaaggaaacgtcccgtaaccgtacccgtaagtaacggtaccggaccttagggaacggtccgtacgtacggacgtacgtaccgtaggaaccgtacgaaccggtcgttataacgttaccggngtaaccggaggaacgtaaggtcgggttaacggtaactttacggttttaccggaacgttttcccgggttacctttcggtttaaccggtacggttaccgggtaccgggaacccgttaaccggggtcccctttacggg

SEQ ID NO: 197948 - DNA, 701 bp, Homo sapiens
  misc_feature: GYAE6OF02IMH6T.39.81.H04.1.454.CMB.1.raw
  modified_base (196)..(196): a, c, t, g, unknown or other
  misc_feature (196)..(196): n is a, c, g, or t
  modified_base (235)..(235): a, c, t, g, unknown or other
  misc_feature (235)..(235): n is a, c, g, or t
tcagtcgcactagtcacgaccggtgctcgatttagtagtgtagattcgcgggggacccaaaaaaccacacccctccttgggagaatcccctagatcacagctcctcaccatggactggacctggagcattcctttttcttggtggcagcaaacaaacaggtcgcccactcccaggttcagctggtacagtctggancgtgagatggacgagccgtgggcctgaggtgaggtctcngacaggcttctgttactaccgttacaactataggtatcgtaggttggtgaccgtacgacggccccgtaggaacgagggtcgttacggaggttgggaacggttggggacgtggtacgtcgaaggtaccgtagtttaacgaagttcggtaacaaacctaacgtaaaacctagtacgacctaacggaaactaaccgccgggtaagacgtaggtaactaccgaactacgtaacgacccaacgcgaaacccaacgtacctaccgaacgaacgaccggtaaccggtacctacgtacgtacggaccgtaggacggacgtacgaagtacgtacgtacgtacgaccgacggtaccggtacgtaagttacgtacgtaggtacacggagtaacggaggtaacgggtaagttcgtttagacgttcgtacctttaggtaccgttacgtacgggtaccggtcggtacggtacccgtacgg

SEQ ID NO: 197949 - DNA, 741 bp, Homo sapiens
  misc_feature: GYAE6OF02JX3SI.39.81.H04.1.454.CMB.1.raw
  modified_base (375)..(375): a, c, t, g, unknown or other
  misc_feature (375)..(375): n is a, c, g, or t
  modified_base (422)..(422): a, c, t, g, unknown or other
  misc_feature (422)..(422): n is a, c, g, or t
  modified_base (579)..(579): a, c, t, g, unknown or other
  misc_feature (579)..(579): n is a, c, g, or t
tcagtcgcactagtcacgaccggtgctcgatttagtagtgtagattcgcggggaccccaaaaaccacacccctccttgggagaatcccctagatcacagctcctcaccatggactggacctggagcattccctttttcttggtggcagcaacaacaggtcgccccactccccaggttcagcgtggtacagttctggagcgtgagatgaacgaagccgtcgggcctcgaggtggaaggtctccgtagccgtaaggtccttctacgggttacctaaccgtttacccaaattagtcggtatcgttaggttgggcgcggactaccggcccctagggaacgagggtctaggtaggttggtaaggtgggtgaggtatcggngtaccgtcttaaactagttcggaaccaacgtaacttaaaagtcgtanaacccgaaataacccgaaacccggtacgacgggaaggaactacgaccaaccgtaacaccggaaccctcgaaacgaaccgtacgaactaccgacgaacccgcgaccccgtacgtaacgtaaccgtacgtaccggaaggtcgaacgtcgtacgaacgtnacgggtacggtaaccgaccgtaaccggtccgttacgtacttaagtccgaggtacggaaggttaacggtacggtaaggtttaacggttaccgtttagtaaccggttaacttccgttaactacgttaccggtacgggtaccggtacggacccgttacggtaccg

SEQ ID NO: 197950 - DNA, 679 bp, Homo sapiens
  misc_feature: GYAE6OF02FNKR6.39.81.H04.1.454.CMB.1.raw
  modified_base (213)..(213): a, c, t, g, unknown or other
  misc_feature (213)..(213): n is a, c, g, or t
tcagtcgcactagtcacgaccggtgctcgatttagtagtgtagattcgcgggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctnagtgaaggtctcctgcaaggcttctggttacacctttaccaactatggtatcaggttgggtgcgacacggcccctggacgaagggcttggagtggatggggatggatcgacggcgtacttacaagtggtacacaacaactagtgacacacgacctaccgaggcaggagtaccacatacgaaccacacgacacactccacgacgacgacggacctacacgtacggacctagggaacggtacgaccgttggaacgtactacggtacgaccgggaccgaccgggtaccgttacggtttactttaaccggtgttaccggtacggaacgggtaacggtacggtaacggggggttaaacttttacggttttaacggtaaccggtttaccggttacccgtttacgttttacggtaaccggttaccggggttaccgggggacccggttaaccggggttaaccccgttacccggg

SEQ ID NO: 197951 - DNA, 803 bp, Homo sapiens
  misc_feature: GYAE6OF02HEOTU.39.81.H04.1.454.CMB.1.raw
tcagtcgcactagtcacgaccggtgctcgatttagtagtgtagattcgcgggggacccaaaaaaccacacccctccttgggagaatcccctagatcacagctcctcaccatggactggacctggagcatcctttctggtgcagcaacaacaggtgcccactcccaggttcagctggtacagtcgtggagctggagatgacgagccgtgggcctcgagtgaaggtcctccgtgacgtaaggtcttacgtcggtaacctacctttaaccaactagtcggtatcgtaggttgggtcgaccgtacgaccggtcccgtaggaacggtaacggtcgttaggtaggtaggtaggtagggagtaggtacgtcgacggtacgtactaagtagtacggtaaccaacgtaacctaaacgtagtacgaacgtaacgaaaccgtacccgtaccggtaagggacgtacggtaccgtaccgtaacgtaacgtaccgaaccgtaacgaacgaacctaaccgtaccgtaaccgaacgacggtaacccgtaaccgtacctaaacgtaccggtaccggtaccggtacggaacggtaccgtacggtaacggtacgtaaccgtccggaaccggaacccgtaccggtacccgggttaaccgttaacgttaacgttcggtacggtaacggtaacgggtaaggtaacgggtacgggttaacggttaacgtttacgggttaaccggtaccggttaccgttaaccggtttcgttaccggtaccggtaccgggtaacccggggtaaccggtaacccgggttaccgtccgg

SEQ ID NO: 197952 - DNA, 682 bp, Homo sapiens
  misc_feature: GYAE6OF02HNGNB.39.81.H04.1.454.CMB.1.raw
tcagtcgcactagtcacgaccggtgctcgatttagtagtgtagattcgcgggggacccaaaaacccacacccctccttgggagaatcccctagatcacagctcctcaccatggactggacctggagcattccttttcttggtggcagcaacacaggtgcccactcccaggttcagctggtacagtctggagctgagatgaacgagccgtggggccctgagtgagtctcctgcgaggtcttcgtcggttacctacctttaaccaattgtacggttatacgtaggttcgggtcacgtaccgacggtcccccgtgggaaccgtaaaggggtcctttaggggacggttaggtacgggttagggggactacggggtacttacggcggtccgtaacttacgtaggtcggtacaacgaactaacgtctcgacctacaaccgtacccgccgaacgggcaagtaccggtcaacctgtaaccacacgaacacacactacgacgtacgcgaccggtacctagacctagggaccttgggacgtacgcgtaacggatcgtaccacggaccgtacgccggtacgtcgttacttacggcgtacgcgtagaggtacgttaagggtatttggtacgtaccgttacggttacccgttagttacctacggtacgtcccggggtaacacccgggtctaccgg

SEQ ID NO: 197953 - DNA, 692 bp, Homo sapiens
  misc_feature: GYAE6OF02JFSXQ.39.81.H04.1.454.CMB.1.raw
  modified_base (189)..(189): a, c, t, g, unknown or other
  misc_feature (189)..(189): n is a, c, g, or t
  modified_base (342)..(342): a, c, t, g, unknown or other
  misc_feature (342)..(342): n is a, c, g, or t
  modified_base (354)..(354): a, c, t, g, unknown or other
  misc_feature (354)..(354): n is a, c, g, or t
  modified_base (376)..(376): a, c, t, g, unknown or other
  misc_feature (376)..(376): n is a, c, g, or t
  modified_base (386)..(386): a, c, t, g, unknown or other
  misc_feature (386)..(386): n is a, c, g, or t
  modified_base (401)..(401): a, c, t, g, unknown or other
  misc_feature (401)..(401): n is a, c, g, or t
  modified_base (465)..(465): a, c, t, g, unknown or other
  misc_feature (465)..(465): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttctggtgcagcaacaacaggtgcccactcccaggttcagctcggtacagtcgtgganccttgagatgacgtaagccgtgggacctcgagtggaaggtctacctcggaccgaaggtcttcgtaggttaacctaccgttttaccaacttagttggtactcgtagttagggtgtccggacgacgggtcccctaggaccgaacgggtcttaggngtaggagtgggntgatcagtcgtctacagtcgtnacactaactncgacacgacgaaccncgtaggcaagtacgtaccaacgtcgacgtacccacaacgtacaactccgttaaccgaacggaancccggtaacccggtacctaacggacgtaccggtaaccctaaggggtcgtaaccgcgtacgaacgtacctcgtttaacgaaccggtacccgtaccggggtccttaaggttaaccgttaggttacgtcggaggtactaggttacgggtaggtaaactttggtttaacgcggtttaccggtacctttggtattacccgggtacggttccggacgtaccggtaccgttccg

SEQ ID NO: 197954 - DNA, 567 bp, Homo sapiens
  misc_feature: GYAE6OF02HB3TQ.39.81.H04.1.454.CMB.1.raw
  modified_base (187)..(187): a, c, t, g, unknown or other
  misc_feature (187)..(187): n is a, c, g, or t
  modified_base (336)..(336): a, c, t, g, unknown or other
  misc_feature (336)..(336): n is a, c, g, or t
  modified_base (371)..(371): a, c, t, g, unknown or other
  misc_feature (371)..(371): n is a, c, g, or t
  modified_base (381)..(381): a, c, t, g, unknown or other
  misc_feature (381)..(381): n is a, c, g, or t
  modified_base (423)..(423): a, c, t, g, unknown or other
  misc_feature (423)..(423): n is a, c, g, or t
tcagtcgcactagtcacgaccggtgctcgatttagtagtgtagattcgcgggggacccgaaaaaccacacccctccttgggagaatcccctagatcacagctcctcaccatggactggacctggagcatcctttctggtggcagcaacaacaggtgccactccaggttcagctggtacagtctgganctgagatgacgaagcctggggcctcagtgaaggtcacctgcaaggcttactggtacactttaccaatatggtatcagttggtgcgacaggcccctggacaaggcttgagtggatgggatggatcagcgcttacaatggcacacaaactngcacagacctcgagggcagagtcaacatcgaccanagacactacnccaacgagcacgacctacatgactcgagactctgacgatcgngaaccgacaacgggtccgtagtaacttacgtaggtcgacgtaagagacgtaccggggtaaatagttttacggaacgttacggtaaccccgtttgtttacggtaaccgtcggttacgggaacccgtacgggttaaccctaccggg

SEQ ID NO: 197955 - DNA, 702 bp, Homo sapiens
  misc_feature: GYAE6OF02GS9IS.39.81.H04.1.454.CMB.1.raw
  modified_base (274)..(274): a, c, t, g, unknown or other
  misc_feature (274)..(274): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagctggggctcagtgaaggtctctgcaaggcttctggttactaccttaccaactatggtatacagttgggtncgacgacggccctggacgaagggcttaggagtaggagtagggagtaggagtcgaaggcgtacttaacgaagttcggtaccaacaactaaaactacgtaggtaccaacaacgtaaacctccggtaaggcgtaagacgtacgaaccgtaacgtacgaacccataacggacctaacgaactaccgaacgtaccgaaccgtaccggacccttaacgtaacgtacggacccgttaagggacggtaacgccgtaacgaacgtacttaccgtagaaccggaaccgaccgggtaccgtacgtttaagttaaccgtggtacggtacggagggtaacgtacggtaacgggtaaagtttacgtttacgtaaccggttaccggtttacccttagttaccgtacgttacggtaccgggtaccgaccgggtacccgtaccgg

SEQ ID NO: 197956 - DNA, 649 bp, Homo sapiens
  misc_feature: GYAE6OF02GZ033.39.81.H04.1.454.CMB.1.raw
  modified_base (426)..(426): a, c, t, g, unknown or other
  misc_feature (426)..(426): n is a, c, g, or t
  modified_base (533)..(533): a, c, t, g, unknown or other
  misc_feature (533)..(533): n is a, c, g, or t
  modified_base (545)..(545): a, c, t, g, unknown or other
  misc_feature (545)..(545): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttctggtggcagcaacaacaggtgcccactcccaggttcagctggtacagtctggagctgagatgacgaagcctggggcctcagtgaaggtctccgtgcaagcttctggttactaccgtttaccaactatggtatcagttgggtgcgacgacggtcccctaggacgaagggcttagaggtggagtgggtatgggtatcgaaggccgtcgttaacgaagttcggtacaacaacctaaaacgtagtacgcaaccgacgaaaccctccgaagggcaaggacgtacaccatacgaaccncgaagaccaacacgtaccacgagaccacggcctacacggtacggacctagggacggcgccgtagatactacgtagacccgtacgaccggtcgttagtaacttaccgngttcgacggtanagggtaactacggggtaaatttaggtttacggacggttacccgtttaccgtcggttttacacggttaccggttaccggggtaccgacccgggttacccgtcggg

SEQ ID NO: 197957 - DNA, 797 bp, Homo sapiens
  misc_feature: GYAE6OF02JHTJJ.39.81.H04.1.454.CMB.1.raw
tcagtcgcactagtcacgaccggtgctcgatttagtagtgtagattcgcgggacccaaaaaaccacacccctccttgggagaatcccctagatcacagctcctcaccatggactggacctggagcatccttttctggtgcagcaacacaggtgcccactcccaggttcagctggtacagtctggagctgagatgacgaagcctaggggctcgagtgaggtctcctgcaacggcttcgtcggttactaccgtttaacaacgttattggtactcgtagggttgggtacgtccgtaacgaaccggtccccgtaggggtaaccgtaaaggggtccttagggtaacggttgggtacgtcggggattacgggtacttacgacgggttcctaacgttaccgtaagtcgggtaccaaccggtaactaaaacggttcacggaactaccgaaacgtacccgttaccgagggtaccaaggtacgttaccgactaacggtcgtaacccgaacgtacggaacgtaccgtaccgtaccgtaaccggaccgaacccggttacccgggaaccttaaccggtacttaaccggggaccctttacgggaacggtccgtaaccggtacgtacgttaaccgtccgtttaacggaacggttaccccgtaacgggtcccggttaaggtttaccacgtttaacggtacggaccgtacggtacgaccgggttaaagggttacttaacggttacggtctttacccggtacgtttcgttacgtaccgttacgggaccgggtacggttaaccggtccgttaccgg

SEQ ID NO: 197958 - DNA, 808 bp, Homo sapiens
  misc_feature: GYAE6OF02GO6PR.39.81.H04.1.454.CMB.1.raw
  modified_base (320)..(320): a, c, t, g, unknown or other
  misc_feature (320)..(320): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttctggtggcagcaacaacaggtcgcccaccgtcccgtaggttcagtacctcggtaacagtcgtgggagtcgtggagatggacgaacgccgttggggcctacgaggtgtaacggtcctcgtgccgtaaggtccttcgtcggttaacctacctttaaccgattagtggtaacgttcgtaaggttcgggntaccgacgtaccggtcccgtagggaacgacgggtcttggtaggtcggagtggtacgaggtactcgagccgtacgtacgacgtcggtaccacgtaacgtacgtagtacgaccgaagtacccgtaacgtaccggaacggtacaacgttcgaacctaacgacgtaccggaccaacgaaccgtaccgtaccgaaacgtacccgtaagggaccctaaccgggtaccgtacctaaccggaccgtagggtaacccgtaaggtcggtaaccgtcgggttaaagtaaccgggtacctacccggttaaccggggaaaccctacccgggtaaaccgggtttaccccgtaagttaaccggtttccgaacggggtcgtaaacgtacgggtacgggtaccttaacggggttatttccgtttacgggaccgtttaaccgtcccgtttaaggtaccgtaaccggttccggggtaagtaccccgggtaacggttacccgtacggg

SEQ ID NO: 197959 - DNA, 688 bp, Homo sapiens
  misc_feature: GYAE6OF02FRMGX.39.81.H04.1.454.CMB.1.raw
  modified_base (242)..(242): a, c, t, g, unknown or other
  misc_feature (242)..(242): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtcctcctgcaaggtcttcnggttacacctttaccaactatggtatctaggttggtgcgtacacggcccctggacgaagggtcttggagtggtagtgggagtggatcaggcgtacttaacgagttggtacaacaactaaactatcgacaacgaacgaaccctcgagggacaggactaccaactactcgaaccaacaacgacgacaactacgacgacggccgaccggtacctacgtaacgtacggaccgtaggacgggaccgcgttagacgtactaccgacggtaccgaccgtaccgggtacgttacgttacgttacgtaggtacggacggtaacggtaggtaacgggtaagggttaaacgtttacggttttaccggtaacccggttacggtttaccccgtttgttaacccggttacggttaaccgggtaccggggtaccggtaacccgggtacccgttacccgggg

SEQ ID NO: 197960 - DNA, 634 bp, Homo sapiens
  misc_feature: GYAE6OF02HE42L.39.81.H04.1.454.CMB.1.raw
  modified_base (254)..(254): a, c, t, g, unknown or other
  misc_feature (254)..(254): n is a, c, g, or t
  modified_base (582)..(582): a, c, t, g, unknown or other
  misc_feature (582)..(582): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctgggcctcagtgaggtctctgcaagcttctgtactaccttaccaactntgtatcagttgggtgcgagacggccctggacaagggcttggagtggagtgggtagtggatcgacgcgtacttaacaagttggtaccaacgaactaaactatcgacaacgacgaaccctacgacggacaggacgtacacgtatacggaccacacgacaactacaccgacgacgcgaccggcctaacagtacgaccgtaggacggaacgcccgtagacgtactcgtacggaccggacggaccgggtacccgttagtaacgttacgttggtacggacgaggtacgtaggtacgggttaattacggtttacgaccgttcggttacccgtttnttaccggtacgtacgggtaccggggaaccgtaccggggtacccgttaccggg

SEQ ID NO: 197961 - DNA, 601 bp, Homo sapiens
  misc_feature: GYAE6OF02FSA37.39.81.H04.1.454.CMB.1.raw
  modified_base (360)..(360): a, c, t, g, unknown or other
  misc_feature (360)..(360): n is a, c, g, or t
  modified_base (424)..(424): a, c, t, g, unknown or other
  misc_feature (424)..(424): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctcctgcaggcttctggttacacctttacaactagtggtatcgaggttggtgcgacgacggcccctggacgaagggtcttaggaggtggagtgggatggatcgagcgtacttacaagtcggtcaactactaaactntacgaccaacgaacgaaccctaccgacggacaagacgtacacctatacgaccacagaccacacnccagacgcgacggcctacgacgtcgacgtaggacgacgcgtagagtactgtacgacgacgaccggtcgtagttacgtactggtacgagaggacgtaggtacgggtaatttcgttagtacgttccgttacccttagtttacgacgttaccggtcgggacctaccgggtaccgttacgg

SEQ ID NO: 197962 - DNA, 765 bp, Homo sapiens
  misc_feature: GYAE6OF02IFN6W.39.81.H04.1.454.CMB.1.raw
  modified_base (197)..(197): a, c, t, g, unknown or other
  misc_feature (197)..(197): n is a, c, g, or t
  modified_base (233)..(233): a, c, t, g, unknown or other
  misc_feature (233)..(233): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcttgggtggcagcaacaacaggtcgcccactcccaggttcagctggtacagtctggagctganatgacgaagccgtgggcctcgagtgaaggtcctcgngcgagtcttcgtacgtactaccttaccatagtgtatcgtaggtggtgaccgacgacgccgtaggacgtaaggtcgttaggacgtggacgtagggtgttaggacgtacgtcggacgtacgttacgaagttcggtaacaactaacaattagacacaacgacgtaacctaccggagacgacgtacgtaccaactacgacgacgaacctaccgaactaaccctcgtaaacccgtaacgacccggtaacccggaacccggttacccgtaacccgtaacggttaacccgggtaccgttaaccgggaacgggtaccggtaaccgtacggtagtaccgtcggtacgacccggaacggtacccgggtcgtttaaggtttaccgtaaccgtttgggacgtaaccgggtaagggaacggttacgggtaaacggggtttaacgtttaacggtttacggtaccggttaacccggttacccgtttaggtttacccgtacgggttacggtacccgggttacggggttaaccccgtccggttacccgg

SEQ ID NO: 197963 - DNA, 748 bp, Homo sapiens
  misc_feature: GYAE6OF02I7AXK.39.81.H04.1.454.CMB.1.raw
tcagtcgcactagtcacgaccggtgctcgatttagtagtgtagattcgcggggacccaaaaaccacaccccctccttgggagaatcccctagatcacagctcctcaccatggactggacctggagcatccttttcttggtggcagcaacaacaggtgcccactcccaggttcagctggtacagtctggagctggagatgacgaacgcctggggcctcgagtagaagtctccgtgcaggcttcgtcggttaactacccttaaccactatgtaatctagttggtgcgacaacggcccctaggacgaagggctaggaacgtggtacgtggacgtggatcgagtacgtacgtaactacgtcggacaactaaaccaaaacgtatacgaacctaacaaccgtaaacccgtccgaacgggtcgaagacgtaaccgaacctacgtaccggaaccaacgtaacaactaacgaaccttaacccgaacgtaacgacccgaacccggtaccctaaacgtacggacgggtaccgtacggtaaggaaccgtcgtagacgtataccgtacgaccggaacgtaccgggacggttacgttaacgttaccgttagggtacctaggaacgggttacggaacgggttaccgggttaaaaatttcggttttaaccggacggtaaccgggttttacccttaccggttttacggaacccggttacccgggttaagggtaccccggtaaccgggttacccccggttaacggg

SEQ ID NO: 197964 - DNA, 860 bp, Homo sapiens
  misc_feature: GYAE6OF02H720U.39.81.H04.1.454.CMB.1.raw
tcagtcgcactagtcacgaccggtgctcgatttagtagtgtagattcgcggggacccaaaaaccacacccctccttgggagaatcccctagatcacagctcctacaccatggactggacctggagcattccttttcttgggtggcacgacaaacaacgtagggtccgacccctaccgtacccgtacggttcaacggtcgttaggtaaccgtagttccgtagggacgtcgttaggaagtgtacggaacggacggtcccgggtccggggaccttacgaggtaggtaaccggttcctccgtacggacgtagttccgttcggttacgttaaccttaaccttaccgaactgtagttactgttacgggttaggtcgaaccgtaccggaccggtcccgtaggaacggtaggttactggtaggtaggagggtacgggtagttcggacgtacggacgtacgtacgttaaacgtcgggtactaaccgtaaactaacggtaaacttgaccgaacaaccgtaccgtaaccgtacgggaacggacgtaacgaaccgttacccaacgacgtaccgaacccgacgtaaaccacgaaccgtacgaacccgaacggaccgtacccgacccgtaccgtacgtacggcggttacggacggaggtaccacgttacgacgtacgtaccgacgggaaccgtaccgggtacgtaccgttaggttaaccttacgtacgggacggtaacggtacggtaacgggttacgggttaaccggtttaaagttttcggttaaccggtttaaccgttccggttttaaccgtacggtttaccgaccgggttaaccgggacccggtaacgggttaccccggtggttacccccgg

SEQ ID NO: 197965 - DNA, 759 bp, Homo sapiens
  misc_feature: GYAE6OF02I7EFA.39.81.H04.1.454.CMB.1.raw
  modified_base (232)..(232): a, c, t, g, unknown or other
  misc_feature (232)..(232): n is a, c, g, or t
  modified_base (263)..(263): a, c, t, g, unknown or other
  misc_feature (263)..(263): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcattccttttcttggtggcagcaaacaacaggtcgcccactcccgaggttcagcgtaggtacagtctggagctgagatagacgagccgtgggcctcagtgagtctcngcgagtcttcgtagtacctaccttacaagtntgtactagtggtggtgccgacgaccggcccgtaggacgaggtcgtaggagtggtacggtgggtagtggtactcgagtacgtacttaacgtagtcggtaccaacgaaacctatagtacgacaacgaaccgtaaccgtacggaacggacgtaacggacgtaccaaccgtaacgtaccgaaccaacgtaaccgaacccgtaactaacccgtaaccggaaccgaaccggacccgaaccggtaccgtaacgtaccggtaccggtaaaccgtacgggtaaggaacccgtccggtaaacgttacgttaccgaccggtaacggaacccggtaccggtaccggtactttaacgttacgttacccgttaggtacccggttaggaacgtacgggtaacggttaacggtttaagtttcgttaaaccggtccggtttaacccgtccgttttaggtaccgttaccgggtaaccgggtaccgggtacccggtaaccggttacccggtaccg

SEQ ID NO: 197966 - DNA, 698 bp, Homo sapiens
  misc_feature: GYAE6OF02F50NE.39.81.H04.1.454.CMB.1.raw
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcaggtgaaggtctcctgcaaggtcttcgtcggttaccacccttaccaactatgtatctaggttggtgcgacgacggcccctgacgaggcttgagtggagtgggagtggagtcgagcgacttacaagtcggtacacgaacaaactacgtagacaacgtaacgaaaccgtccgaagggtacacggtaacgaccgtaccacgtaccgacccgaacaacgacaaccactaccgaacgacggaccgaaccgcctaacgtacgtacggaccgtacggacggacgaccggtagacgtactaccggttaacgaccggaaccggtaccggtaccgttacgttaacgttaccgttaggtccggtaggaacggtaacgtacgggttaacgggttaacgttttaaggtttacggttacggtttaccggttaccctttagtttcggtaaccggttacggttaccgggaaccggttaccgggtaccgtttacccggg

SEQ ID NO: 197967 - DNA, 617 bp, Homo sapiens
  misc_feature: GYAE6OF02FR1CE.39.81.H04.1.454.CMB.1.raw
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttaccacctttaccaactatggtatcagttgggtgcgacacggcccctggacaagggtcttggagtggagtgggatggatcgaggcgtacttacaagtggtaccacaacaaactatcgacacacgaacctccgacgggcaggactacaccagtacgaccacaagaccaactactaccgaacgacgaccgaccgtcctaacgacgtacggacctaggacggagccgttagagtactcgacgaccgacgaccggccgttagttaccttagtcgtaggacgagagtacggtagggtaacttttggttacgtacggttacggttacccttcgtttagaccgttaacgggtcggggacccgtagggtaccccgttacggg

SEQ ID NO: 197968 - DNA, 800 bp, Homo sapiens
  misc_feature: GYAE6OF02JVWSX.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttctggtggcagcaacaacaggtgcccactcccaggttcagctggtacagtctggatctgagatgacgaagccgtggggcctcgaggttgaaggtcctccgtgacgaaggtccttcgttacggttacctacccttttaccgaaacttagttacgggtaacttcgtaaggttcgggtcggtacgaccgtaccgggtccccctagggtaacgacgggtaccgtttggacggttaggaggttacgggagtacgtagtccggtaagtccggtacttaacgaacgttcgggtaacctaactaaccgtaaaacgtacgtaccgtaacggtaaccaacggtaacccgtaacggtaccgggactaacggtaaaccgtccgaaacgtaccgttaaccgaacccgaacgtaaccgtaaaccgtaaccgtacgttaacccgaaccggttaaccgggtaccgaaccccgggttactaaccgtaacgtaccgggttaacccgtagggaaaccggtacgtacccgtacgtacgtaacgtccgaacgaccgtaccgtacggtaccgtagttaccgttaacgtcgggtagtaaccggagtacggacggttaaggttagttacccggttagtaccgttaccgttacgtacgttacgacggtggaccggtcgaccggtacgtaccgg

SEQ ID NO: 197969 - DNA, 723 bp, Homo sapiens
  misc_feature: GYAE6OF02G1XQU.39.81.H04.1.454.CMB.1.raw
  modified_base (64)..(64): a, c, t, g, unknown or other
  misc_feature (64)..(64): n is a, c, g, or t
  modified_base (307)..(307): a, c, t, g, unknown or other
  misc_feature (307)..(307): n is a, c, g, or t
tcagtcgcactagtcacgaccggtgctcgatttagtagtgtagattcgcgggggaccaaaaccncaccctcctgggagaatcccctagactcgactagcgtccttcacctagtggactggaccgtggagacagtcctttactaggtggccaagcgaacgtacgaggtgcccactcccgtaggtttcaggctggtaactaagtctcggagtctgagatgacgagcctcgggcctcgaggtcgggagtctcgtgcgaggcgttcctggtaccaccttaccaactagtcggtactcgtacggttcgggtnaccgtaccaccggtcccgtggaaccaagggtcctagaggtggaagtgggcgtcggactcgacgtcgacgtacgaggtcggtacgaactacgtaaactgtacggactaacgaacggtaacccggtacggaagtaaccaggtacctaccgactaacgtaccgaccgaacgtacggtacaccgtactaccacgtacgacccgaccggtacctaacgaactaccggtaaccgaacgtacggtaccgtacgtacgtacgactacaacggtaccgaacggaccgtaccgtggtaacgtacgtaccggtacgacgaacgtcgtaacgtacgggttaacggtaagtttaccgtaacggtaccgttaacccgttataccggttacgggtacctacggggtaccggaacgggtacccgtaacccgg

SEQ ID NO: 197970 - DNA, 664 bp, Homo sapiens
  misc_feature: GYAE6OF02HY6O3.39.81.H04.1.454.CMB.1.raw
  modified_base (186)..(186): a, c, t, g, unknown or other
  misc_feature (186)..(186): n is a, c, g, or t
  modified_base (216)..(216): a, c, t, g, unknown or other
  misc_feature (216)..(216): n is a, c, g, or t
  modified_base (352)..(352): a, c, t, g, unknown or other
  misc_feature (352)..(352): n is a, c, g, or t
  modified_base (422)..(422): a, c, t, g, unknown or other
  misc_feature (422)..(422): n is a, c, g, or t
tcagtcgcactagtcacgaccggtgctcgatttagtagtgtagattcgcggggacccaaaaaccacacccctccttgggagaatccctagatcacagctcctcaccatggactggacctggagcatcctttctggtgcagcaacaacaggtcgccactcccaggttcagcgtggtacagtctggancctgagatcgacgacgccgtgggcctacgngtacggaacgttctcctgacaggtcttcgtgttaacctaccttaaccaattgtgtacgtctagggttggtcgcgtacgagtccccgtgacgtaagggttcacggtagtacggagtcggtatcggtatcgacgtacncgttaacaagtcgtaacacgtaactaaacgcttcgaccgacgtaaacgacctacggacggtcgtacgacncgtaaccagtaccgactaacacgtaacactacgaccgacgacgtacgaccggacttaacgacgtacgtactacgggtacggacgtctacggaatcaaccggttagaccgtaacgcccgtagtaccgtattaccgtacggtggtaaccacggtacggtacgggttacgtaagtttcgttaccgtaccgtacgttaccgtagtttacgacggtaccggttacgggccgttaacggtaccgtcgg

SEQ ID NO: 197971 - DNA, 714 bp, Homo sapiens
  misc_feature: GYAE6OF02FK94X.39.81.H04.1.454.CMB.1.raw
  modified_base (265)..(265): a, c, t, g, unknown or other
  misc_feature (265)..(265): n is a, c, g, or t
  modified_base (271)..(271): a, c, t, g, unknown or other
  misc_feature (271)..(271): n is a, c, g, or t
tcagtcgcactagtcacgaccggtgctcgatttagtagtgtagattcgcgggggacccaaaaaaccacacccctccttgggagaatcccctagatcacagctcctcaccatggactggacctggagcatccttttcttggtaggcagcaacaacaggtgcccactcccaggttcagctggtacagtctggagctgagatgacgaagcctggggcctcagtgaaggtctctgcaggcttctgttactaccttacaactatgtatcngttggngcgacaggccctggacgtaggcttggagtaggagtgggatggactcgagcgtcttaacgaagtggtacacctaacaaactagtacgacaacaacgtaaccctaccgacgggtacacggtacgtaccaaccagtacgaaccctaacgaacgtaaccgaactactacccgaacgaacgacccggtaacccggaccctaaacgaattaccgggaaccgtaggaacgggaaccgttccggtaacggaagtacgttacggtacgtaaccggaaccggtaacccggggtacgttacgttaacgttacgtacggtacggacggtaggaacggttacggtaacgggttaaagtttaaggtttacgtaccgttaccgggttaaccccttttagtttacccggtaccgttaccgggtacggggaacccgtaaccggggtaacccggttaccgg

SEQ ID NO: 197972 - DNA, 901 bp, Homo sapiens
  misc_feature: GYAE6OF02H0IXH.39.81.H04.1.454.CMB.1.raw
  modified_base (335)..(335): a, c, t, g, unknown or other
  misc_feature (335)..(335): n is a, c, g, or t
  modified_base (399)..(399): a, c, t, g, unknown or other
  misc_feature (399)..(399): n is a, c, g, or t
tcagtcgcactagtcacgaccggtgctcgatttagtagtgtagattcgcggggacccaaaaaaccacacccctccttgggagaactcccctagatcacagctcctcaccagtggacctggacctaggagcattccgtttttctgggtaggcagacaaacgaacgacgggtcaccctactacccgagggttcacggctggtaacagttccgttagggactcgtagagatacggaacgacgccggtgggtcctagacggtcggaacgttctcgtcgactaggtcttcgtacgttaacctacttaacctaagtcgtagtactcgtaggtttagcgacngtaaccggcctaaggaacggtacggtacgttggtaagggtcggaggttacgggtacgtacgganaccgtacggtaccgttaccgtaaacggtacgtccggtaacctaaacccgtaaagttaacgtaccgtaccggtaccaaaggttcccttaaaaccgggtacggacggggaactaacccgggttaagtaccgttaaacccgcggttaaaccgggaacccgaaacgtaacgggaaccctaacgggttacccaaaacccgggtaacgtaacccggaccggttaaacccgggtaccgttaacgtaaaccgggttaccgtaaccggttaaccggtaaacggttaccggttacggtaaccgtacgtacgttaacgaacggtaaccgtacgaccggttacgttacgttaccgttagtcggtagtaccgtaacggtaacgacgggttaacgttaacgtttaacggttaacccggttacggtttaacccggttacggttacccgttttacgggttaacccgtaccgggttaaccgggggtacccgttaaccgggtttaccccggttaacccgg

SEQ ID NO: 197973 - DNA, 805 bp, Homo sapiens
  misc_feature: GYAE6OF02JLU2K.39.81.H04.1.454.CMB.1.raw
  modified_base (385)..(385): a, c, t, g, unknown or other
  misc_feature (385)..(385): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtctctgcaaggcttcgtggttacacccgtttaccaactagtggtatctaggttgggtgcgacgcggcccgtaggacgtaagggtcttaggaggtaggagtgggagtggtacgtcgaaggccgtaccgttaacgagttcggtacaacgaacctaaaacgtntcggactaaccgaaccgtaaccgtccggaacgggactaaggtaccgtacctaaacccaggtaccgaacccgaacgaacgaaccgtaactaccgtacccgaacggaacgaccccgtaaacccgggacttaaccggtagtaacccgggtacccgaaggggtaaccgaaccgtaccggttaacggaacgtacggttacccgtaacggaacccggtacccggtaaaccggtaccgttaacgttaacgttccgggtacggttacggacccggaagggttaacgacggggttttaaaaccggggtaagttttacggttttaacggaacccggttaacccggtttacccgttttaacgttacggttaaccccgggttaaacgggttcccgggggaacccggtacccgggtttaaccccggtcccggg

SEQ ID NO: 197974 - DNA, 762 bp, Homo sapiens
  misc_feature: GYAE6OF02INBGX.39.81.H04.1.454.CMB.1.raw
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtctccgtgcaaggcttctggttactacctttaccaactagtggtactcgtagttaggtcgacgacgcggcccgtaggacgaagggtcttaggacggtaggaggtgggagtggagtacgacgtcgtacgttaacgtaagttaccggacaacgaacctaaatagtacgaccaacgtaaccgaaacccgtccgaacgggacgaggaacgtacgtaaccagtaaccgaccaaccgtacggaaccaaactaccggtaccaaccgacgaccggtaaccggtaccctaacgtaacgtaccggaccgtaggacggtaaccgtccgtggaactagttaccacgggtaaaccgacccggtacccggtaccggttagttaaccggttttacgacggttacggacggtaagtaacgggtacggttaaacggggttaactttaagttttaccggtaacccgtttacgggttacccgttttaccgtttacgggaacccttaccgggggttaccgggggaacccgttaacgggggtaccccgtttaccgggg

SEQ ID NO: 197975 - DNA, 853 bp, Homo sapiens
  misc_feature: GYAE6OF02FPW3W.39.81.H04.1.454.CMB.1.raw
tcagtcgcactagtcacgaccggtgctcgatttagtagtgtagattcgcgggggacccaaaaaaccacacccctccttgggagaatccccctagatcacagctcctcaccatggactggacctggagcatcctttcttggtggcagcaacacaggtgcccactcccagttcagctggtacagtctggagctgatatgacgaagtccgtggggcctcgagtcgtaggtcctccgtgactaacggtcttacgttgggttacccttaaccgtttacccaacttagttcggtactacgtaggttgggtacgaccggaccgtaccggtacccgtacggtacgtacggtacgtacggtaaggtggtacggtagggtacgtaggtacgtacggtacgtacgtacgttacgtacgtacgtacctaacgtaacctaacgtacgtacgaccgtaaccgtaaccggtaacccgtaccgggacggtacgtaacggtaccgtacccgtaaccgtaccggtaaccggtaacccgtaaccggtaacccgtaacctaaccgtacccgtacccgaaccggtaccggaaccgtaaccccggtaccctaacgtaccggtaccgtaacggtaacgggtacggtaccgtacggtaacgtaccggtaccgtaccggtaaccggtaaccggtaaccggtacccggttaacgtttaacgttacggtttaccgtggtaacggtacggaaggtacggtaacgggtaacggttaacggtttaacggtacggttacccgttaaccggtttaccgtttaacggttaccggtaccggttaccgggtacccgggtaccgggttacccggttaccggtaacccgg

SEQ ID NO: 197976 - DNA, 829 bp, Homo sapiens
  misc_feature: GYAE6OF02HW1PN.39.81.H04.1.454.CMB.1.raw
tcagtcgcactagtcacgaccggtgctcgatttagtagtgtagattcgcggggacccaaaaaaccacaccccctccttgggagaatcccctagatcacagctcctcaccatggactggacctggagcattcctttttcttgggtaggcacgcaaacaacagggtcgcccactcccgaggttcagtctggtacagtcgtggagctgagatggacgaagccgtgggcctacgagtgaacggtcctccgtgacaaggtccttcgtacggttacctaccttttaacaactagtaggtatcgtaggttcgggacgccgacgaccggtcccgtaggaacgtaagggtcttgggtaggtagggtagtagggaagtgggtactacggacgtccgttaaccttaacgtaacggttcggaaccaaaccgtaaaccgtaaaacctagtaccggaacctaaccgtaaaccggtaacccctcgggtaacgggaacctaacggtaaccgttacccaaccgtaacggtaacccgaaaccctaaaccggaaccgaacccgaaacccgtaccgtaaacccgaaaccgggtacgaaacccggtaacccgtaccgttaaacccgaggttaacccgggaaccgtgggaaacgggtcctaacggtacggtaagtcggttaccgacgggtaaaccggtaacggttaccgggtaccgtttaagttaccgttggtacggttacggaacgtagacggttaaggtttaaccggggtaatttcgggttacgttaccgttccgttacgtttcgtacgttaccggacggttaccgggaccttacgggtaccgttccgg

SEQ ID NO: 197977 - DNA, 673 bp, Homo sapiens
  misc_feature: GYAE6OF02FRR81.39.81.H04.1.454.CMB.1.raw
  modified_base (256)..(256): a, c, t, g, unknown or other
  misc_feature (256)..(256): n is a, c, g, or t
  modified_base (355)..(355): a, c, t, g, unknown or other
  misc_feature (355)..(355): n is a, c, g, or t
  modified_base (374)..(374): a, c, t, g, unknown or other
  misc_feature (374)..(374): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaggtctcctgcaaggcttctggttacaccttacaactntggtatcagttggtgcgacgacggcccctggacgaagggcttggagtggagtgggatggatcgaggcgtacttacgaagtggtacaacaactaaactanacgacaacgacgtaacccnccgaagggcaagacgtaccacagtcgaaccacagaccacacaccgacgacgaccgaccggtacctacgagtaccggaccgtaggacggactaccgtaggacgtactccgtacgaaccggaccgtaccgggtacgttagttaccgtttacgtggtacggtacggaggaaggttacggtaacggggttaaattttacggtttaacggtaccgtttaccggtttaaccccgtttaggtttaccggtaaccggttaccggggtaccgggggtaacccgtaacgggggtacccccttaccgggg

SEQ ID NO: 197978 - DNA, 984 bp, Homo sapiens
  misc_feature: GYAE6OF02FVRYJ.39.81.H04.1.454.CMB.1.raw
tcagtcgcactagtcacgaccggtgctcgatttagtagtgtagattcgcggggacccaaaaaaccacacccctccttgggagaatccccctagatcacagctcctcaccatggactggacctggagcattccttttcttggtggcagcaacaacaggtgcccactcccaggttcagctaggtacagtctggagctgagatagacgaacgccgtcggggcctacgaggtaggtaacggttccttccgtacggacgaacgggtccgtttcgttacggtttaacccttaacccttttaacccgtaacgttagttacggttaacttaccggttaaggtttcggggtacggtacccggaaccggtaccgggtccccccggtaagggaaccgggtaaacggggttcgttagggtaacgggtagggtagggttacgggggaagtacgggtacgtaccggacggtaccgttaaccgttaaacgtaacgttacgggttaaccaaacctaaactaaaacgtactaccgtacgaaccgtaaacgaacccgtacggaacggaacgtaacggtaacgtaccgaacctacgtaaccgaacccgaacgtaacgaaacccaaccgttaacgtaaccccgaacgggtaacgaccccggtaacccgggtaaacccttaaccggtaaccggttaaccgggtacccgtaaacgggtaaccggggtaaccctacccggttaaaggacccgtacgtttaaccggaacccgggaaccggtaaacccgggtaccggttaaccgtttaacggtttaacgtttacccggttagggtaaccggtacggggtaaaggtaacggttaaccgggtttaaacggggttaaagttttaacggtttttaccggaaacgtttaccccgggtttaaccgtttacggtttaacccgggttaccggtaccggggtttaccccggggaaccgggttaacccgggtcccggtttaaccccggg

SEQ ID NO: 197979 - DNA, 779 bp, Homo sapiens
  misc_feature: GYAE6OF02GVCMM.39.81.H04.1.454.CMB.1.raw
  modified_base (201)..(201): a, c, t, g, unknown or other
  misc_feature (201)..(201): n is a, c, g, or t
tcagtcgcactagtcacgaccggtgctcgatttagtagtgtagattcgcggggactggacctggagcatccttttcttggtggcagcaacaacaggtgcccactcccaggttcagcctggtacagtctggagctgagatgacgaagcctgggcctcagtgaagtctcctgcaaggcttctggttaccacctttaccaactntggtatcgtaggttggtgcgacacggccctggacgaaggtctagagtggagtggagtggatacgagtccgtactttaacgaagttcggtacaaccgtaactaaacttaagtcgaccaaaccgtaacgtaaccccgttaccggacggactaacggtaccggtaccaaccgtatacggaacccaaccgacggaaccaacctaccgtaccgaaccgtacggcccgtacccgtaccctaacgtacgtacccggaaccgtagggacgacggttaccgtaaggtacgtacgttacgtaccggaaccggaacccgaccgggttaccgttaacgtttacgtttacggtacgtcggaacggaggtaaacggtaacgggttaaggggttaacttttaacggttacgttaccggtttaccgtttaccccgtttggtttaacgtcccggttaagggtacccggggacgttaaccgggtacccgttcggtacctcccgttacctccgaccgtaccgtcccgtaaccacccgggtaccgaccctaccgttcccgttaccccgtcccgtccgtacccgtcccttaccgacccg

SEQ ID NO: 197980 - DNA, 700 bp, Homo sapiens
  misc_feature: GYAE6OF02G2EK7.39.81.H04.1.454.CMB.1.raw
  modified_base (368)..(368): a, c, t, g, unknown or other
  misc_feature (368)..(368): n is a, c, g, or t
tcagtcgcactagtcacgaccggtgctcgatttagtagtgtagattcgcgggacccaaaaaccacacccctccttgggagaatcccctagatcacagctcctcaccatggactggacctggagcattcctttttcttggtggcagcaacaacaggtgcccactcccaggttcagctggtacattctggagctgagatgacgaagccgtggggcctgagtgaaggtctctgcgaggcttcgtgttactacttacaactatggtatctaggttggagcgacgacggccccgtaggacgacgggtcttaggacggtaggtagtggggtataggactcggagcgtactacagtcggtcaacgaactaaactntagaccacaacggtaaccctcggaagggcgaggtacgtaccaacgactacgaacctaacgacgaaccaccacgtaccgaacggacgacccgaccggtacctacgtacggtacgaccgtaggtacggcgtacgtggaatacgtccgaggaaccgaccggtaccggtaccggttacgttaacgttccgtaggtacccggaggtacgggacgtaggggtaacgggttaattttacggtttaaggtaccggttaacccggttacccgtttacggtttacggtaaccggtttacgggtacccgggggtaaccttaccggggtaacccgtttaccggg

SEQ ID NO: 197981 - DNA, 712 bp, Homo sapiens
  misc_feature: GYAE6OF02G9V5B.39.81.H04.1.454.CMB.1.raw
  modified_base (313)..(313): a, c, t, g, unknown or other
  misc_feature (313)..(313): n is a, c, g, or t
  modified_base (391)..(391): a, c, t, g, unknown or other
  misc_feature (391)..(391): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagcctggtacagtctggagctgagatgacgaagccgtggggcctcaggtgaaggtctcctgcgaggcttctggttacacctttaccactatggtatcgtagttgggtgtcgacacgggccccctggaacaagggtcttaggngtggatggggatggatcgagcgtctacaagtggtaccacaactaactatcgacacgacgaaccctccgagggacgagngtccacatcgaccacacgaccacactccgaacgacgccgaccggcctaaccgaggtaccgggacccgtagggacgggtacgtaccgtcggaaggtactcggtacgaaccggtaccgggtacccgggtccgggttaacgttactttaacgttacgggtagtacccgggtaaggaacggtacgggttaaccggggttaaacgttttacggttttaacggtaccccgggtttaccggggtttacccctttacgttttacggtacccggtttaccgggtccggggggtaaccccgggttaaccgggtaccccgggtttaaccggg

SEQ ID NO: 197982 - DNA, 654 bp, Homo sapiens
  misc_feature: GYAE6OF02F4D7A.39.81.H04.1.454.CMB.1.raw
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctctgcaagcttctggttaccacctttaccaactatggtatctagttgggtgcgacgacggcccctaggacgaggtcttgaggtggagtgggataggatacgaggcgtacttacgaagtcgtacaactaactaactatgaccgaacacgaacctccgaacggacaagactaccgaacagtaccgaaccaacgaacgaacaccactaccgaacgacgaccgaccggcctaacgacgtacgacgtaggaagcgtcgtagagtactcgacggaccgacgtaccggtcgttagtacgttagtcggtagacgtaagaggtaggttaagggtaacttttacggtttaacggaccgtttacccggttacccgtttaggtttaacggtaccgtttaccgggaccgggtacccggttaacgggtcccggttaacccgg

SEQ ID NO: 197983 - DNA, 743 bp, Homo sapiens
  misc_feature: GYAE6OF02GAC8A.39.81.H04.1.454.CMB.1.raw
  modified_base (582)..(582): a, c, t, g, unknown or other
  misc_feature (582)..(582): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtgggcctcagtgaaggtctctgcaagtcttctgttacctaccttaccaactatggtatcgaggttgggtgcgacgacggccccgtggacagggtcttggacgtggagtgggatggactacgaggccgtcttaacaagtcggtaccaagtaacgaaacttagtgacctaacgaacgtaaccctccggaagggacaggtacgtaccaacgtactaccggaacctaacgacgtaaccacctaactacccgaacgaccgaccgtaaccggtccctaaacgtacgtaaccggtaccgtacgggaaggtaccgtaccgttaggacgtaccgttaaccggtaaaccgaccgtaccgggtaccgtttacgtaacgtttaccgnggttacgaccggaagggtaacgggtaccgtacggggttaaactttacggtttaacggttaccggttaaccggtttccgttaaccggttttacggtaacccggttaccggggttaccggggtaacccgggtaccgggttaccccggttacggttacccccgg

SEQ ID NO: 197984 - DNA, 702 bp, Homo sapiens
  misc_feature: GYAE6OF02I6JZO.39.81.H04.1.454.CMB.1.raw
  modified_base (157)..(157): a, c, t, g, unknown or other
  misc_feature (157)..(157): n is a, c, g, or t
  modified_base (196)..(196): a, c, t, g, unknown or other
  misc_feature (196)..(196): n is a, c, g, or t
  modified_base (347)..(347): a, c, t, g, unknown or other
  misc_feature (347)..(347): n is a, c, g, or t
  modified_base (366)..(366): a, c, t, g, unknown or other
  misc_feature (366)..(366): n is a, c, g, or t
  modified_base (389)..(389): a, c, t, g, unknown or other
  misc_feature (389)..(389): n is a, c, g, or t
tcagtcgcactagtcacgaccggtgctcgatttagtagtgtagattcgcggggcacccaaaaaccacacccctccttgggagaatcccctagatcacagctcctcaccatggactggacctggagcattccttttcttggtggcagcaacacaggtncccactcccaggttcagctggtacagtctggagctgagntgacgaagtccgtgggcctgagtgaacggtctccagacgaaggcttcgtggttaacctacccgtttacaacttgtcggtaacttcgaggtttggagcgacgacgtccccgtaggaaccgtaagggtcttaggagtgggagtgggatacggntacgacgtactacgttaanaacgtcgtaccaacaacgactancgacaaacgtacgacctacggacggaacgacgttaacgccaacgagtaccgaacacgaagtaacactagtaccaacgcgaccgtacggacctaagacgttaccggacttaggacgactacggtacgaacgtccacggacgacccggtaccgtacggggtacccttaggtaacctttaccggttagaccgtcgtaaaggcccggttaaggttaaccggaacgttttaagtttacccgggtaacttaccggtttacccgttacggtttcaaacccgggttttggaacccggggttaccgtacccggttaacccgg

SEQ ID NO: 197985 - DNA, 836 bp, Homo sapiens
  misc_feature: GYAE6OF02IKGHQ.39.81.H04.1.454.CMB.1.raw
  modified_base (186)..(186): a, c, t, g, unknown or other
  misc_feature (186)..(186): n is a, c, g, or t
tcagtcgcactagtcacgaccggtgctcgatttagtagtgtagattcgcggggacccaaaaaacccacacccctccttgggagaatcccctagatcacagctcctcaccatggactggacctggagcatcctttttcttggtggcagcaaacaacaggtgcccactcccaggttcagcgtggtacngtctggagcgtgagatggacgaagccgtggggctcgaggtagaacggtctcgtcgacgtaagtccgtttcgtacggttaacctacccgttttaaccaagttacgttggtataccgtaaggtttggggtgaaccggtacgtacccgggcccccgttaagggaacgaacggggtcgtttagggacgggttcgggtaagggttacgggtaagtgggtaacgttcgaacggtcgtacttaacgtacgtacggtaccgtaaacaaaccttaaacggtacgtacggaccgaaacccgtaacggtaaacccctacggaacgggtaacgtaacgggtaacgtacctaacccgtaacgttaaccggtaacccaaacgtacgaaacccgagtacctacccgaccgaacgacccgtaacggaacctacggacgtacgggaaccgtaagggacggtaaccgccgttaaaggcgtaacgtacggtacggaaccgtacgaccgggttacgttacgttacgttagtccggtagaccggtaaggtacgtacgggtaagtttaacggttagtttaccggtaaaccggtttccgttaacccgtttgttaccggtaaccggttaccgggtaaccggggtaccccggtaccgggtaacccgttacccggg

SEQ ID NO: 197986 - DNA, 908 bp, Homo sapiens
  misc_feature: GYAE6OF02HSGNY.39.81.H04.1.454.CMB.1.raw
  modified_base (197)..(197): a, c, t, g, unknown or other
  misc_feature (197)..(197): n is a, c, g, or t
tcagtcgcactagtcacgaccggtgctcgatttagtagtgtagattcgcgggggacccaaaaaccacacccctccttgggagaatcccctagatcacagctcctcaccatggactggacctggagcatccttttcttggtggcagcaacaacaggtgcccactcccaggttcagctggtacagtctggagctgagangacgaagcctggggacctcgaggtgaaggttctccgtagacgaaggtccttacgttggttacctaacccttttaaccaactagtcggttaatcgtaaggtttggggtgaccgaaccgtacggcccccgtagggaaccaaaggggctttaggaacggttggtaagtacgggggtattcggggaagtccgaaggtccgtactttaaaccgtaaagtacgggttaccaaccgtaaaccgtaaaacgtaacgtacgaccgtaaaccgtaaaccggtaaccccgttaccggaacggggaacctacggtaaaccggtcccgaaacccttaaacggttaacgaaccccgtaaaaccaaccgggaaacctaaccaaaccgtttaaccccgaaaccggtaccggtacccgtaaacccggggtacccttaaaccgaaccggttaacgggtaaacccgttggggaaacggtaccggaccggtacgaacggtaaccgtacgtacgaaccggaacgtaccggggtaccgttaacggttacgttaaccgttggtacggttaacggaacgtacgggtacgggtaacgggtttaaaaccggttaacgtttttaccggtaaaccggtttacccggttaacccgttttaccggttttaacggttaacccggtttaaacgggtacccggggttaaccgggtttaacccggggtaccccgtttaacccggg

SEQ ID NO: 197987 - DNA, 981 bp, Homo sapiens
  misc_feature: GYAE6OF02ITFI1.39.81.H04.1.454.CMB.1.raw
tcagtcgcactagtcacgaccggtgctcgatttagtagtgtagattcgcggggacccaaaaaaccacacccctccttgggagaatcccctagatcacagctcctcaccatggactggacctggagcattccttttcttggtggcagcaaacaacaggtcgcccacgtcccgtaggttcagctacggtactaggttcgtaggagctaggagtatacgaacggtaacgtccggttacggggccctacgaggtaggtaacgggttcctaccgttaggaccgtaaacggttccgtttacggttaacgggtttaacccttaaccccgttttaaacccgtaaaaccgtttagttacgggttaaccgttaccggttaagggggtttacggggtacggtacccggtaaccggtaccggggtacccccgtaacggggaaccggtaaacggggttccgtttagggacggtttagggaagggttacggggtaagtaaggggtacctaaccgggacggtaccggtttaaccttaaacgtaacggttcggtacctaaaccggtaaacctaaacgttacgtacgaactaaaccggaaccgttaacccgtacggaacggaccgtaggtaacccgtaccaaccgtagtaacccgaaccggaacgtaaccgaacaccgtaaccgtaacccgtaaacggccgaacggtacccgtaaccgtaagtaccggggttaccgtaaccggtgggaaccggtaccggacgtaggaaacggtcctacgggtacgaacccggtaccggaaccgggtttccgttaaaggttccgttaccgggtaacggtacggaaaccggtacggttacggggtaacgggttaaacggttaacgttttaacggtttaccgggaacccgtttcccggtttaacccgtttacggtttaaccgacccgggttttaacccggggtaccgggtaaccccggttaaacggtccccggtacccggg

SEQ ID NO: 197988 - DNA, 665 bp, Homo sapiens
  misc_feature: GYAE6OF02FNDTC.39.81.H04.1.454.CMB.1.raw
  modified_base (263)..(263): a, c, t, g, unknown or other
  misc_feature (263)..(263): n is a, c, g, or t
  modified_base (574)..(574): a, c, t, g, unknown or other
  misc_feature (574)..(574): n is a, c, g, or t
tcagtcgcactagtcacgaccggtgctcgatttagtagtgtagattcgcgggggacccaaaaaccacacccctccttgggagaatcccctagatcacagctcctcaccatggactggacctggagcatccttttctggtggcagcaacaacaggtgccactcccaggttcagctggtacagtctggagcgtgagatgacgaagtcgtggggcctcgagtgaaggtctccgtgcaaggtcttctggttaccacctttacaactntaggtatctaggttggtgcgacgcggccctaggacgagggtcttggagtgggtagtgggataggtacgtcgaaggcgtactttaacgacgtggtaccaactaactaactagtcgacgaacgtaccgaacccgtccggagggacgaacgacgtaccgaccaagtacgaacccaacgaacgaaccgaacctaacgtacccgaacggaccgaccgtaacccggacctacgtacggtacggaccgtgggacgacgtaccggagacgtacgtcgtaacggacgaccggaccggtacgttagtactacgtggtacgnggaacgtgtacggtaaggtaagtttcgttacggtacgttccggtacttcgttacgtagtaccggtccgggtacgtaccggtcgtaacccgg

SEQ ID NO: 197989 - DNA, 679 bp, Homo sapiens
  misc_feature: GYAE6OF02GV0GG.39.81.H04.1.454.CMB.1.raw
tcagtcgcactagtcacgaccggtgctcgatttagtagtgtagattcgcgggggacccaaaaaaccacacccctccttgggagaatcccctagatcacagctcctcaccatggactggacctggagcatccttttctggtggcagcaacaacaggtgcccactcccaggttcagctggtacagtctggagctgagatgacgaagccgtcggggcctcagtgaagggtctacctgcgaaggcgttctcggttacacctttaccaactatggtatcaggttggtgcgacacggcccctggacaagggcttgacgtagggactggggatgggactcgacggctacgttacagtcggtacaacaactaacctatcgcaacgaacgacccgtccgaggggcaaggactcgaccatacgacctacagtacacactaccaacgacgaccggaccgtaccgtacgacgtccggggaacctacggaacgggacgacccgttaggaacgacgttacgtacggaaccggtaccgaccgggtccgttacggttacgtttaccgttcggtggacgaaggtacggtacggtaacgggggttaaactttaggtttacgtacgttaccggtttaccctttgtttacgtaccggttaccggtaccggggtaccggtaccgggtacccgttaccggg

SEQ ID NO: 197990 - DNA, 835 bp, Homo sapiens
  misc_feature: GYAE6OF02JFXZ5.39.81.H04.1.454.CMB.1.raw
tcagtcgcactagtcacgaccggtgctcgatttagtagtgtagattcgcgggggacccaaaaaccacacccctccttgggagaatcccctagactcacagctcctcaccgatggactggacctggagcacttccttttctcggtggcgagcgaacacgaggtcgccactcccgtaaggttcagcgtaggtacaagtcgtggacgcgtgagagtagacggaacgtccgtacggggaccttacgacgtacggtaacggtctaccgtggaccaaacggtcttacgtacggttaaccgtaacccgtttaaccgaaacgttacgtacggtaacgtacgtacggttacggtacgacggtaacgtaccggtaccagggggtaccctaaagggggacctttagggaacgtttcgggaacttcggggaacttacggggaacttaccggaacggtaccgacgtttacgaaacgttacggtactaacggtaactaaaacgttacgtaacgtacgtaacgtaacgtaaaccgtaccgtaacgggactaaacggtacgtaacgaaccgtaacgtaacggaaaccgtaacgaacggtaaccaacgtaacgtaccgaaccgaacggtaacccgtaacggtacctaaacggaacgttacggaaaccgttacgggaaccggtaacggaccgttaacggaacgtaacgtacgtacggaaccgaacgtaccggacgttacgtacgttaacgtacggtacgacgtacgtacgagtacggtaagttaacgtttacgtaacgttacggtaccttacgttacgtacggtaccggtacggtacctacggtaaccgtcgg

SEQ ID NO: 197991 - DNA, 875 bp, Homo sapiens
  misc_feature: GYAE6OF02FKNJT.39.81.H04.1.454.CMB.1.raw
  modified_base (431)..(431): a, c, t, g, unknown or other
  misc_feature (431)..(431): n is a, c, g, or t
tcagtcgcactagtcacgaccggtgctcgatttagtagtgtagattcgcgggggacccaaaaaaccacacccctccttgggagaatcccctagatcacagctcctcaccatggactgacctggagcattccttttcttgtggcagcaacaacaggtgcccactcccgaggttcagctggtacagtcgtggagctagagatgacgaagccgtacggggtcctacgtagtcgaacggttcctaccgtcggacgaaggtcctttcgtacggtttacctaccgtttaccaacgttagtggttactcgtagggtttcggtcgtcgacgaccggtacccgttacggaacggaacgggtcgttaggtacggttgggacgtaggggtgtacggtagtcgagtcgttcttaacgtagtacgtttaccgaacaacctaaancgttacgacctaacgaactacccgacgaacgggcaacggtacgtaccgacgtacgtaccaacctaacgacgacccgtaactaacgtacccgaaccggaccgtaaccgtacccggtaccgttaaccggtacgtacccgggaacgttaccgggtaacggggtaacgtaccggttaagacgggttacgtacccgggtaacgacccgggtaaacgtacccgggttaacgtttaacgggtttaccgtttaaccgttacggttacgggtaaaccggtacgggtaacggtaacggggttaaaccgggttaacggtttttaacgggttttaacggttaccggtttaaccccggggttaaccttttacccggttttaacggttacccggttaaccggggttacccggggtttaaccccggtaaacccgggggtttaccgtttaaaccccgggg

SEQ ID NO: 197992 - DNA, 1011 bp, Homo sapiens
  misc_feature: GYAE6OF02G4ATO.39.81.H04.1.454.CMB.1.raw
  modified_base (204)..(204): a, c, t, g, unknown or other
  misc_feature (204)..(204): n is a, c, g, or t
  modified_base (223)..(223): a, c, t, g, unknown or other
  misc_feature (223)..(223): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagtcattcctttttcttggtggcagcaaacaacaggtcgcccactcccaggttcagtcgtaggtacagtctggagctgagntgacgaagccgtgggcctnagtagaggtctccgtgacaagcttcgtcgttactacctttaccaactagtggtatcgtaggttgggtgacgacgtaccggtcccgtaggaacgtaagggtcttaggtagggttacgggtaggtacggggtagtagggtaccttacggacgccggtaacctttaacggttaacgttaacgggtacctaaaaccgaaaccgtaaaacgttagtaccggtaacccaaacgggtaaacccgtaaacccgttaccggggtaaaccggggtaacgtaacggtaaccgttaaccgaaaaccccggtaacgtttaacccggggaaaaccctaaccgggaaaaccgggtaaccaaccgtttaaacccgtacccggaaaccgtaaacccggggtaacccggaacccggttaccgtttaaacccggaacgggttaacccgggtaacccggttaaggggaaccggtaaccgggttaccggtaaccggtaaacgttaacccggtttaaacgggacccgtaaaccgggtaacccgtaacccggggtttaccgttttaacggggtttaacctttacggtttacgggttacccggtaaaaccggggtaaccgggttaacggggttaacggggtttaaccgggttttaaaaacggttttcggttttttaaaccgggttaacccggttttacccgggtttttaaccccgttttaaccgggtttacccggttaaccgggttttaacccgggggttacccggggtaaccccgggtttaacccggggttaccccgtttaaccccggggg

SEQ ID NO: 197993 - DNA, 645 bp, Homo sapiens
  misc_feature: GYAE6OF02HHX69.39.81.H04.1.454.CMB.1.raw
  modified_base (269)..(269): a, c, t, g, unknown or other
  misc_feature (269)..(269): n is a, c, g, or t
  modified_base (343)..(343): a, c, t, g, unknown or other
  misc_feature (343)..(343): n is a, c, g, or t
  modified_base (375)..(375): a, c, t, g, unknown or other
  misc_feature (375)..(375): n is a, c, g, or t
  modified_base (450)..(450): a, c, t, g, unknown or other
  misc_feature (450)..(450): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtcgtggagctgagatgacgaagccgtggggcctcagtgaaggtctccgtgcgaaggtcttcgtcggttacctacctttaccaactntgtatcgtaggttgggtcgacgacgacggtccccgtggaacgaagggtcgttaggaggtggagtgggagtggancgacgcgtacttagagtcgacacaacaactgngacacgaacgaacctacggacggacagacgtcaacacacgaacacacacacactaccgagacgaccgacacctanacgtcgacgtggaacgtcgctagacagtcgacggacgaccggtacggccgttattacggttagtgacggaacgaggtaggtaacgggttagggttaaactttcggtttaaccggtaccgttaccgtttacccgttaggttaccgttaaccggtacgggtaccgggaacccggttaaccgggtacccggttaccgg

SEQ ID NO: 197994 - DNA, 963 bp, Homo sapiens
  misc_feature: GYAE6OF02FOKKU.39.81.H04.1.454.CMB.1.raw
  modified_base (185)..(185): a, c, t, g, unknown or other
  misc_feature (185)..(185): n is a, c, g, or t
tcagtcgcactagtcacgaccggtgctcgatttagtagtgtagattcgcggggacccaaaaaccacacccctccttgggagaatcccctagatcacagctcctcaccatggactgggacctggagcagtccttttcttggtacggcagcaacaacaggtgcccactcccaggttcagctggtacngtctggagctgagatcgacgaagcctgggggcctacgagttgaaagggtcctaccgttcgaccgaaagggtcctttaccgtagggtttaaccacccgttttaacccgaaaacgttacgtacgggggttaaacttccggaacggttagggggttacggtaccgggtaacgaccggggtacccccgttagggggaactaacgggggtaccgttacgtagggttacggggtaaccggttagggggtacgttcggggaacttccggtacgggccgttacgttaccgtaaacggttcggggtacctaaaccggtaaccgaaaacttagggttaccgaccggtaaccgaaccggggtaaccccttacccggacggggtaaccggaacggggttaacgtacccctaaaccgaccggttaacggaacccgtaaacgtaacccgggaacttacccgaaactaccccggtaaaccggaacgtacccgggttaacccgggaaccctaaaccgggtacgttacccggggtaacccgttagggtaaaccggggtaacccttaaccgggtacccgaaggggttaccgtaaccgggttcggaaacccgggttaacgaaccccggggttaccggttaacggttaacgttccgttagggtaacccggtgggtaaaccgtaggtaaccgggtaagggtaacgttttaacggttcggtaaacggttccgtttaaacccggtcgtttacggaaacccggttggttacccgggggactaccgggtaacggttcccgggg

SEQ ID NO: 197995 - DNA, 821 bp, Homo sapiens
  misc_feature: GYAE6OF02JFIY8.39.81.H04.1.454.CMB.1.raw
  modified_base (215)..(215): a, c, t, g, unknown or other
  misc_feature (215)..(215): n is a, c, g, or t
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtgggcctnagtgaacggtctcctgacaaggtcttctaggttacctacctttaaccaacgtagtggttatacgtaggttggtgacggacgacggccccgtggaccgaagggtctaggagtagggagtgggagtggactcgaggtcggtactttaacgtaacgtcggtaccaaacgtaacctaaaacgttacgtacgtaacgaacgtaaacccgtaaacccggtaccggaaacgggtaccgtaacggtaacgttaacccgaaccctaaacgttaccggaaccgtaaacggaacctaaaccgtaaacctaaccgtaacccgaaaccggacccggtaaccggaccccggtaacccgttaaccgtaaccggttacccgggaacccggttaagggaaccgggtaacgttacccgtaggtaacgtaccggttaaccgtaacgggaccccggtaaccgtacccggggttaccgtagtttaaccgttacgttacggtacggacgtaacgggaggtaaccggtaaacgggttaatttacgtttacgggtaccgtttaccgttaccccgttaaggtttaccggaccggttacgggtaccgggtaccgggtaacccggtaacccgg

SEQ ID NO: 197996 - DNA, 844 bp, Homo sapiens
  misc_feature: GYAE6OF02JI5J9.39.81.H04.1.454.CMB.1.raw
  modified_base (286)..(286): a, c, t, g, unknown or other
  misc_feature (286)..(286): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaaggtctccgtgcgaaggtcttcgtggttaaccaccgtttaccaactatggtattcaggttgggtncgacgacgcccctaggacgaggctgagtggagtggagtggactcgacgcgtacgttaacaagtggtacacgaacaaacgtatgaccaacgaacgtaaccctaccgagggtaccaacggtaacgtaccgaccgtaaacgtaccggaaccctaacgaacgtaaccaactaaccgtaacccgaaccgggaaacgtacccggaaacccggtccctaacgaacggtaccgggtaaacccgttagggaaaccgggtacgtacccggtaggtaaacggtaccctttaacgggtaaccggaaacccgggtacccgtaacccgggggttacccgttaaagggttttaaacctttacgggtttacggtaacgggtaaccggtaacgggtaaacgggttacgggttaaaaccgggggtaaaagttttttaccggttttaaccggtttaaaacccgtttaccgggtttaaaccccccgttttattttaacccgggtaacccgggttttaaaccggggtacggggggttaaacccccggtacccggggggtttaaaccccccgttacgggg

SEQ ID NO: 197997 - DNA, 654 bp, Homo sapiens
  misc_feature: GYAE6OF02H2DOR.39.81.H04.1.454.CMB.1.raw
  modified_base (147)..(147): a, c, t, g, unknown or other
  misc_feature (147)..(147): n is a, c, g, or t
  modified_base (193)..(193): a, c, t, g, unknown or other
  misc_feature (193)..(193): n is a, c, g, or t
tcagtcgcactagtcacgaccggtgctcgattttagtagtgtagattcgcgggggacccaaaaaaccacacccctccttgggagaatcccctagatcacagctcctcaccatggactggacctggagcatcctttttcttggtggcngcaacaacaggtgcccactcccaggttcagctggtacagtctgganctgagatgacgaagccgtggggcctcagtgaaggtctccgtgcaaggcttcgtagggttacacccttttaccgaaacttagtaggtatctaagttggggtcgacgacgacggcccctggaccaagggcttgagtggattgggagtgggtatcgaggacgtcttacaagttcggtccaacaacaaacgtatacgtacacgaactaaccctcgagggacaggtactcaaccatacgaacctacaacgaacacctaacgtaccaacgacgaccgaaccggtacctaacgacgtggaacccgtaggacggtacgccgtagacgtacttacggagaccgaacgtacgggaccgttaggtaactttagcgtaagccggaagagtacggtagggaatttaagttttcgaacgttcgttaaccccttgtttcgtaacttccggtacgggacgtacccgggtacgtacgg

SEQ ID NO: 197998 - DNA, 738 bp, Homo sapiens
  misc_feature: GYAE6OF02JJ32Z.39.81.H04.1.454.CMB.1.raw
  modified_base (338)..(338): a, c, t, g, unknown or other
  misc_feature (338)..(338): n is a, c, g, or t
tcagtcgcactagtcacgaccggtgctcgatttagtagtgtagattcgcggggaccccaaaaaaccacacccctccttgggagaatcccctagatcacagctcctcaccatggactggacctggagcattccttttcttggtggcagcaacaacaggtgcccactcccaggttcagctggtacagtttggagctgagatcgagaacgccgtggggcctcgagtaggaacggtcctccgtgacgaacggtctttcgtacggttacctacctttaaccaactattggtactcgtacggttgggtcgacgacaccggtcccctaggacgaagggtcctggnggtaggtagtgggacgtggatacgaggtacgtacgttaacgaagttcggtaccaacgtaaacctaaagtacgtcgacgaaactaccggaaacccgtcgaacgggtcaaccggtacgtaccaacctacgtaacgaacccaagtaacaccgaactaccgtacccgacgtacgaccggaccgtacgtaccaggtaccgaccgtacggaacggtaccgtacgtaaggacacgtacgtaacgaccggaacctacggtcccgtagttaacgttacgtggtacggaaccgagggtaaagtcggtaacgggttaattacggtttaaccgtcggttaccgtacccgtttacggtttacgaccggttcccgggtaccgtaaccgggtaaccggtccgttacccggtaccg

SEQ ID NO: 197999 - DNA, 685 bp, Homo sapiens
  misc_feature: GYAE6OF02I201O.39.81.H04.1.454.CMB.1.raw
  modified_base (378)..(378): a, c, t, g, unknown or other
  misc_feature (378)..(378): n is a, c, g, or t
  modified_base (427)..(427): a, c, t, g, unknown or other
  misc_feature (427)..(427): n is a, c, g, or t
  modified_base (569)..(569): a, c, t, g, unknown or other
  misc_feature (569)..(569): n is a, c, g, or t
  modified_base (601)..(601): a, c, t, g, unknown or other
  misc_feature (601)..(601): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatcttttctggtggcagcaaacaacaggtcgcccactcccaggttcagctggtactagtctggagctaggagtaagtgaacgaacgccgtgggggcctcgaggtggaacggtctccgtgaccgaaggtccttcgttacggttaaccctaccctttaaccaacgttacgtaggtactacgtaggtttggggtgacgaccgaccggccccgtagggaaccgaagggtctagggtaggtgggtaggtggggtagnggtagtcgagtcggaacctttacgtagtacgactaaccaactaaacgtntcgactaaccgaacgtaccgtaccgtaacggggacgtaacgacgtacgtaaccacgtaccgaaccaacgaacaacaccgtacgaaccacggtccgaacgaccgaccacgtacgcggtaccacgggacgtacgcgtagactanaccggtcgacgtaacgcggtcgtacttaagtnttaggagcgagtagggtacgaacgggtatttaaggtcgtacgtccgttacgtcgtacgtacgtcggaggccggtacggccgtcg

SEQ ID NO: 198000 - DNA, 621 bp, Homo sapiens
  misc_feature: GYAE6OF02FI51V.39.81.H04.1.454.CMB.1.raw
  modified_base (312)..(312): a, c, t, g, unknown or other
  misc_feature (312)..(312): n is a, c, g, or t
  modified_base (327)..(327): a, c, t, g, unknown or other
  misc_feature (327)..(327): n is a, c, g, or t
  modified_base (347)..(347): a, c, t, g, unknown or other
  misc_feature (347)..(347): n is a, c, g, or t
  modified_base (351)..(351): a, c, t, g, unknown or other
  misc_feature (351)..(351): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctctgcaaggcttctggttacaccttaccaactatggtatcagttggtgcgacaggcccctggacgaagggcttggagtggatggganggatcagcgtcttanaagtggtacacaacaaactngcanacgaactcgaggcagatcacatacgaccacacacacacaccacgacgcgaccgcctacacgtacggacctaggacggacgtaccgtaggacgacgttacgtacgacggaaccgtaccgggccgttagttaacgtttacgttaggtgaccggtaagaacggtacggtaacgggggtaaattttaagtttacggtaactttaccggttacccgttacgttttcggtaacttaccgggtacgggacccggtaccgggtaccccggttaccggg

SEQ ID NO: 198001 - DNA, 848 bp, Homo sapiens
  misc_feature: GYAE6OF02HSJ19.39.81.H04.1.454.CMB.1.raw
  modified_base (211)..(211): a, c, t, g, unknown or other
  misc_feature (211)..(211): n is a, c, g, or t
  modified_base (831)..(831): a, c, t, g, unknown or other
  misc_feature (831)..(831): n is a, c, g, or t
tcagtcgcactagtcacgaccggtgctcgatttagtagtgtagattcgcggggcccctagatcacagctcctcaccatggactggacctggagcatccttttcttggtggcagcaacaacaggtgcccactcccaggttcagctggtacagtctggagctgagactgacgaagccgtggggcctcgagtgaaggtctcctgcgaagtcttntggttacaccttaaccacgtatacggtatacgtaggttggtcgacgacgtacggcccctagggaacgtaacgggtcttaggaggtaggtacgtgggaagttgggaactacgtaacggtaccgttacgttaaacgtaaagttccgggtaaccaaaccttaaaccgtaaaaaccgttacgtacggtacccaaaccggtaaaccgtaaacccgttaccggggaaacgggtaccaaacgggttaacgtacccgaacctaaggtacccgaacccgaaaacgaacgaaccctaacgtaacgttaccccgaaaggaccgtaaccgaaccggacccttaacgacggttaacggaccccggttaggaacgggacccgttaccgtaggaaccggttacgtaacgtaaccggtaaccggtaacccggtaaccggttcccggttaagttaacgtttaacgtacgggtaaccgacggggttacgaaacggttacgggttaaacgggttaaaagttttcgtttaacgaaccggtttaccggttaaccgttacgttttacggaaacccggttacggaccggggtaaccgaaccgggtttaccgtcgaacccgttaccggtaccttcccggtaccnccgtacccctaacccgg

SEQ ID NO: 198002 - DNA, 744 bp, Homo sapiens
  misc_feature: GYAE6OF02I4IU8.39.81.H04.1.454.CMB.1.raw
  modified_base (231)..(231): a, c, t, g, unknown or other
  misc_feature (231)..(231): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcacttccttttcgttggtggcagcaacaacaggtgcccactccacggttcagctggtacagtctggagctagagatgacggacgcctgggcctcgagtagacggtcnccgtgcaagtcttctacggttacctacctttaccaacttagtacgtactcgtaggttggacgcgacacggtcccgtaggacctagggtcttggagtagggagtggactggattacgacgcgtactacgagtcgaacgacaactaactgacgacacgacgtacctcggacggtcacggactcgaaccgtactaacgacctacgacgtaaccactactaaccgacggacgaccgtacggtacctaacggacgttacggaccgtacgggtacggacctacgtaagacgttaccgtaggtaccgtaacgggacccgtacggggttacgttaccggttaactttacgggtaccggtaacggtaacggggaacgtttaacccggacgggggtttaaacggttttaacgtaacggttttttaccggaaccggttccggggttttaaccttaacggtttaccgggaacgtttacccgggggtaccgggacccgtttaaccggggtacccgtttacccgggg

SEQ ID NO: 198003 - DNA, 739 bp, Homo sapiens
  misc_feature: GYAE6OF02I6DNR.39.81.H04.1.454.CMB.1.raw
  modified_base (124)..(124): a, c, t, g, unknown or other
  misc_feature (124)..(124): n is a, c, g, or t
  modified_base (184)..(184): a, c, t, g, unknown or other
  misc_feature (184)..(184): n is a, c, g, or t
  modified_base (192)..(192): a, c, t, g, unknown or other
  misc_feature (192)..(192): n is a, c, g, or t
  modified_base (555)..(555): a, c, t, g, unknown or other
  misc_feature (555)..(555): n is a, c, g, or t
tcagtcgcactagtcacgaccggtgctcgatttagtagtgtagattcgcggggacccaaaaaccacacccctccttgggagaatcccctagatcacagctcctcaccatggactggacctggancacttccttttctggtcgcagcaacaacaggtcgacccactcccaggttcagctggtacngtctggancgtagagatcgacggaagcccggtggggtcccacgtggttaggaggttcctccgtggacgtaaggtccttcgttcggttaacctaacccgtttaccaaacttgtacggtactagtaggggtttcgggacggtaccgacaccgggtaccctggaaccgtagggtccttggaggttcggtaaggtgggaacttcggaattcgacggtcgtaactacgtaagtcggtaacacaacggtaactagcctagaaccgacttacgaccgtaggaacacgacgtactacctaagacgtacccgaagaccgtacaccgtaacgtacccgaaacgcttaacccgacggtaccctaaggacgacggttaaccgngaacggtccgacgagaacgtctacgacgtaaccgacgtaccggtacgtagtacggttacggacgtacggaccgaaaggtacgttacggtaaaggttaccggttacgtttacggacgttaacccggtttacgttaaccggttcgtaccggtaccgggccggttaacccgagggttacccgtacgg

SEQ ID NO: 198004 - DNA, 799 bp, Homo sapiens
  misc_feature: GYAE6OF02G5TJX.39.81.H04.1.454.CMB.1.raw
  modified_base (194)..(194): a, c, t, g, unknown or other
  misc_feature (194)..(194): n is a, c, g, or t
  modified_base (359)..(359): a, c, t, g, unknown or other
  misc_feature (359)..(359): n is a, c, g, or t
tcagtcgcactagtcacgaccggtgctcgatttagtagtgtagattcgcggggcacccaaaaaccacacccctccttgggagaatcccctagatcgacagctcctcaccatggactggacctggagcatccgttttcttggtcggcagcaacaacacggtgcccactcccaggttcagctggtacagtctgganctgacgatcggacgacgtccgtgggacctcgagtgaacggtctccgtgacagtccttcgtggttacctacctttaccaacgttagtggttatccgtaggttggggtagccgaacgaccggtcccctaggacgtaagggtcttaggagtggacgtgggatggtacncaaggctaacttagaacgtcggttaccaactaaccgtaaacttcgacggacctaacggaacgtaacccgtacgagggaccgaacgtacgacccaacgaactcgaaaccgacgaaacgaccctaactaacgtaccccggaacggtacgtaaccccgaaacggtcccgtaaactaagggtcccggtaaacggttacgaacggggtacctaaccggtagtaaaccgtacgtaccgtagggaaacccgggttacccgaacggttccgttaacgttaacgtacggttcgaaccggcggtaacgtacgggtaccgttaaaaggggtttaaaccctttcgggttttaacccggttaaccggttacccggtttttaaccctttaaccggttacggtaaaaccccgttgggggttaacccgggaacccccgttaccggggttaaacccg

SEQ ID NO: 198005 - DNA, 843 bp, Homo sapiens
  misc_feature: GYAE6OF02F1L2T.39.81.H04.1.454.CMB.1.raw
tcagtcgcactagtcacgaccggtgctcgatttagtagtgtagattcgcggggcacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcaggttgggtgcgacgacggccccgtaggacgaagggcttggagtaggagtggatggactcgaggcgtactacgtaagtggtcaacgaactaaactagtacgaccgaacgaacgtaaccctacgagggtcaaggtaacgtaccgaactacggttaccgaacccaacgaacggaacctaaccaacgttccccgaaacgacggtaaccgaccggtaaccctaaccgtacggtaccggaccggttaacggaacgggtaccgtaccgtaaggtaacggtacggttaccgttaacgggaaacccggtacccggtaaaccggggtacccggtttaacggttttacgtttaaacccgttagggttaaccgggacccgggttttaaaggggacgggttaaaccgggggtttaaaccgggggggttttaaaaacgtttttaacggtttttaaacccggggttaaccgggtttaccggtttttaacccccggtttttagtttttaaacccggtaaccccggggttttaccggggtttaacccggggggttaccccggggtaaaccccgggggtttttaaccccccgg

SEQ ID NO: 198006 - DNA, 667 bp, Homo sapiens
  misc_feature: GYAE6OF02JM9DT.39.81.H04.1.454.CMB.1.raw
  modified_base (227)..(227): a, c, t, g, unknown or other
  misc_feature (227)..(227): n is a, c, g, or t
  modified_base (331)..(331): a, c, t, g, unknown or other
  misc_feature (331)..(331): n is a, c, g, or t
  modified_base (419)..(419): a, c, t, g, unknown or other
  misc_feature (419)..(419): n is a, c, g, or t
tcagtcgcactagtcacgaccggtgctcgatttagtagtgtagattcgcggggacccaaaaaaccacacccctccttgggagaatcccctagatcacagctcctcaccatggactggaccgtggagcattccttttcttggtggcagcaacaacgaggtgcccactcccaggttcagctggtacagtcgtggagctgagatgacgagcgtgggacctgagtgagtcnctgcgagcttcgtgtacaccgttacactagtggtatcgtggttaggtcgacgacgtccggcccgtaggacgaaggtcttgacggttggagtcggtagtggactnacggtcgtacttagagttcggtaccacgtaaacaacgtgtcacgaacgacgtacctacgaggacagtacgtacacgaacgtcgaccanacgacacgactcgacgtaacgcctacggaactacgacgtaccgtacgtacgaacggtcaccgttgaaccgtcgacggtacgaaccgtacgcgggtacgttaattaccgttaccgtcggtaacgtccgtaggtaaggttaccggtaacgggtttatttaacggtttcggtacccgttaaccggtttaaccttcgttacggttacccggtaaggggtcccggggtaaactcccgggttaacccttacggg

SEQ ID NO: 198007 - DNA, 751 bp, Homo sapiens
  misc_feature: GYAE6OF02I120K.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcattccttttctggtggcagcaacaacaggtgcccactcccaggttcagcctggtacagtctggagctgagatgacgaagccgtggggcctcaggtgaaggtctcctgcgaaggtcttcgtggttaaccaccttttaccaacgttatggtacttcgtaggttgggtcgcgaacgcggtccccgtggaaccgaaggggtctggaggtcggtaagtggggattgggactacgaggtaccgtacgtttaacaaggttcggtaccaaccgtaacaaaaccgtttagtacgaacaccgtaacgtaaccccgtcgaacggggtaccaacgggtactacccgaactacggtacgaaacccacgaacgtaaccactaaccgtacccgaacgtaaccgaccgaccgtaccgtacgaacgttacggacgtacggacggacgaccggtagacgtattaccgtaggaacccgtaccggaccggtaccgttacgttaacgttacgtacggacggtaaccggtaagtaacggtacggttaaacggttaaccgttaggttttacgaaccggttaccgggttacctttaacgtttacggaccgttaccgggtaccgggtacccggtaccggttaacccgtcgg

SEQ ID NO: 198008 - DNA, 725 bp, Homo sapiens
  misc_feature: GYAE6OF02F1A3O.39.81.H04.1.454.CMB.1.raw
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgccccactcccaggttcagctggtacagtctggagctgagatgacgaagccgtgggcctcgagtgaaggtctccgtgcgaaggtcttcgtggttacctacctttaccaacttagtggtacttcgtaggttgggtgaccgtacgaccgggtcccccgtaggaacgtaagggtcgttaggaggttaggtaaggttggggacgtgggaatccgacggccggtactttaacgaagttacggtaccaaccgaaactaaactagtcgaaccaacgaaccgtaaccctacggaagggtacaacggtacgaccaaccgtacgtaccgaccaacaacgtaccaacgtactacccgaacgacgaccgaaccggtacctaacgacgtaccggtaccgtaggacgaccgtacgagaacgtactacggaacgacgaccggtaccggtaccgtagttaacgttcgtagtacggaacgaggacggtacggttaacgggtaattttacggttacgtaccggttaccgttaccttacggttacgtacggttaccgggacgggtaccggtaccgggtaccgttacgg

SEQ ID NO: 198009 - DNA, 790 bp, Homo sapiens
  misc_feature: GYAE6OF02FNAI3.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatcctttcttggtggcagcaacaacagtgcccactcccaggttcagcctggtacagtctggacgctgagatcgacgaacgccgtaggggcctcgagtgaacgtccgtccgtgacgaaggtcttcgtacggttacctaccctttaccaacgtgtaggtactcgtaggttggtcgacgacgaccggtaccctaggacgaacggtcgtacggtaggtacggtagtcgggtaacgtacggtagtccgacggtacgtaccgtaacgtaggttacggtacctaaacgtaaccgtaaacgttcgtaaccgaccgtaaccgtaaccttaacccgttacggaaccgggtacgtaaaacggtaccggtaacgtaacccgtaacggttaacccgacccggtaaaccgaacggacctaaacccgtacgtaaccgaacggtacggacccgtaacccggtcctaacggtaaaccgtcgggaaccctaggggaccgtaaccgtacggtagacccgtatcccggtacggaccgtaacggtcccgttaggtattacccgttagtcggtagaaccggttagaacgggttacggtagttaacgtttacggttaccgtacggtttaccgttaccgtaggttaccgtacggttcggtaccggggactttaccgggcgttacccggg

SEQ ID NO: 198010 - DNA, 867 bp, Homo sapiens
  misc_feature: GYAE6OF02GCGYT.39.81.H04.1.454.CMB.1.raw
  modified_base (191)..(191): a, c, t, g, unknown or other
  misc_feature (191)..(191): n is a, c, g, or t
  modified_base (481)..(481): a, c, t, g, unknown or other
  misc_feature (481)..(481): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcacttccttttcgttggtggcagcaacaacaggtgcccactccgagttcagctgtacagtctgganctgagatgacgaacggccgtgggcctagagttaggaacggtcctcgtcgacgtaacggtcttcgttacgttacctaccctttaactaacgttatcgttatcgtggttaggtcgcgacgaccggtcccgtaggaacggacgggttgtaggtaggtagggtaggtgggtaacggtaggtacgtcggtacggtacgtacttaacggtagttacgtacaaacgaaacgtaaactacgtaccgtaccaaacgaccgtaacccgacggtacggacgtaacggtactaacccggtanaaccgtaccgaaccgtaacccgaagaacctacgtaacccaaccgaacgtacggaacccgacccgtactaaacggtcggtaccgtaacgggtacggaaacggtccgacggtaagaccggttcgtaggaccggtaaccgtaaacggggtcggtttaacccgttagtttacgttaacccggggttagtaccggtaacgggggttaaacaccgggggttttaaaaggggttacccggggtttaaacgtttttaacggtttaccgggtaaacccggttttacccggtttttaactttcccggggtttaaacgggttaaccccgtttaccggggggtaacccggggttttaacccccggggtaaaccccggtttaccggggttaaccccggg

SEQ ID NO: 198011 - DNA, 790 bp, Homo sapiens
  misc_feature: GYAE6OF02HFRKR.39.81.H04.1.454.CMB.1.raw
  modified_base (665)..(665): a, c, t, g, unknown or other
  misc_feature (665)..(665): n is a, c, g, or t
  modified_base (675)..(675): a, c, t, g, unknown or other
  misc_feature (675)..(675): n is a, c, g, or t
tcagtcgcactagtcacgaccggtgctcgatttagtagtgtagattcgcggggacccaaaaaccacacccctccttgggagaatcccctagatccacagcctcctcaccatggactggacctggacgcacttccttttcgttgggtggacaggacaacaacagggtcgcccacttcccgtaggttcaggcgttaggtacagttcgtggacgtcgttagacgagtcggaacggtaacggccgtcggggtccttcgaggtaggtaacggttcctccgtcgacggtaacggttcttacggttaccggttaaccttaacccttaccgaacttagttacggtaaccgttgttagggttcgggtacgacggaaccggtaccggccccgtagggaaccgtaacggggtcctttaggacggttggacgggtgggtacgttagggaacttacggaccgtaaccgtttaccgttaaagtacggttccggaactaaacccgtaacctaaaacggttcgtaacgtaacccgaaagtaaccccgaaccggttacggaccggtacgtaacgtaccgtaccgaacctacgttacccggaacaacgaccgacgaacctacgtaccaacgggaccgacgacccgtaccacgtaccgtaggacgttacggacgtgtacgacgngtcgtaccgngaaccggttcgaccgtcgtagtacgttcgtacggcgtagaggtactaggttaggtaacgttgttaacgacgttcgtacgttacgtcggtacgtcggtaccggacgtacgccgtcg

SEQ ID NO: 198012 - DNA, 573 bp, Homo sapiens
  misc_feature: GYAE6OF02IUJQ0.39.81.H04.1.454.CMB.1.raw
  modified_base (456)..(456): a, c, t, g, unknown or other
  misc_feature (456)..(456): n is a, c, g, or t
  modified_base (464)..(464): a, c, t, g, unknown or other
  misc_feature (464)..(464): n is a, c, g, or t
  modified_base (493)..(493): a, c, t, g, unknown or other
  misc_feature (493)..(493): n is a, c, g, or t
tcagtcgcactagtcacgaccggtgctcgatttagtagtgtagattcgcgggggacccaaaaaccacacccctccttgggagaatcccctagatcacagctcctcaccatggactgggacctggagcatccttttcttggtggcagtaacaacaggtgcccactcccaggttcagctggtacagtctggagctgagatgacgaagccgtggggcctcagtgaaggtctccgtgactaaggcttctggttaccacctttaccaactagtggtatctaggttggtgcgacgcggcccctaggacagggcttggagtggagtgggtatggtactacgacgtccgcttaacgacgttcggtacaacactaaactctcgacacacgtacctcgaggcagcgtacacatacgaccacacgacacactcgacgacgcacgtacacagtacggactgacggacncaggatcncgtacgacgacgacgtcgtagtagtacgngtcgacggagtagagtacggtaattcgttcgactacggttacctgttagacgtcggtacggacgaccggtactcgtaccg

SEQ ID NO: 198013 - DNA, 699 bp, Homo sapiens
  misc_feature: GYAE6OF02JEJ6W.39.81.H04.1.454.CMB.1.raw
  modified_base (491)..(491): a, c, t, g, unknown or other
  misc_feature (491)..(491): n is a, c, g, or t
  modified_base (496)..(496): a, c, t, g, unknown or other
  misc_feature (496)..(496): n is a, c, g, or t
  modified_base (512)..(512): a, c, t, g, unknown or other
  misc_feature (512)..(512): n is a, c, g, or t
  modified_base (539)..(539): a, c, t, g, unknown or other
  misc_feature (539)..(539): n is a, c, g, or t
tcagtcgcactagtcacgaccggtgctcgatttagtagtgtagattcgcggggacccaaaaaccacacccctccttgggagaatcccctagatcacagctcctcaccatgggactggacctggagactattcctttttcgttaggtggcagcaacaaccaggtgcccactcccaggttcagctggtacagtctaggtagctagagtatgacgaacgccgtggggcctcgagtagacgtctccgtgaccgaaggtcttacgtcggttacccagttcccaaccttaccgtttgccttactcgaggtctggggtacaccggaccgaccgggtccctggaccggtaacgggtcgttaacggacggttggacggttccgggttaccctaccgtaaccgaaacctaaccgaaacctaggtcgaaccctagggtaacgtacccgagggtaccacgtatccgaaacctgacgacccagtacactaactgacccagaccngtacncgttacagtacgacgnacgtacaggtcctaggtactagtaacncggtaaccgacgcctagtagttcgtaccgtagtcgcgttacgttcccgtactaccgtaaccgtagtacgtaaccgtggttaaccgaaggttaacggtccgtaacggttccggacgtacccgacggttccgtaccgtacccgtacgttccgtcctacccgg

SEQ ID NO: 198014 - DNA, 682 bp, Homo sapiens
  misc_feature: GYAE6OF02GZK2L.39.81.H04.1.454.CMB.1.raw
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtctcctgcaaggcttctggttacacctttaccaacttatggtatcgtaggttgggtgcgacacggcccctggacgaggcttggagtggagtgggatggatcgagcgtcttacagtcggtacaacgaactaaactatcgacacgaacgaacccgtaccgagggtacaaggtacgtacaacctagtacgaacccacgaacgaaccacgacgtacccgaacggacgaccgtaaccggcctaacgacggttacggaacctgggaacggacgtccgtagacgtatccgtaggaccgaccgccggttacgtagttacgtcgtggtacgacggtaagtacggtacggttaaccgggtaatttaacggtttacggtaaccggttacccggtttaccccgtttagtttaaccggtaccgttaccggggtaccggggtaacccgtaccggggtacccgttacccggg

SEQ ID NO: 198015 - DNA, 733 bp, Homo sapiens
  misc_feature: GYAE6OF02G7343.39.81.H04.1.454.CMB.1.raw
  modified_base (158)..(158): a, c, t, g, unknown or other
  misc_feature (158)..(158): n is a, c, g, or t
  modified_base (200)..(200): a, c, t, g, unknown or other
  misc_feature (200)..(200): n is a, c, g, or t
  modified_base (429)..(429): a, c, t, g, unknown or other
  misc_feature (429)..(429): n is a, c, g, or t
  modified_base (607)..(607): a, c, t, g, unknown or other
  misc_feature (607)..(607): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaaacaacaggtnacccacctcccaggttcagctggtacagtctggagctgagangacgaagccgtgggcctcgagtggaaggtctaccgtgacgtaaggtcttcgttacggttacctaacccttttaaccaacgttagtacggttattcgtagggtttgggtcgtcgaaccgtaccggccccgtaagggaaccgtaagggtcgttacggaaggtgggacggttggggagtcggtactaccggaacgcgttacttaaacggtaagtcgtacaaccaactaaacntagactaacgaaactaccgtcggaaggaccgagtaccgtacgaccaactacggacaaccgataacctaacgaccaccgaacgaagaccccgacgtacctaacacggtaccggcctagggacggtacgacctagactacgtacgcgaaccgaccggtacgacgttagttacgttaacgnggtacggaacgtacgtaggtacggttaacggttaactttaggttaacgtaccggttcccttacggtttaccgttacgtaacccggttacgggaccgggtaacccggtaaccggttaccggtaccgg

SEQ ID NO: 198016 - DNA, 823 bp, Homo sapiens
  misc_feature: GYAE6OF02G5RFA.39.81.H04.1.454.CMB.1.raw
  modified_base (387)..(387): a, c, t, g, unknown or other
  misc_feature (387)..(387): n is a, c, g, or t
  modified_base (486)..(486): a, c, t, g, unknown or other
  misc_feature (486)..(486): n is a, c, g, or t
  modified_base (513)..(513): a, c, t, g, unknown or other
  misc_feature (513)..(513): n is a, c, g, or t
tcagtcgcactagtcacgaccggtgctcgatttagtagtgtagattcgcgggggacccaaaaaaccacacccctccttgggagaatcccctagatcacagctcctcaccatggactggacctggagcatcctttcttggtggcagcaacaacaggtgcccactccagttcagctggtacagtctggagctgagatgacggaacgtccgtggggcctgacggtaggaagggtcctcccgtggactaacgggtccttccgtgggtttaacctacccttttaacccgaaacttacgtagggttacttccggtaggtttgggttcgacgacgaccggtccccgtagggaaccgaagggtcgttggaggtgggacgttagggagttgggaancgtacggcgttacttaacgaattccggtaccgaactaaacaaccgttaatcaaccgacaccgtaacccgtcggaacgggactacgtacggtacaaccgngtacgaacccgagacgaacaacgtacnccggtaacgacggtaccgtacccggtacctaacggtaacacgggtaaccctgggaacgggtactacccggtaagacggttaccgtacgttaacggaacccgtaccggtaccgggtaccgttacgtttaaccttacggtcggttaacggacgttaacggtaccggttagggtaaaccggggttaactttttaacgggttaggtttaacccgtttccggggttaacccttttagggtttaaccgtaacccgggtttacgggtcccggggggtaaaccccggttaccgggggtaaccccgtttaacccggggg

SEQ ID NO: 198017 - DNA, 720 bp, Homo sapiens
  misc_feature: GYAE6OF02JCXIP.39.81.H04.1.454.CMB.1.raw
  modified_base (543)..(543): a, c, t, g, unknown or other
  misc_feature (543)..(543): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagctggtacagtctggagctgagatgacgaagccgtggggcctcgagtggagtctccgtgactaaggtcttcgtacggttacctacccgtttaaccaactagtcggtactcgtaggttgggtgtaccgacgtaccggcccgtaggacgtaagggtcttaggacgtaggtacgtgggtagtagggtactacggacgtacgtacttaacgaagttcggtactaacgtaaacccgtaaagtatacggacctaacgaaccgtaacctcggaacgggtcaagggtactaccgaaccagtaccgaacgtacgagaccacgtaactaccgacggacgacccgaacggtacctaacgacgtcgaacgtaggacggtacncgtacgagtacgtacgtacgaacggtaccgaccggtaccgtagtttacgtaacgttcgaacggtacgaggagttacggtaagggtttaaacttggttttaacggaccggtttacgttacccgttagtttacggtacgttacccgggtaggggaccccggtacggtacccgttaccgg

SEQ ID NO: 198018 - DNA, 744 bp, Homo sapiens
  misc_feature: GYAE6OF02HC020.39.81.H04.1.454.CMB.1.raw
tcagtcgcactagtcacgaccggtgctcgatttagtagtgtagattcgcgggggacccaaaaaacccacacccctccttgggagaatcccctagatcacagctcctcaccatggactggacctggagcatccttttcttggtcggcagcaaacaacaggtgcccactccaggttcagctggtacagtctggagctgagatgacgagcgtggggcctcgaggtgagtctcctgactacggtcttacgtcggttacctacctttaccaacttatggtatcgtaggttggtcgcgacgccggcccgtaggacgtaacggggtcgttacggaggtcggtacggtagggtaagtcggattacggacgtcgtacttaacgaaggttcggaacaacctaaacaacgtagtcgtaccaacgtaaccggtacccgtccggaacgggacgtaacggcgtaacccgtaccgaaacgtaccgacctaacgaaccgtaccataaccctaccggaaacggtccgaacccgaccggttctaaacgtaacggtaccgaccggttaggacgtaccggacgtacggacgtacgtacggtaacgaacccgtaacccggtcgggttaccttaagttacgtacgttggtacgaaccgttagggacgttaggaacggtttattaccggtttacgtacgttaccggttacctttagttaccgtaacgggttccggttaaccggggacggttaccgggacgttaccgg

SEQ ID NO: 198019 - DNA, 709 bp, Homo sapiens
  misc_feature: GYAE6OF02FY0KV.39.81.H04.1.454.CMB.1.raw
  modified_base (191)..(191): a, c, t, g, unknown or other
  misc_feature (191)..(191): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaacaacaggtgcccactcccaggttcagcctggtacagtctggtnctgagatgacgaacgccgtgggccctacaggtgaaggtcctccgtgcgaacggtcttcctggttacctaccttttacccaacctagttcggtatacaggttcgggtgccgaacgtcggtccccctgggaacgtaacgggcttggagtcgggaagtgggtatccgggatccgagccgtacttaacgaagttgggtaccaccgtaacctaaaactgtcacgaccgtacgaacccgtccgagggacacgtaggtacccaacacgtacgacccgtaacacgtaaccaacctacgacccctacggacgaccgacccgacccgtaacgacgtacggacgtcggaggaccgtcccagatacgttccacgtccgaccgacccggtccggtatttaacgttcccggtatcgggacctaaggacggtacggtaacggtaacggtttacgttcgaaccggttcggttaacccgttgttaccggtacgttaccggggaccgggcccggtaaaccggggtaccctaccggg

SEQ ID NO: 198020 - DNA, 666 bp, Homo sapiens
  misc_feature: GYAE6OF02GHL49.39.81.H04.1.454.CMB.1.raw
  modified_base (161)..(161): a, c, t, g, unknown or other
  misc_feature (161)..(161): n is a, c, g, or t
tcagtcgcactagtcacgaccggtgctcgatttagtagtgtagattcgcggggccccctagatcacagctcctcaccatggactggacctggagcatccttttcttggtggcagcaacaacaggtgccccactccccaggttcagctggtacagtctgganctgagatgacgaagccgtggggcctgagtgaaggtctcctgcaggcttctggttactacctttacaactatgtactctaggttgggtgcgacgccggcccctggacgaaggcttaggagtggagtgggagtggatcgagcgtacttaacgagtcggtaccaacaaccgtaaactatcgacaacacgaacctcgaggcagacgtacacatccgaacacacgacacgacctccggacgacgccgaaccggtacctacgacgtacggaccgtaggacgggacgccgtagaacgtacttcgtacggaccgacgaccggtacccgttggttaacttacgtcggttggaacggtaggtaacggtaggttaacggggttaaatttaaggttcgtaacgtttacggtacccgtttacgttacgttaccggttacggtccggggtaaccgtacccgggttaaccgtcggttacccgtaccgttacctaccgtccgtaccgtcccgtaaccccgg

SEQ ID NO: 198021 - DNA, 781 bp, Homo sapiens
  misc_feature: GYAE6OF02GBCUJ.39.81.H04.1.454.CMB.1.raw
  modified_base (190)..(190): a, c, t, g, unknown or other
  misc_feature (190)..(190): n is a, c, g, or t
tcagtcgcactagtcacgaccggtgctcgatttagtagtgtagattcgcgggggacccaaaaaccacacccctccttgggagaatcccctagatcacagctcctcaccatggactggacctggagcatccttttcttggtggcagcaacaacaggtgcccactcccaggttcagctggtacagtctgganctgagatgacgtaaggccgtggggcctcgagtgtaaggtcctccgttgacgtaagggtccttaccgttagggttaacctaacccttttaaccgtaacttagtacggttaacttacgtagggttttcgggagtacccgaacgtaccggccccgtaggaacgtagggcttggagtcgggtagtacggggtagtgggtaactgacggccgtactacgaaacggtcggacctacgaaactaacgtagtacggaccaaacgacgtaaccctcggaagggtaccaaggaccgtaccgaacccgtatacccgaaaccgacgtacgaaccgaactacgtaccgaacgacgaccgaccgaccttagacgtaccgacgagggtacgacgtacctagggacctaggtaccgtcgggaaaccgccggtaacgggttacccgttaagtttacctaacggttcggacgtaccggaagaacggttacggtaaccggggttaattttacggttaccggtaaccgtttaccgggttaccccgtttgtttaccggaaccggtttacccgggtacgggaccccgggttaaccgggtcccgtttaaccggg

SEQ ID NO: 198022 - DNA, 775 bp, Homo sapiens
  misc_feature: GYAE6OF02HSM77.39.81.H04.1.454.CMB.1.raw
  modified_base (305)..(305): a, c, t, g, unknown or other
  misc_feature (305)..(305): n is a, c, g, or t
tcagtcgcactagtcacgaccggtgctcgatttagtagtgtagattcgcggggacccaaaaaaccacaccccctccttgggagaatcccctagatcacagctcctcaccatggactggacctggagcatcctttttcttggtggcagcaacaacgaggtgcccactcccaggttcagctggtacagtctggagctgagatgacgaagccgtggggcctcgaggtggaacggtcctaccgtgacgaacggtcttcgttacggttaacctacctttaaccaacttagtaggtatcgtaggttgggcncggacgaccggcccgtaggacgtaggcttaggcggtaggaggtgggtagtggacgtacacggtcgtaccttaacgtaagtcggtaaccaaccaaaccgtaaactacgtaaccgtaccgtaaaccgaaccggtaacccgttaccggacgggtaaaccgacggtacggtaacccaaccgtaacgtaccgaacccgaaacgacgtaaccgacctaaacccgaccgaacgtaccggaccggaacccgtaccgtaaacgtacgtacggtaacgtacgggaacggaccgtccgggtaacgaagtaacgttccgaacgggtaccgacccgggtaccggttccgtaggttacgtaccgtggtacgacggaagtaggtacggttagggtaaacgttcggtttaccggacgttacccgttccttagttaccggtacggttcccgggtagggtaccccgtaccgggttacccgttaaccgg

SEQ ID NO: 198023 - DNA, 775 bp, Homo sapiens
  misc_feature: GYAE6OF02HY799.39.81.H04.1.454.CMB.1.raw
  modified_base (400)..(400): a, c, t, g, unknown or other
  misc_feature (400)..(400): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttctggtggcagcaacaacaggtgcccactccctaggttcagcgtggtacagtctggagcgtgagatgacgaagccgtgggcctcgaggtgaacggtctccgtgacgaacggtcttcgttacggttaacctacctttaaccaacttagtggtactcgtaggttcgggtacgaccgacgaccggtccccgtagggaccgtaagggtcttaggagtggagtggagtggatcgacgcgtacgttaacagttcggtacaactaactaacgtntacgacctaacgaacgtaacccgtagacgggactacggacgttaccaacgtagtaaccgaaccctacgaacgtaacctaaccgtaccgtacccgaaacggtacccggacccggtaacccggtacccttaacggtaaccgttaccgggaaccgtagggaaccgggtacgtaccgtacggtaaccgtacgtcccggttaaacgacccggtaacggtacccgggtaaccttaggttaaccgttcgtcgggtaacgacggtaaggtacggtacggttaacggggttaatttcggtttacgaccggtttaccgttacccgtttacggtttaggtaacccggttcggtaaccggggacccgttacgggtacccgttacggg

SEQ ID NO: 198024 - DNA, 715 bp, Homo sapiens
  misc_feature: GYAE6OF02I0FAT.39.81.H04.1.454.CMB.1.raw
  modified_base (191)..(191): a, c, t, g, unknown or other
  misc_feature (191)..(191): n is a, c, g, or t
tcagtcgcactagtcacgaccggtgctcgatttagtagtgtagattcgcgggacccaaaaaccacacccctccttgggagaatcccctagatcacagctcctcaccatggactggacctggagcatccttttcttggtaggctagcaacaacaggtcgcccactcccaggttcagctggtacagtctgganctgagtatgacgaacgccgtagggcctagagtgaacgtctccgtgacgtaggtcttcgtgttaacctaccttacgaactgtaggtactacgtaggtggtcgaccgtacgaccggtcccgtaggaacgtaagggtcgttaggacggtacggtaggtacggggtagtaggtacgtccgacggtaccggtacgttacgtaagtacggtacctaaccgaacgtaaacgtgtaccgacctaacgacgtaacccgacggtcggactaggtacaccgtacgactcgaaccgtaaccgaacgacaaccgaccgtaccacggacgacgaccggtacctagtaccgcgtacgtacgacgtacgccgtagtacgactcgacgtaccgacggtaccgtacgtgtacgttacgcgtacgagtacgtacgtacgggtacggttaacgttcgggttaactacccggttacgttacccgttgttaccgttaccggtaaccgggttcccgggtaacccggtacgggttacccggtacccgg

SEQ ID NO: 198025 - DNA, 733 bp, Homo sapiens
  misc_feature: GYAE6OF02G9YTZ.39.81.H04.1.454.CMB.1.raw
  modified_base (181)..(181): a, c, t, g, unknown or other
  misc_feature (181)..(181): n is a, c, g, or t
  modified_base (262)..(262): a, c, t, g, unknown or other
  misc_feature (262)..(262): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacngtctggagctgagatgacgaagcctggggcctcagtgaacggtctcctgcaaggcttcgtggttaccacctttaccaactntggtactctaggttgggtgccgacgcggcccctaggacgtaagggtcttggagtggagtggggatggatcgaggtcgtacttaacgaagtcggtacaaccgtaactaaacgtagtcgtacaaccgtaaccgtaacccaccggaacgggaccaacggtaccgtaccgaaccctggtaaccgaacccgaacgtaaccgaacccaaccgtacacccgaacggtacgaccggtacccggacctaacacggtaccggtaccgaggtacgggacctccgtagaactacgtcctacgggaaccggtacccgaaccggtccgggttattaaccgttaccgtaggttccgaagggtacgtaaaggtacgggttaacgggtaaagttttccgtttaacggacgtttaacccggtaccctttcgtttaaccggtaccgttaacgggtccggggaaccccgttaacgggttacccgttcccgg

SEQ ID NO: 198026 - DNA, 836 bp, Homo sapiens
  misc_feature: GYAE6OF02G7YYD.39.81.H04.1.454.CMB.1.raw
  modified_base (452)..(452): a, c, t, g, unknown or other
  misc_feature (452)..(452): n is a, c, g, or t
  modified_base (484)..(484): a, c, t, g, unknown or other
  misc_feature (484)..(484): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcacttccttttcgttggtggcagcaaacaacgaggtcgcccactcccgacggttcagtccgtaggtacagtcgtggagctggagagtcgacgaacgtccggtggggcctcgagtaggaacggtcctcgtgacgaggtcttcgtacggtaccttaccttaacctaacttacgtggtactaccgtaaggttgggtcgacgacgtaccggtcccccttagggaacgtaacgggtccgttagaggtacggtaggtagggtacttggactacgtcggaccgtacgtacgtaagtcggactaaccgaactaacgtagcacaccgaacgtacccncggtaggaccaggtactaccgaacgtaaccgnaacccgactaacggtacgtaacctacggtaacccaaccggacgtaccgaccgacctaacgtacggaccgttaccgtacggtaacggccgtaaccggtacggaacgttaccgtaacggccggtaaacccgtaaccgggtaccggttacccggttttaaggtaacccgttttttacggacgggttaaccggaccggtaacggttaacgggttacgggttaaccgggtttaacgttttaacggtttaccggtttaaccggttacccggttaccgttttacggtttaccggtacccggtttaaacgggtaccccggggttaacgggttaaccccgggtacccgggtttaacccggg

SEQ ID NO: 198027 - DNA, 641 bp, Homo sapiens
  misc_feature: GYAE6OF02FKV0V.39.81.H04.1.454.CMB.1.raw
  modified_base (308)..(308): a, c, t, g, unknown or other
  misc_feature (308)..(308): n is a, c, g, or t
  modified_base (442)..(442): a, c, t, g, unknown or other
  misc_feature (442)..(442): n is a, c, g, or t
  modified_base (449)..(449): a, c, t, g, unknown or other
  misc_feature (449)..(449): n is a, c, g, or t
  modified_base (452)..(452): a, c, t, g, unknown or other
  misc_feature (452)..(452): n is a, c, g, or t
  modified_base (512)..(512): a, c, t, g, unknown or other
  misc_feature (512)..(512): n is a, c, g, or t
  modified_base (532)..(532): a, c, t, g, unknown or other
  misc_feature (532)..(532): n is a, c, g, or t
tcagtcgcactagtcacgaccggtgctcgatttagtagtgtagattcgcggggacccaaaaaccacacccctccttgggagaatcccctagatcgacagctcctcaccatggactggacctggagcatccttttcttgggtggcagcaacaacaggtgcccacgtcccaggttcagctggtacagtctggagctgagatgacgaggtcctggggacctcgagtgaacggtcctctgacctaaggtcttcgtaggttacctaacccttttaaccaaccgttagtgggttacttcgtagggtttcggggngccgacgaccggcccccgttaggacgtaacggtcttaggaggtcgggtagtcggggtatgggatccgaggcgtactttagaacgttcgacaactaactaaactgagaccataccgaaccgcgaggctaacggcncaacgtnacncgacacgacacgactccgacgacgcgaccgttcagagttcggacctaggcgacgtctagntactgacgacgagacccgtnttacggtattcgtgcgcgttagacggtagttaacgggtaattttcgtacgttaccgttccggtacttcgtttacgcgtttacgaccggggcttaaccggcccgtttacg

SEQ ID NO: 198028 - DNA, 779 bp, Homo sapiens
  misc_feature: GYAE6OF02I6KSX.39.81.H04.1.454.CMB.1.raw
  modified_base (282)..(282): a, c, t, g, unknown or other
  misc_feature (282)..(282): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaaacaacaggtgcccactcccaggttcagctggtacagtctggagctgagatgacgaagccgtggggcctcgagtggaagtctcctgacaaggtcttcgtggttacctaccttaccaatagtgtatctaggttggngcgacgcggccctaggacgaagggtcttaggacggtggagtgggagtggatcgacggtcgtacgttaacaagtcggtacaacgaactaaacgtatcgaccaacaacgaaaccctcggaagggcaacggtacgtaccaacgtacgtaaccgaacccgtaacgaacgaaccgaacctaaccgtaccccgaaacgaaccgggtacccgaacccgggtaacccttaaaccggtaacggtaacccgggtacccgtaagggtaaaccggacggtacccgtagggaacgttacgtaccgtacggaacccggaacggacccgggttaccgttagttaaccgtttcgttacggtacggaacggtagtaacgggtacggttaacggggttaaacgttttacggttttaaccggttaccgtttacccggttacctttaccgggtttacgtaaccgggtttaacgggttacccggggacccggttaaccggggttacccgttacccggg

SEQ ID NO: 198029 - DNA, 714 bp, Homo sapiens
  misc_feature: GYAE6OF02ILEF5.39.81.H04.1.454.CMB.1.raw
  modified_base (312)..(312): a, c, t, g, unknown or other
  misc_feature (312)..(312): n is a, c, g, or t
tcagtcgcactagtcacgaccggtgctcgatttagtagtgtagattcgcggggacccaaaaaccacacccctccttgggagaatcccctagatcacagctcctcaccagtggactggacctggagcacttcctttttcgttggtggcagcaaacaacgaggtcgcccacgtccaggttcagctggtacagtcgtggagctgagactgaacgacgtccgtcggggtcctacgtagtaggtacggtcctcgtgaccgtacgttccgttcgttacgtaccttaccttaacacgtagtcgtagtcgtggttacggngacgacgaccggtcgtaggaagtacggtagtggaggtagtcggtggagtacgtcgtacgcgtaccggttataacggtacttcggtaaccaacgtaacgtaagcgacgacctaaaccgtaccgttaccgacggaacgtacgtaaacggtacttaccgaacgtaacgaacccggaactaccggaactaaccggaactacgaccgaacggaaccgaccgaacgtacgtaccgtaggtacgtaaccgtggaaccggtacgtaaccgagacgtacgtccggtaagacccgtacggtccgagttacgtactgtacgacggactaagtacgtaggttaagttacggttaagtccgtacgtacgttcgttagccggttacggaccggtacggtaccgtacgttactacgg

SEQ ID NO: 198030 - DNA, 694 bp, Homo sapiens
  misc_feature: GYAE6OF02FKOFE.39.81.H04.1.454.CMB.1.raw
  modified_base (240)..(240): a, c, t, g, unknown or other
  misc_feature (240)..(240): n is a, c, g, or t
  modified_base (277)..(277): a, c, t, g, unknown or other
  misc_feature (277)..(277): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcaggcaacaacaggtgccactcccaggttcagctggtacagtctggagctgagatgacgaagccgtggggcctcagtgaaggtctcctgcaaggcttcnggttacacctttaaccaactatggtatcagttagggngcacgaggcccctggacagggcttgagtggatgggatggatcgagcgacttacaatcggtactaaccaacgtaaaactattcggacaacacgaaacctccgaacggggtacaacggtaacgtacctaaaccgtaactacggaacccaacgaacgaccgtaacaaacgttacccaaacgggtaacgaccggaaccgggacccttaacgaaaccggttcgggaacccttagggaacggtaacgacccgttaacggaaggtacctcggttaacgaaccggtaacgacccgggttacggtacttaagttaccgtaggtacggacgtaggtaacgaggtaacggggtaattgtttcggaacgttcggtttaccctagtttacgtaccggttaacggttcggggactaccggggaccttcggg

SEQ ID NO: 198031 - DNA, 695 bp, Homo sapiens
  misc_feature: GYAE6OF02G9Z9X.39.81.H04.1.454.CMB.1.raw
  modified_base (188)..(188): a, c, t, g, unknown or other
  misc_feature (188)..(188): n is a, c, g, or t
  modified_base (235)..(235): a, c, t, g, unknown or other
  misc_feature (235)..(235): n is a, c, g, or t
  modified_base (275)..(275): a, c, t, g, unknown or other
  misc_feature (275)..(275): n is a, c, g, or t
  modified_base (363)..(363): a, c, t, g, unknown or other
  misc_feature (363)..(363): n is a, c, g, or t
  modified_base (381)..(381): a, c, t, g, unknown or other
  misc_feature (381)..(381): n is a, c, g, or t
  modified_base (420)..(420): a, c, t, g, unknown or other
  misc_feature (420)..(420): n is a, c, g, or t
  modified_base (436)..(436): a, c, t, g, unknown or other
  misc_feature (436)..(436): n is a, c, g, or t
  modified_base (449)..(449): a, c, t, g, unknown or other
  misc_feature (449)..(449): n is a, c, g, or t
  modified_base (462)..(462): a, c, t, g, unknown or other
  misc_feature (462)..(462): n is a, c, g, or t
  modified_base (541)..(541): a, c, t, g, unknown or other
  misc_feature (541)..(541): n is a, c, g, or t
tcagtcgcactagtcacgaccggtgctcgatttagtagtgtagattcgcgggggacccaaaaaccacacccctccttgggagaatcccctagatcacagctcctcaccatggactggacctggagcatcctttcttggtggcagcaacacaggtgcccactccaggttcagctaggtacagtctgganctgagatgacgaagcctggggcctcagtgaggtctcctgcaagcttntaggttacacctttaccaatatggtatacgtaggttggtnacgacgacggcccctaggacgaaggtcttggacgttggatgggtagtcggagtccggcgtacttacgagtcgtccaagaccaaaagtntacgacaacgagtacccncgtaacggacaggacgtacacctatacgaccacacgacncaactacccaggaacncgtacccgactanactcggtaaccgngaacgggctaccgaggacgtacgtactacggtaacccgacgtaccgggtcgttaacgtttacgttacgttccggggtanaccggaacggtaacgtaaccgggtaagggtttaacgttaacggttttaacgtacccgggtttaggtaaccccccgttttaggttttaacccgaaaccggttcccgggtagggaacccccggttacgggggtacccccgttagggtaacccccgg

SEQ ID NO: 198032 - DNA, 710 bp, Homo sapiens
  misc_feature: GYAE6OF02HDO7X.39.81.H04.1.454.CMB.1.raw
  modified_base (274)..(274): a, c, t, g, unknown or other
  misc_feature (274)..(274): n is a, c, g, or t
  modified_base (353)..(353): a, c, t, g, unknown or other
  misc_feature (353)..(353): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctctgcaagcttcgtgttaccacctttacaactatggtatcgagttggtncgacacggcccctggacgaaggtcttagaggtggagtgggatggatcgagcgtacttacagtggtacacaataacgtancgacacaacgaacctcgaaggtacagtacgtaccaccacgtacgaaccacgaacgaacctacgtactaccgaacgtacgacccgaaccggtacctaacgtacgtaccggaaccgttagggaacggtaaccgtaccgtaggtaccgtacgttaccgaacggtaacccggtacggtaaccgggtcttaaaccggttaagtttacccggtgtaaccggtaccggaagttaacggttacgggtaacgggttaaacgttttcggtttaaccggtaaccgtttaccggttaccccgtttaggttaccgttaacccgggttacggtaccccgggggtaaccgtaccggtaccccggttaccggg

SEQ ID NO: 198033 - DNA, 641 bp, Homo sapiens
  misc_feature: GYAE6OF02F2U3X.39.81.H04.1.454.CMB.1.raw
  modified_base (366)..(366): a, c, t, g, unknown or other
  misc_feature (366)..(366): n is a, c, g, or t
  modified_base (372)..(372): a, c, t, g, unknown or other
  misc_feature (372)..(372): n is a, c, g, or t
  modified_base (398)..(398): a, c, t, g, unknown or other
  misc_feature (398)..(398): n is a, c, g, or t
  modified_base (411)..(411): a, c, t, g, unknown or other
  misc_feature (411)..(411): n is a, c, g, or t
  modified_base (424)..(424): a, c, t, g, unknown or other
  misc_feature (424)..(424): n is a, c, g, or t
tcagtcgcactagtcacgaccggtgctcgatttagtagtgtagattcgcgggggacccaaaaaaccacacccctcccttgggagaatccccctagatcacagctcctcaccatggactggacctggagcatccttttctggtggcagcaacaacaggtgcccactcccaggttcagctggtacagtctggagctgagatgacgaagcctggggcctcagtgaaggtctcctgcaaggcttctggttactacctttacaacctatggtatcgtaggttgggtgcgacgaccggtccccgtggacgtaagggcttacggagtggagtgggtatggatcgagcgtactacgacgtgtacacaacaactntcgcanaccgtaacctcgaggcacgagccacnacgaccacagacnctacacacggacncaccggtccactaggtaccggaccgtaggaacggccgtaccgtaggaactcgtacccgtaggaacccgtaccggaccggttaccgtcgttaagttgttcgacgaccgagtacggtacggttaacgggtaattttgttaaccggtacttacccggttacccttcggttaccgtaggttccccgggttacggggacctaacccggggttcctacccggg

SEQ ID NO: 198034 - DNA, 737 bp, Homo sapiens
  misc_feature: GYAE6OF02HBIYA.39.81.H04.1.454.CMB.1.raw
  modified_base (198)..(198): a, c, t, g, unknown or other
  misc_feature (198)..(198): n is a, c, g, or t
  modified_base (238)..(238): a, c, t, g, unknown or other
  misc_feature (238)..(238): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcattccttttcttgggtggcagcaacaacaggtgcccactcccaggttcagctggtacagtctggagctgagngtgacggagccgtggggcctcgaggtgaagggttctaccngtacgaaggtcttcgttcggttaacctacctttaaccaactagttcggtaactccgtaggttcggtcgcgacgccggcccgtaggacgagggtcttggaggtcgggagtgggtagtcggacgtacggacgtaccgtaccgttaacgtaacgttcgggtaacctaacgaacctaaagtacgtaccgaaccgtacgtaaccgaaccgtacggacggtacgaacgtacgtaaccaccgtagtaccgacctaacggaacacaccgtacctacgaacggaccgacgtacccggtactaacggaacggtcgaccgggtaggaaccggtccgacgtacggacgttacgacgtaacgaaccgtaccggtacgtacgttagttacgttcggtgaacggtaccgagggtacgtacggtaacggttaactttcgggttagtacccggtttagttcccgttaagttcggaacgggtttcccgacggggtacccgtaccggtcgttacccgg

SEQ ID NO: 198035 - DNA, 708 bp, Homo sapiens
  misc_feature: GYAE6OF02GPW2C.39.81.H04.1.454.CMB.1.raw
  modified_base (266)..(266): a, c, t, g, unknown or other
  misc_feature (266)..(266): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttctggtggcagcaacaacaggtgcccactcccaggttcagctggtacagtctggagctgagatgacgaagcctggggcctcagtgaaggtctctgcaaggcttctgtacaccttaccatgtgtatcgagttggncgacgacggccctggacgaggtctgcgtggagtggtatggactcgaggccgtacttaagaagtcggtacaactaacgtaaactgtcgacaacgacgaacctccggaagggcgaagactaccgaacgtctacgaccacgagacacgacgtaccgacggacgccgtaacggcctacgtacgtacggtacccggtggtaaacgggcccgtacgttaggaacgtccgttaacggacgggaacccgtaacggacccgggttacgttacggtttaactttacccggtggtaacggtacgggtaacgaacgttaacggggtaaccgggttaagttttacggtttacccgttacgggtttaacccggtttaacctttccggttttacgtaaccgggttacccgggttaccgggaaccccgggttaaccgggttacccccgttacccgggg

SEQ ID NO: 198036 - DNA, 812 bp, Homo sapiens
  misc_feature: GYAE6OF02F75JW.39.81.H04.1.454.CMB.1.raw
  modified_base (151)..(151): a, c, t, g, unknown or other
  misc_feature (151)..(151): n is a, c, g, or t
  modified_base (469)..(469): a, c, t, g, unknown or other
  misc_feature (469)..(469): n is a, c, g, or t
  modified_base (577)..(577): a, c, t, g, unknown or other
  misc_feature (577)..(577): n is a, c, g, or t
  modified_base (596)..(596): a, c, t, g, unknown or other
  misc_feature (596)..(596): n is a, c, g, or t
  modified_base (602)..(602): a, c, t, g, unknown or other
  misc_feature (602)..(602): n is a, c, g, or t
  modified_base (608)..(608): a, c, t, g, unknown or other
  misc_feature (608)..(608): n is a, c, g, or t
tcagtcgcactagtcacgaccggtgctcgatttagtagtgtagattcgcggggacccaaaaaccacacccctccttgggagaatcccctagactcacagctcctcacctagtggactggacctggagcatccttttctggtcgacagcaanaacaggtgacccactcccgtagttcagtctaggttacagtcgtgacgctgtagacgtgaccgaagtccggtacgggtcctacgagtacggtaacgttccgtacccgttacggaccgtaacgtccgtttaccgttaccgggtttaacccttaaccctttaaccggtaaaccttacggttacggttaacggtccttaacggggtttacgggtacgccggttaaccgtccggtaacccccggttaggaaaccggttaacggggttaccgttaggaccgggtaggtaacggtagggggttagacggttaacacggtaccggngttaaccgttagaaacggttcttaaccaccgaaacgtaacttcgaacctacgaacgtaccgaacgtacgaggtaccaggtacgtccaacgctaacggcgacagctacnctacgcacgtacacgtacncgtaanccgganacgtagctagtcacgtactacgacgggtaaccacggttcgaaccgttgttaaccgttaggcccgtaaagcgttaacgggaccgtttaagggtaacgtttaaaccggtttaggttccggtaaaccttaccccgggtttattaccgttacgggttaactttaccggggacccggtttaaccggtacgggtaacccgttaacccggg

SEQ ID NO: 198037 - DNA, 790 bp, Homo sapiens
  misc_feature: GYAE6OF02IMUFR.39.81.H04.1.454.CMB.1.raw
  modified_base (134)..(134): a, c, t, g, unknown or other
  misc_feature (134)..(134): n is a, c, g, or t
  modified_base (236)..(236): a, c, t, g, unknown or other
  misc_feature (236)..(236): n is a, c, g, or t
  modified_base (352)..(352): a, c, t, g, unknown or other
  misc_feature (352)..(352): n is a, c, g, or t
tcagtcgcactagtcacgaccggtgctcgatttagtagtgtagattcgcgggacccaaaaaaccacacccctccttgggagaatcccctagatcacagctcctcaccatggactggacctggagcatccttttnttggtggcagcaacaacaggtgcccactcccaggttcagctggtacagtctggagctgagatgaacgaagtccgtcggggcctcgaggtcgaaggtctccgngacgaacggtcttcgttacggttaccttaccgttacctaacttacgtcggtactcgtagggttgggtcgcgtacgacggtaccccgtggacgaggtcgttgaggtcgaggtggggngtacggtagtcgacgtcggtactaacgtagtcgtacgaaccaactaacgttacgtacgacctaaacgaccgttaaacccgcggtaacgggggacctaacggtacgtacccgaacgtacgttaaccgacccgaacggtaacaaccggtaacctaaccgaaccgaaccgggacgaccccgtaaccggtacctaaaccgacgtaccgggtaccggtagggtaacggtaccggtaccgtacgtaacgttacgttacggttaccgaaccgggtaaccgtaccgggtttacgtaccgtttaagtcgttaacgggacgtacggtacgaaggttaccgggtaacgggttaaacgttttcgtttacggaccgttttccggttaacctttaccgtttagggcccgttaacggggtcgggaaccggttaccgggtaccccgttaccggg

SEQ ID NO: 198038 - DNA, 747 bp, Homo sapiens
  misc_feature: GYAE6OF02F53E5.39.81.H04.1.454.CMB.1.raw
  modified_base (156)..(156): a, c, t, g, unknown or other
  misc_feature (156)..(156): n is a, c, g, or t
  modified_base (399)..(399): a, c, t, g, unknown or other
  misc_feature (399)..(399): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtncccactcccaggttcagctggacagtctggagctggagatagacgaagccgtgggcctcgagtcgaaggtctccgtgacgaggtcttacgtggttaacctacctttaccaacttagtggtatcgaggttggtgacgtacgaccggtccccgtaggaacgagggtccttaaggaggtacggtagtagggacgtaggtactacgacgtccgtacgttaacaagttcggtacacgaaactaaactnacggactaaccgacgttaaccaccggaaggtaccgataccgccaacgacgtaccgaaaccaacgtaacgaaccaccgtacgtacccgaaccgacgaccggtaacccgtaccgtaataccggtacgtaccgtacggacggacgttaccgagtacgacgttccgtcggaaaccgtacggtacccgggtcgtttaacggtccttaacgtacgggtcgtaaaccggaggttaaccggagggttacgggtaaacttttcggtttaacgtaccggttaaccgttacccgttttaggttacccgttacggttaaacccgggtgggaccccgttaaccgggtaccccgtttacggg

SEQ ID NO: 198039 - DNA, 943 bp, Homo sapiens
  misc_feature: GYAE6OF02GL3X1.39.81.H04.1.454.CMB.1.raw
tcagtcgcactagtcacgaccggtgctcgatttagtagtgtagattcgcggggacccaaaaaccacaccctccttgggagaatcccctagatcacagctcctcaccatggactggacctggagcattccttttcttggtggcagcaacacaggtgcccactcccaggttcagcgtggtacagtctggagctgagatgacgaagccgtcgggcctcgaggtagaacggtcctcgtgacgtaaggtcttcgttcggttaacctaccttttaaccgaacttagtggtactacgtaggttgggtcgcgacgtaccggtccccgtaggacgtaacgggcgttaggcggtaggtaggtgggtacgtcgggtacgtacgaggtcgttacgttaaccgaagttcggtacgaaccgtaaacgtaaacgttacgtacgaccgaacgttaaaccggaaccgtaccgggtaacggggacgtaacggtacggtaacctaaccgtacgtaacccggaacgaaccgtaacgaaccggtaaccctaaccgtacccggtaaaccggacgggtaaccccggtaaccggtaccccgttaaacggtaaccggttaacccgggtaacggttaaccgggacggggttaacccggacccggttaaggaaccgggttaacttacccgggtaacggttaacccggtaaaccggggtacccgggtttaccggttaaacggttttaccgtttacggggttaacggccgggttaaacgggtaaccgggtaaccggttaacgggtttaaccgggggtttaaacggtttttaacgggttttacccggtaaggggtttttaaaccccgggttttaaccccggttttgtttaacccggggtttaaaccggttacccgggggtttaaccggggggttaccccggttaacggggtttaaccccccggtttaccgggg

SEQ ID NO: 198040 - DNA, 812 bp, Homo sapiens
  misc_feature: GYAE6OF02HMCEY.39.81.H04.1.454.CMB.1.raw
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcagtgaggtctccgtgcaggcttgtgtactacctttaccaactagtggtatcgtaggttgggtcgacgtacgacggtccccgtggaaccgaagggtccttaggacggtaggaggtacgggtagtacgggatcgagccgtacgttaactaacgtcggtacaacgaacgttaaacctagtcgaccaacgaaacgaaccctcggaaccgggtcaaggtaacgtaccctaacgtacgtaccggaaacccaacgtaaccggaacctaaccgtaaccgtaacccggtaaccggtaaccgacccggaaccggtaaacccgtaaccggtacggtacccggggtaacccgtagggtaaccgggtaaccgtacccggtagggaacgtacgtccggttaacggaacccggtaccgtaccgggtccggttaagttaaccgtttccgggtaacggttcggaacgttaacgggaacggtaccgggttaaacgggttaaggttttaaccggtttaccggtaccgttaacccggttttcccgttacgttttaaccgggtaaccgttaccgggttaacccggggtaccggtacccggggtaccccgtttaccggg

SEQ ID NO: 198041 - DNA, 648 bp, Homo sapiens
  misc_feature: GYAE6OF02FXE9Q.39.81.H04.1.454.CMB.1.raw
  modified_base (237)..(237): a, c, t, g, unknown or other
  misc_feature (237)..(237): n is a, c, g, or t
  modified_base (351)..(351): a, c, t, g, unknown or other
  misc_feature (351)..(351): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaggcttntggttacacctttaccaactatggtatcagttggtgcgacagcccctggacaagggcttggagtggagtgggatggatcaggccgtacttacgaattggtacacaactaaactntacgcacgagaacctccgaggtcagacgtcacgatcgaccacgacgacacacgtaccaacggtcgacgaccgcctaacgtagtacggaccgtggaacgggtacgaccgtagacgtactcgtacgacgaccgtacggccgttcgtaacgtttacgtcggtacggcggtaaggtacggtaggttaaccggggtaaagttttaaccggttttacggaaccgtttaccgggttaacccttttggttttaccgaccggtttaaccgggtcgggggttaccctacgggggtaccccttacggg

SEQ ID NO: 198042 - DNA, 738 bp, Homo sapiens
  misc_feature: GYAE6OF02FUL63.39.81.H04.1.454.CMB.1.raw
tcagtcgcactagtcacgaccggtgctcgatttagtagtgtagattcgcggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgagcctgggcctcagtgaggtctccgtgcagtcttctgttacctaccttaccaatatggtatcgaggttggcgcgacgcggcccctggaccagggtcttgagtcggagtcgggatggatcgagccgtacttacgagttcggacctaaccaacctaaacgtagtacgtacaaaccgtaccgtaacccgttacccggaagggtacgaaggtaaccgttaccgaacccgtacgtacggaacccaacacgacctaaccgacctaccgaacgacgtacccgacggtaccctaacgacgtaccggaccgtaggaacggacgtccgagacgtacgtcgtacggacgacgtaccgggtccgttagttaccgttacggtacgtcggaaccgggtagaacgggttacggtaacgggttaacgttttaggtttaaccggtaacccgggtttaccggtttaaccccgtttacgttttaaccggtaacccggtttaaccggggtcccgggggtaaacccgttaaccggggggtaaccccccctttacgggg

SEQ ID NO: 198043 - DNA, 742 bp, Homo sapiens
  misc_feature: GYAE6OF02G44UR.39.81.H04.1.454.CMB.1.raw
  modified_base (155)..(155): a, c, t, g, unknown or other
  misc_feature (155)..(155): n is a, c, g, or t
  modified_base (567)..(567): a, c, t, g, unknown or other
  misc_feature (567)..(567): n is a, c, g, or t
tcagtcgcactagtcacgaccggtgctcgatttagtagtgtagattcgcggggcacccaaaaaccacacccctccttgggagaatcccctagatcacagctcctcaccatggactggacctggagcatcctttctggtggcagcaacaacaggtncccactcccaggttcagctggtacagtctggagctgagactgaacgaacgccgtggggcctcgaggtcgaacggtcctccgtgacgaaggtcttcgtaggttacctaccgttttaaccaacgtacgtaggtactccgttaggttgggtacgtacgaacccgacggtacccccgtaggaaccgtaaggggtccttaggtaacgggttggggggtagggtacgggtaactcgtacttaccgttaccttaggttacggtttacggaaaccctaaccgtagtttcggtttaccggtaacctaacccgttaagttaccgccgaacgtaacgtaacggttacccgaggtacgaagtacggtacaacggtaaccgttaccggacgtaacgtactacgtacggataccacgactcctaanccgtaggcctacgacgacgtacgtcgagtacgtactagtacggtaacgaccgacggtacgttcgttaacttcggtagtcgacgtagggtacggtacggtacgggtactaacggtagttaacggacggtcgggacggtacgtacgttaccggaccgggtacgtacccggtacccgg

SEQ ID NO: 198044 - DNA, 868 bp, Homo sapiens
  misc_feature: GYAE6OF02H6U85.39.81.H04.1.454.CMB.1.raw
  modified_base (173)..(173): a, c, t, g, unknown or other
  misc_feature (173)..(173): n is a, c, g, or t
tcagtcgcactagtcacgaccggtgctcgatttagtagtgtagattcgcggggacccaaaaaaccacacccctccttgggagaatcccctagatcacagctcctcaccatggactggacctggagcatcctttttcttggtggcagcaacaacaggtgcccactcccaggttnagctggtacagtctggagctgagatgacgaagccgtggggcctcaggtggaacggttcctccgtgacaggtcttctggttacctaccttacaactagtggtatcgtaggttcgggtgacgtaccgtaccggcccccgttaggaaccgtaaggggtctttacgggaagttgggaacggtcgggtagttgggtactcgacggtccgtaccgtaacgtaagttacggtacctaaccgtaaactaaaacgttacgtacgacccgtaaacgaaccggtaacccgtacggaacgggacgaaggtaacgttaccaacgtaactaccgaacccacgaacgtaacgtaactaaccgtacccgaaacggtaccgaaccggtaacccgtaccgtaaccgaggtaccggtaacccgtagggaccggtaaccgtccgtaaggtaccgtacgtcgtaaccgggaccgtaacccgggaccgggttacccgtttaacggttaaccgtttaccggttagggtaccggtaaccggtaagggtaaccggttaacggggttaacccggggtttaaaaagttttcgggttttaacccggtaaccggtttaacccgggttttacccccgtttacgggtttaaccggttaccccggttaaccgggggttacccgggggttaacccggtaaccccgggggttaacccggtttcccgggg

SEQ ID NO: 198045 - DNA, 911 bp, Homo sapiens
  misc_feature: GYAE6OF02G9A76.39.81.H04.1.454.CMB.1.raw
  modified_base (568)..(568): a, c, t, g, unknown or other
  misc_feature (568)..(568): n is a, c, g, or t
tcagtcgcactagtcacgaccggtgctcgatttagtagtgtagattcgcggggacccaaaaaaccacacccctccttgggagaatcccctagatcacagctcctcaccagtcggactggacctggagcattcctttttcgttgggtggccagcaaacaaccaggtcgcccaactcccgaggtttaccagtcgtcggtaactgttccgttgggacgcgttacgagattaggacgaacgtccgtacgggggccttcgaacggttggaaacggttcgttaccgtgaccgtaacggtccgtttaagttccgggttaccttaacccgttttaacccaaacgttaacgttgggttaacttaccggttaggttagggttacggtaccggaaccgaccggtaccccgttaggaacggtaacgggttcgttaggaggttcggaacggtgggacgttaggatcggacgtacgtacgttaacgaacgttacgggacctaacgaaaccgaaacgttactaggaacccaacgaaaccgaacccgtcgggaaaggccgtaagtaccgttacccacgtaaacnccgggtaaccaaccggataacccactacccgtaacccgtaaccggacggtacccgaccggacccgttaacgacgtaccgggtaaaccgtcggaaacgggtcccgtaacggtacggtaaacgtcgttacggaaccggttaccgaaacccggtttaccggtacggtttaacggttaactttaccgggtagggtttacgaaccgggtaaggtaacggttacgggggtaagttaaacggtttaaccgttttcgggtaaaccggttcccggtttacggtttaacgttccggttaaaccgggttagggttacccggtaacccggggttaccggtaccggttaacccggg

SEQ ID NO: 198046 - DNA, 725 bp, Homo sapiens
  misc_feature: GYAE6OF02HBBVS.39.81.H04.1.454.CMB.1.raw
  modified_base (285)..(285): a, c, t, g, unknown or other
  misc_feature (285)..(285): n is a, c, g, or t
  modified_base (349)..(349): a, c, t, g, unknown or other
  misc_feature (349)..(349): n is a, c, g, or t
tcagtcgcactagtcacgaccggtgctcgatttagtagtgtagattcgcgggggacccaaaaaaccacacccctccttgggagaatcccctagatcacagctcctcaccatggactggacctggagcatccttttcttggtggcagcaacaacaggtgcccactcccaggttcagctggtacagtctggagctgagatgacgaagccgtggggcctcgagtgaaggtctcctgcaaggcttcgtggttacctaccttttaccaactatggtatctaggttgggtnacgacacggccctggacgaggtcttgaggtggagtggggattgggatcgaggtcgtaccttaanagtcggtacaactaactaaactatcgactaacaacggaaccctccggaagggtcaaggtacgtaccaaccgacgtacgaacccaacgtacgaaccacctacgtaccccgaaacggacgtaccgtaacccggcctaacgacggtaccgggacccgttagggaacggtacgtccgttagggaactcgtacggacggaacccgtacggtaccgggtaccgtttgttaaccgttcgtacggtacggtacgggaaccgtaaggaccggggtttaacgggtaaacttttggtttaaccggaaccgtttccgggtttaccctttagttaaccggtaccggttaccgggtacggggaacccggtaccgggtaccccttacgggg

SEQ ID NO: 198047 - DNA, 614 bp, Homo sapiens
  misc_feature: GYAE6OF02GCA1J.39.81.H04.1.454.CMB.1.raw
  modified_base (215)..(215): a, c, t, g, unknown or other
  misc_feature (215)..(215): n is a, c, g, or t
  modified_base (398)..(398): a, c, t, g, unknown or other
  misc_feature (398)..(398): n is a, c, g, or t
  modified_base (458)..(458): a, c, t, g, unknown or other
  misc_feature (458)..(458): n is a, c, g, or t
tcagtcgcactagtcacgaccggtgctcgatttagtagtgtagattcgcgggggacccaaaaaaccacacccctccttgggagaatcccctagatcacagctcctcaccatggactggacctggagcatccttttctggtggcagcaacaacaggtgcccactcccaggttcagctggtacagtctggagctgagatgacgaagcctggggcctnagtgaaggtctccgtgcaaggtcttcgtggttacacctttaccaacttatggtatcgagttgggtgcgacacggcccctggacagggcttgagtggagtgggagtcggtatcaggcgtacttacaagttggtacacgaactaactatgacacacgtaaccctcgagggacagacgtacactanacgaccacacgacacactaccagacgacgacggccactacgtcggaccgtaggacggacnccgagacgtactgacggaccgacggaccggacgttagttacgttcgtgtacggacgaggagtacggtacggtaaagtttcgttaacgtacggttacggttacccttcggtttacgttaccggtacggtaccgggaccggtaccggtaccggtccgg

SEQ ID NO: 198048 - DNA, 717 bp, Homo sapiens
  misc_feature: GYAE6OF02FVMQN.39.81.H04.1.454.CMB.1.raw
  modified_base (571)..(571): a, c, t, g, unknown or other
  misc_feature (571)..(571): n is a, c, g, or t
tcagtcgcactagtcacgaccggtgctcgatttagtagtgtagattcgcgggggacccaaaaaaccacacccctccttgggagaatcccctagatcacagctcctcaccatggactggacctggagcatcctttcttggtggcagcaacaacaggtgcccactcccaggttcagctggtacagtctggagctgagatggacgaagccgtgggcctcagtgaaggtcctcgtgcaaggtcttctggttaccacctttaccactatggtatgtaggttggtgacgacgacgccctaggacgaaggtcgttggaggtgggtaacgtgggtacgtggtacgtcggacggccgtacgtttaacgaaacgttcgggaacctacggaaactaaacgtacgtacgtacgtaaccgaactaaaccccgttacccggaacgggggacctaacgggtaaccgtaaccgaacccgtacgtaccggaacccaaaccgtacgaccgtaacacgtacccgaacgaacggcgtaacccgaccttaacgccgtaccggtaaccgttgggaacggtaccgccgtaaggngtaccgttcgacggaccgaaccggtcggtacccgtaggttactacggttgacggtacgagtaggacgttacgggtaatttcggttagtacgttaccgttaccgtgtttacacggttaacggccgggtaccggacggttaccgtccg

SEQ ID NO: 198049 - DNA, 872 bp, Homo sapiens
  misc_feature: GYAE6OF02GWF9K.39.81.H04.1.454.CMB.1.raw
  modified_base (274)..(274): a, c, t, g, unknown or other
  misc_feature (274)..(274): n is a, c, g, or t
tcagtcgcactagtcacgaccggtgctcgatttagtagtgtagattcgcgggggacccaaaaaaccacacccctccttgggagaatcccctagatcacagctcctcaccatggactggacctggagcatccttttcttggtggcagcaacaacaggtgcccactcccgaggttcagctggtacagtctggagctgagatcgacgagtccgtgggcctcaggtgaacggtcctccgtgcaaggtcttcgtacggttacctacctttaaccaactntaggttatcgtaggttagggtcgaccggaacgccggtaccccgtagggaacccgtaagggtcgttaggaacggtgggtaaggttacggggacgttagggtaccgtaccgtacggtaccgtacgtttaacgtaacggtcggtaaccgtaaaccgtaacgtaaaaccgttagtccgaacccgtaaaccgaaaccggtaaccccgtaccggaagggtaacccgtaaggtaacccgtacccgaaacccgtaggtaaccccggaaacccgaacgaacccggtaaccctaactaaccccgacccggtaaaaccggaccgtaacccgggaaccccgtaccgtaaaccgtacggttaccggaaccggtacgggaacggttacccgaccggtaacggaaccgtttaagtacccgaaccggggtaccaccgggtaacccgggtccttaaggttaaccgttaacggtcgtaacggtacgggacgtaaggtacgggttaacgggttaagttttaccgtttacggaccggttttaccgttacccttagggtttaacctacgggttaccgggtaacccgggtaacggtacccgggttacccgttaacccggg

SEQ ID NO: 198050 - DNA, 902 bp, Homo sapiens
  misc_feature: GYAE6OF02GSYJ4.39.81.H04.1.454.CMB.1.raw
  modified_base (393)..(393): a, c, t, g, unknown or other
  misc_feature (393)..(393): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcgtggtggcagacaacaacaggtcgcccacctccgtaggttcagtctggtacagtcgtgggactcgtgacgatggaacgagtccggtggggccctagaggtacgaacggttcctcgtcgacgtaacggtccttacgtcggttaccttaacccgttaacgaagttacgtagggtacttacggtacggttgggtcggcgtaaaccgggtccggtaccccgtagggtaaccggtaacgggttccgtaggtacgggttagggnggtacggggtagtacggtacgtacggtaccgtacgttacgttaaacggtaagttccggtaactaaaccgtaaacctaagttacgacgaaccgaaccgttaaccggaaccccgtacggggacggaccgtaacggtaaccgtaaccgtaaccgtaacggtaaccggaacctaacggaaccgtacctaaccggtacctaaccggaaacgaccggtaccggtaaacccggccgtaaaccggtacgttaaccgggacctaggggtaaaccgaccggtaaccggtaggaacgttacctaccgggaccgttaaaccgtaccggttacccgggtcccgtttaaagttacgggttcgttaacgggtacggaacgaacgggttacccgtaaaggggttaccggtttaaacgttttacgggtttaccggacccgttttaccggttaaccgttttaccggtttaccggacggggttttacccggaacgggttaacccgggtcccggtaagggttaccccgg

SEQ ID NO: 198051 - DNA, 676 bp, Homo sapiens
  misc_feature: GYAE6OF02H000X.39.81.H04.1.454.CMB.1.raw
  modified_base (196)..(196): a, c, t, g, unknown or other
  misc_feature (196)..(196): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcattccttttcttggtggcagcaaacaaccaggtcgcccaacctcccaggttcagctaggtacagtctaggnctgagatgacgaacgccgtcgggctcagtgaacggtctccgtgacgaaggcttcgtgttacctaccttttaaccaactacgtggtactcgtaggttggtgcgaacgcgcccgtaggactaagggtctggaggtacgagtggatcggaactcgagccgtataacgtagtacggtacaacaacgtaaactgtaccgacaacgtacgtaacctcggaggacgagacgtccaacgtaatcgaaccacgaacgacaactacaccgtaacgacgaccgaccggtaacctacggtactacgtacgtagggtaacggacgactagtaagcgtagtacgacccggtaacggacggtacgttacggtattacgcggtagtaccggaggaacgtacgggtacggttaagttcggtttacgtacggttaccgtttaaccgttcgttaggaccgttaccgggacggggtacctaccggggttacctacccggg

SEQ ID NO: 198052 - DNA, 695 bp, Homo sapiens
  misc_feature: GYAE6OF02GN0F0.39.81.H04.1.454.CMB.1.raw
  modified_base (151)..(151): a, c, t, g, unknown or other
  misc_feature (151)..(151): n is a, c, g, or t
  modified_base (188)..(188): a, c, t, g, unknown or other
  misc_feature (188)..(188): n is a, c, g, or t
  modified_base (271)..(271): a, c, t, g, unknown or other
  misc_feature (271)..(271): n is a, c, g, or t
  modified_base (360)..(360): a, c, t, g, unknown or other
  misc_feature (360)..(360): n is a, c, g, or t
tcagtcgcactagtcacgaccggtgctcgatttagtagtgtagattcgcggggacccaaaaaccacacccctccttgggagaatcccctagatcacagctcctcaccatggactggacctggagcatccttttctggtggcagcaacaacnggtgcccactcccaggttcagctggtacagtctggancgtgagatgacgagccgtggggcctcagtgaggtctcctgcaggtcttctgtactcctttaccactatggtatcgaggttggngccgacacgggcccctggacgaagggcttaggaggtacggagtgggagtaggatcgaggtcgacttacgagtcggtacacgaacaaatntcgacacgaacgaacccgtacggacggcgaacgacgtccgaacctataccgaccacacgaacacgacctccgacggacgacgacccggacctacggtacgtaccggactagggacgtcgtaccgtaggacgtactacggtacgtaaccgacggttacccggtacggttacgttagttcccgttaggtccggtacggaagggttacggtagggttaaacggggttagtttaaccttttacgggtacctttacccgggttaccccttttaacggtttcggtaacccgggtttaccgggttcgggggtaacccgtacccgggggtacccttacccggg

SEQ ID NO: 198053 - DNA, 886 bp, Homo sapiens
  misc_feature: GYAE6OF02H16G9.39.81.H04.1.454.CMB.1.raw
  modified_base (385)..(385): a, c, t, g, unknown or other
  misc_feature (385)..(385): n is a, c, g, or t
tcagtcgcactagtcacgaccggtgctcgatttagtagtgtagattcgcggggacccaaaaaccacacccctccttgggagaatcccctagatcacagctcctcaccatggactggacctggagctattccttttctggtggcagcaacacaggtcgcccactcccgaggttcagcgtggtacagtctggagctgagagtagacgaacgtcccgtgggcctacgtagtaggtaacgtctaccgtagacgtaaggtccttacgttacggttacctaaccttttaccgaaattcgtaggttactccggttagggttacgggcgtaccgacgtacggccccgtagggaagacgggtctaggacggtggtacgtaggtacgtcggtacncgacggtaccgttattaaccgtaaggttccggtaaacctaacgaaaaacctaacggttaggaccgaaaccgtaccgttaaaccgaccccggttaacgaccggggacttaaacggacgtaccaacgttacgaacccgaacccgtaacgaaacggacccctaagtacccgtaccggtaaaccgggttaacgacccggtaaccgtttaccgtaaacggtaaccgggtttaccggaaacggtccggggtaaccgtaacgtaacggttaaggtcccttacggggaaacccgacccggttaaccggaaccccgggggtttcctttaacgtttaaccggtttacccggttaggaacccggtaaggaaccggtaaacgggttacgggtaaacgggtttaacctttacgtttaacgggttacccgtttacggttacccctttaaggtccgttaaccgggttcggtacccggggtaacccggtaacggttacccggccggtttaaccccgg

SEQ ID NO: 198054 - DNA, 529 bp, Homo sapiens
  misc_feature: GYAE6OF01AJAQ5.23.83.H06.1.454.CMB.1.raw
  modified_base (298)..(298): a, c, t, g, unknown or other
  misc_feature (298)..(298): n is a, c, g, or t
  modified_base (420)..(420): a, c, t, g, unknown or other
  misc_feature (420)..(420): n is a, c, g, or t
  modified_base (498)..(498): a, c, t, g, unknown or other
  misc_feature (498)..(498): n is a, c, g, or t
  modified_base (517)..(517): a, c, t, g, unknown or other
  misc_feature (517)..(517): n is a, c, g, or t
  modified_base (525)..(525): a, c, t, g, unknown or other
  misc_feature (525)..(525): n is a, c, g, or t
tcagacgcgagtatcacgaccggtgctcgatttagatcacgtgcgtcgcggggagctgtgggctcagaagcagagttctggggtgtctccaccatggcctggacccctctctggctcactctcctcactctttgcatagggtctttggtttcttctgggctgactcaggagcctgctatgtctgtggccgtgggacagacagtcaggatcacctgccgaggagacagcctcagggaccattccgccacctggtaccagcagaagccgggacaggcccctctacttgtcatcttggtanaaacgaccggccctcagggatccccgaccgattctctggctccacctcagggacacagcttcgtgaccatcactggggctcgaggcgaagatgaggctgagtattatgcagccacccggganagtggtaacttcgttaaccttttcgcctacccgggtacagtcggtccaccgtccttagcacgcccaaggccaaccccntcgtccactctcgttcccncctcctcntccg

SEQ ID NO: 198055 - DNA, 520 bp, Homo sapiens
  misc_feature: GYAE6OF01EM760.23.83.H06.1.454.CMB.1.raw
tcagacgcgagtatcacgaccggtgctcgatttagatcacgtgcgtcgcggggagctgtgggctcagaagcagagttctggggtgtctccaccatggcctggacccctctctggctcactctcctcactctttgcatagggtctgtggtttcttctgggctgactcaggagcctgctatgtctgtggccgtgggacagacagtcaggatcacctgccgaggagacagcctcagggaccattccgccacctgataccagcagaagccgggacaggcccctctacttgtcatcttggtagaaacgccggcctcgagggactccccgaccgattctctggctccacctcaggaacacagcttcgtgaccatcactggggctcgaggcgaagatgagctgagtattattgcagcgacccggacagtggtaatcgttacctttcgcacccggacagtcgtcaccgtccttagtcacgcccaaggcccaaccccactacgctactctacgtccccaccctcctacc

SEQ ID NO: 198056 - DNA, 550 bp, Homo sapiens
  misc_feature: GYAE6OF01DIWPO.23.83.H06.1.454.CMB.1.raw
  modified_base (321)..(321): a, c, t, g, unknown or other
  misc_feature (321)..(321): n is a, c, g, or t
tcagacgcgagtatcacgaccggtgctcgatttagatcacgtgcgtcgcggggtcccttcctatgataagagaggcctggaggttcctccttagctgtgggctcagaagcagagttctggggtgtctccaccatggcctggacccctctctggctcactctcctcactctttgcatagggtctgtggtttcttctgggctgactcaggagcctgctatgtctgtggccgtgggacagacagtcaggatcacctgccgaggagacagcctcagggaccattccgccacctggtaccagcagaacgccgggacacggcccctntacttgtcatctttggtaacgaaacgccggccctcgacgggactccccgacgtacttctcgtcggcctccacctcgacgggaacacacgtcttcgttcgaccatcacgtcgggctcgaggcggaagatgaggctagagttattagtgacacgacgacccggatagtgtactcgttaccgtttcgaccgtacccggacacgtgtactaccgtactagtcacgcccgaacg

SEQ ID NO: 198057 - DNA, 590 bp, Homo sapiens
  misc_feature: GYAE6OF01A8F3W.23.83.H06.1.454.CMB.1.raw
  modified_base (281)..(281): a, c, t, g, unknown or other
  misc_feature (281)..(281): n is a, c, g, or t
tcagacgcgagtatcacgaccggtgctcgatttagatcacgtgcgtcgcggggagctgtgggctcagaagcagagttctggggtgtctccaccatggcctggacccctctctggctcactctcctcactctttgcatagggtctgtggtttcttctgggctgactcaggagcctgctatgtctgtggccgtgggacagacagtcaggatcacctgccgaggagacagcctcagggaccattccgccacctggtaccagcagaagccgggacacggcccctntactgtcatctttggacgaaacgaccggccctcacgggactccccgacgattcctcgtggcctccaccgtcgagggaaccacagtcctttcgtcgaaccctatccgaacgtcgggggcctcgaggcggaagagtggaggcgtaggaagttattagttgcgagccgaacccgggacgtaaggtaggttaacttcggtttaacctttccgaccgtacccgggacctagtcggtccaccgtccttagccacgacccgaacgacccaaccctacgtcgacctacctctaccgttaccccaccctcctcctaac

SEQ ID NO: 198058 - DNA, 667 bp, Homo sapiens
  misc_feature: GYAE6OF01DHAT6.23.83.H06.1.454.CMB.1.raw
  modified_base (109)..(109): a, c, t, g, unknown or other
  misc_feature (109)..(109): n is a, c, g, or t
  modified_base (233)..(233): a, c, t, g, unknown or other
  misc_feature (233)..(233): n is a, c, g, or t
  modified_base (308)..(308): a, c, t, g, unknown or other
  misc_feature (308)..(308): n is a, c, g, or t
tcagacgcgagtatcacgaccggtgctcgatttagatcacgtgcgtcgcggggagctgtgggctcagaagcagagttctggggtgtctccaccatggcctggacccctntctggctcactctcctcactctttgcataggttctgtggtttcttctgagctgactcaggaccctgctgtgtctgtggccttgggacagacagtcaggatcacatgaccaaggagacagcctanaagaagctaattatgactaaggttggtaaccagacaagaacgccgaggacacggccccagcacttgtcaatttanagaataaaaatgtccggacctacgagggactacccaagaccgtattctcgtggacctccgtagttacgaggaagacacacgtcctttaccgtacgaacctagtcgacggttcgggacctacggaagggtaccgggaagtagtacggacggtaccttagtaacgtttaagttttacccgaacggttaaacccgtaccccggggaactaaccgtaagggttacggtacgtaaccgttaagttaccgtttaaagttttcggggtaacgtttaccgggacgggtaacgggtaaccaacggtccgtacggtaaccccgtacgttaacgtaccgaaccgtccccgtaaaggtcccgttaccccgg

SEQ ID NO: 198059 - DNA, 864 bp, Homo sapiens
  misc_feature: GYAE6OF01ARSWK.23.83.H06.1.454.CMB.1.raw
tcagacgcgagtatcacgaccggtgctcgatttagatcacgtgcgtcgcggggagctgtgggctcagaagcagagttctggggtgtctccaccatggcctggacccctctctggctcactctcctcactctttgcatagggtctgtggtttcttctgggctgactcaggagcctgctatgtctgtggccgtgggacagacagtcaggatcacctgccgaggagacagcctcgagggaccattccgccacctggtaccagcagaacgccgggacacggcccctctacttcgtctattcgtttaggtaacgaaaccggaccggtccctacgaacggggtacctccccccggaaccgtacgtttcctcgtcgggcctaccccgaaccgttccgaacggggaaaccaaccgtacgtccgttttaccggttacgaaccctaagttccgaacgggttcggggggacccttacggaacggggaccgggaaagtacggtacgggaacgggtacgttaggtaaaggtttaactttaacgtttcggaccggtaacggaccccggtaaccccgggggtaacgtaacgggtttaccgggtttaaacgtttacccggttttaacccgtttttaccgggaccccggttaacccccgggggttaacccgtacggttaccggggttacccttaaccccgggtttacccgtttaacgggttacccgtaaacccgggtaccccccggtaaaaccgggtaccccccgtaaaaccccccggttacccggttaaccggttaccccctaaaccccgttttccccggtttaccccgggtttaccccccccgtccccccgtttaccccgttacccgttaaacccccgg

SEQ ID NO: 198060 - DNA, 696 bp, Homo sapiens
  misc_feature: GYAE6OF01B3WHA.23.83.H06.1.454.CMB.1.raw
  modified_base (265)..(265): a, c, t, g, unknown or other
  misc_feature (265)..(265): n is a, c, g, or t
tcagacgcgagtatcacgaccggtgctcgatttagatcacgtgcgtcgcggggtcccttcctatgataagagaggcctggaggttcctccttagctgtgggctcagaagcagagttctggggtgtctccaccatggcctggacccctctctggctcactctcctcactctttgcataggtctgtggtttcttcgtgggctgactcaggagcctgctatgtctgtcggccgtgggacagacagtcaggatcactgaccgagagacngcctcgaggacctacttcccgccacgtcggtaccaggacacggaacggccgggacacgggtcccccttacgtaccgtttcggtcctattacgtttacgggtaacgaaaccggtcccggaccctacgacgggacctccccggaacgtactttccgtcgtacggtacctacccgtaacctacgaacgggaaccacgacgtcgttacgtacgaacctacgtacgtacggtcgggtcctacggagggacggtaagacgtacggaacggtccgtaggtaacgtttagtttacgtaggaccgtacggaccggacccgggtacgtaacgggttacgttaaacgtttacccgttaacccgtttccgacccgtaccccgggtacacggttaccggtaccgtacccgttcgttaacgtccgtaccgaccccgtaaacccgg

SEQ ID NO: 198061 - DNA, 582 bp, Homo sapiens
  misc_feature: GYAE6OF01D8JYG.23.83.H06.1.454.CMB.1.raw
  modified_base (281)..(281): a, c, t, g, unknown or other
  misc_feature (281)..(281): n is a, c, g, or t
  modified_base (409)..(409): a, c, t, g, unknown or other
  misc_feature (409)..(409): n is a, c, g, or t
  modified_base (567)..(567): a, c, t, g, unknown or other
  misc_feature (567)..(567): n is a, c, g, or t
tcagacgcgagtatcacgaccggtgctcgatttagatcacgtgcgtcgcggggagctgtgggctcagaagcagagttctggggtgtctccaccatggcctggacccctctctggctcactctcctcactctttgcatagggtctgtggtttcttctgggctgactcaggagcctgctatgtctgtggccgtgggacagacagtcaggatcacctgccgaggagacagcctcgagggaccattccgccacctggtaccagcagaagccgggacaggcccctntactgtcatctttggagaaccgccggccctcgacgggactccccgacgtatttcctctggcctccaccgtcgaagggaaccacagtcttacgtgaccatcacgtggggctcgaggcggaagatggagngtagagttattattgcagccaccgggactaggtcgtaacttccgtttacctttcggaccgtacccgggtacacgtcggtcctaccgtccttagtccgacgtacccgaacggtaccccaaccccgtactcggtaccaccgttccttacccgttaccccnccctcctccgtaccg

SEQ ID NO: 198062 - DNA, 550 bp, Homo sapiens
  misc_feature: GYAE6OF01A51XO.23.83.H06.1.454.CMB.1.raw
  modified_base (282)..(282): a, c, t, g, unknown or other
  misc_feature (282)..(282): n is a, c, g, or t
  modified_base (440)..(440): a, c, t, g, unknown or other
  misc_feature (440)..(440): n is a, c, g, or t
  modified_base (484)..(484): a, c, t, g, unknown or other
  misc_feature (484)..(484): n is a, c, g, or t
  modified_base (513)..(513): a, c, t, g, unknown or other
  misc_feature (513)..(513): n is a, c, g, or t
  modified_base (517)..(517): a, c, t, g, unknown or other
  misc_feature (517)..(517): n is a, c, g, or t
  modified_base (546)..(546): a, c, t, g, unknown or other
  misc_feature (546)..(546): n is a, c, g, or t
tcagacgcgagtatcacgaccggtgctcgatttagatcacgtgcgtcgcggggagctgtgggctcagaagcagagttctggggtgtctccaccatggcctggacccctctctggctcactctcctcactctttgcatagggtctgtggtttcttctgggctgactcaggagcctgctatgtctgtggccgtgggacagacagtcaggatcacctgccgaggagacagcctcgagggaccattccgccacctggtaccagcagaagccgggacacggcccctntactgtcatctttggtagaacgaccggcctcagggactccccgaccgattctctcggctccacctcgacgggaacacgagtccttcgttcgacctatcacgtggggctacgaggcggaagagtggacggctaggagttattagtgcacgcaccggganagtggtaactcgttacctttcgccgtacccggacagtcggtacnccgttctagccagcccgacgcccaacccnctcnctaccttcctccgttaccccacccttccnctac

SEQ ID NO: 198063 - DNA, 703 bp, Homo sapiens
  misc_feature: GYAE6OF01AN9KD.23.83.H06.1.454.CMB.1.raw
  modified_base (278)..(278): a, c, t, g, unknown or other
  misc_feature (278)..(278): n is a, c, g, or t
  modified_base (337)..(337): a, c, t, g, unknown or other
  misc_feature (337)..(337): n is a, c, g, or t
  modified_base (363)..(363): a, c, t, g, unknown or other
  misc_feature (363)..(363): n is a, c, g, or t
tcagacgcgagtatcacgaccggtgctcgatttagatcacgtgcgtcgcgggagctgtgggctcagaagcagagttctgggtgtctccaccatggcctggacccctctctggctcactctcctcactctttgcataggtctgtggtttcttctgggctgactcaggagcctgctatgtctgtggccgtgggacaggacagtcaggatcacctgcgaggacgacagtcctcgaggaccattccgccacgtggtaccagcagacgccggacacggccctntacgtgcctagtctttaggagaaaccgtccggcctagacgggactccccgacgtattcncgtcgcctccacccgtgaacggaacncgacgtccttcggtacgaccctatcccgacggtcgggcctacgacggacggaagacgtacggaacggtctaggtaagttacttaacggtttcgacgaacggcccggtaaccccgggacgttaacgggttaacgggttaaacgtttccggttttaacccgttttccgggaacccgttaaccccggggaacttaacggttacggttacccgtaccggtttacccttaacggtacccgtaaccggtaccccgtaaaccggaccccgtaaaccccgtccgttaccgtacccgtaacccgtcgttaccccggttcccccgtccccttcccggtaccctaacccgg

SEQ ID NO: 198064 - DNA, 764 bp, Homo sapiens
  misc_feature: GYAE6OF01C0I1B.23.83.H06.1.454.CMB.1.raw
  modified_base (273)..(273): a, c, t, g, unknown or other
  misc_feature (273)..(273): n is a, c, g, or t
  modified_base (283)..(283): a, c, t, g, unknown or other
  misc_feature (283)..(283): n is a, c, g, or t
tcagacgcgagtatcacgaccggtgctcgatttagatcacgtgcgtcggcggggagctgtgggctcagaagcagagttctggggtgtctccaccatggccctggacccctctctggctcactctcctcactctttgcatagggtctgtggtttcttctgggctgactcaggagcctgctatgtctgtggccgtgggacagacagtcaggatcacctgccgagagacagcctcgagggaccattccgccacctggtaccagcagaagccggganacggcccctntacttgcatcttggaacgaaaccgaccggccctacgacgggactcccccgacgtattcctcgtcggcctcccaaccgttcgaacggggaaaccaccgtaacggtccgttttaccggtttacgaaccctaactcccgtaaccggttcggggggacccttcggaacggggtaccgggaaaggtacgtagggaacggctaggtaacggttatttaacgttgaccgtacggaccgaaccccggggtaactaagggttacggttaacgttacccggttttaacctttttcccgggacccgtaaaccccggggtaccctaaggttccggtaccgtaacccgggttaccttaacggttacccgaaccggtacccccgaaaaccgggttacccccaaaccccccgtaccgtttacccggtaccccgtaaccgtttccccggttacccggtttacccccccggtcccccttccccgtacccgttaacccg

SEQ ID NO: 198065 - DNA, 534 bp, Homo sapiens
  misc_feature: GYAE6OF01CZJNS.23.83.H06.1.454.CMB.1.raw
  modified_base (171)..(171): a, c, t, g, unknown or other
  misc_feature (171)..(171): n is a, c, g, or t
  modified_base (338)..(338): a, c, t, g, unknown or other
  misc_feature (338)..(338): n is a, c, g, or t
  modified_base (395)..(395): a, c, t, g, unknown or other
  misc_feature (395)..(395): n is a, c, g, or t
  modified_base (421)..(421): a, c, t, g, unknown or other
  misc_feature (421)..(421): n is a, c, g, or t
tcagacgcgagtatcacgaccggtgctcgatttagatcacgtgcgtcgcggggagctgtgggctcagaagcagagttctggggtgtctccaccatggcctggacccctctctggctcactctcctcactctttgcatagggtctgtggttttcttctgggctgactcaggngcctgctatgtctgtggccgtgggacagacagtcaggatcacctgccgaggagacagcctcagggaccattccgccacctggtaccagcagaacgccgggacacggcccctctacttgtcatcgtttggtacgaaacgccggcctcgagggactccccgacgattcnctggctccacctcaggaacacagcttcgtgaccatcacgtgggctcgaggcgaagangagctgagtattatgcagcaccgganagtgtaatcgttacctttcgcgtacccggctagtcgtcaccgtccttagccacgacccgaacgcccaaacccctctcgtaccactcttaccgttccccacccctcctctaccg

SEQ ID NO: 198066 - DNA, 748 bp, Homo sapiens
  misc_feature: GYAE6OF01EVBMA.23.83.H06.1.454.CMB.1.raw
tcagacgcgagtatcacgaccggtgctcgatttagatcacgtgcgtcgcggggagctgtgggctcagaagcagagttctggggtgtctccaccatggcctggacccctctctggctcactctcctcactctttgcatagggtctgtggtttcttctgggctgactcaggagcctgctatgtctgtggccgtgggacagacagtcaggatcacctgccgaggagacagcctcagggaccattccgccacctggtaccagcagaagccgggacacggcccctctactgtcattctggttcggtaaacgaaaccggccccgtcctagggaaggtccccgtaccccggacgttacgttcctcggtacggtccctacccctacctacgggaaacggaaccaacgcgttccgttttacggtaccgaactcaccttacggggcgggttccacggacgggaacgggaacgtagtagggacggttcgaggttaaagttaattttaggtcgacgtacgaacccccgggaacccgggaacgttacgggttaaaggttaccgttttaacccgttttttacccggttccgaacccccgggtaaccccggtaaccgttacgggttccgtaacccggtacccgttacgttttaccgacgaccccgtaacccgggtaacccgaaccccccgtaaccccgtacgttccgtaacccttacccgttaccgtttaccccggtaccccccttccccgttccgtaacccg

SEQ ID NO: 198067 - DNA, 810 bp, Homo sapiens
  misc_feature: GYAE6OF01BQWLE.23.83.H06.1.454.CMB.1.raw
  modified_base (109)..(109): a, c, t, g, unknown or other
  misc_feature (109)..(109): n is a, c, g, or t
tcagacgcgagtatcacgaccggtgctcgatttagatcacgtgcgtcgcggggagctgtgggctcagaagcagagttctggggtgtctccaccatggcctggacccctntctggctcactctcctcactctttgcagtgggtctgttggtttcttcgtgggctgactcgaggacgcctgctatgtctggtcggccggtgggacagacagtcgaggactccaccgtgaccggaaggacgacgacgcccgtacgacgggacctacgttcccgcccgaacccgttacggtaacccaggaccgaaacgggaaaccgggacccggggaaccgtaaccgggtcccccccttacgttaaccgtttcggtaccttaacgtttaccggttttacgggaaaccggaaaacccggtccccggtcccgttaacggacgggtacccttacccccggacgttacttccgtccgtacgtcctacccacgtacgaacggtaccacgtacgtcgttaccgtacgaccctagtccgtacggtcgggtacctaccggagggaaccgtaaggagtacgggacggtactaaggttacgttaactttagtcggaaccgtacgacccgggaaccggtactaggtttaacggtactttacccggtttacccggttcggaccccggttaaccggacgtttacgtccggttacccgttaccggttaccttacgacccgacccgaacccggaccccgaacccgtaaaccccttcgtaccgttacccgtaccgtttcctaccccgtttacccccacccgtttacccgtctaaccccgg

SEQ ID NO: 198068 - DNA, 524 bp, Homo sapiens
  misc_feature: GYAE6OF01B1C7S.23.83.H06.1.454.CMB.1.raw
tcagacgcgagtatcacgaccggtgctcgatttagatcacgtgcgtcgcggggagctgtgggctcagaagcagagttctggggtgtctccaccatggcctggacccctctctggctcactctcctcactctttgcatagggtctgtggtttcttctgggctgactcaggagcctgctatgtctgtggccgtgggacagacagtcaggatcacctgccgaggagacagcctcagggaccattccgccacctggtaccagcagaagccgggacaggcccctctacttgtcatctttggtagaaacgaccggccctcagggatccccgaccgattctctggctccacctcagggaacacagcttcgtgaccatcactggggctcaggcgaagatgagctgagtattattgcagcaccgggacagtgtaatcgttaccttttcgccgtacccggaccactggtccaccgtccttagtccagcccaaggccaaccccgactgtccactctcgtccccaccctcctctac

SEQ ID NO: 198069 - DNA, 730 bp, Homo sapiens
  misc_feature: GYAE6OF01D9Z3U.23.83.H06.1.454.CMB.1.raw
  modified_base (175)..(175): a, c, t, g, unknown or other
  misc_feature (175)..(175): n is a, c, g, or t
  modified_base (535)..(535): a, c, t, g, unknown or other
  misc_feature (535)..(535): n is a, c, g, or t
tcagacgcgagtatcacgaccggtgctcgatttagatcacgtgcgtcgcggggagctgtgggctcagaagcagagttctgggggtgtctccaccatggcctcggacccctctctggctcactctcctcacttcttgctatagggttctttggtttcttcgtggctgactcaggcncctgctatgtctggtggccgtgggacagacgagtcaggctacacgtgaccggaggacgacacgcctacgggaacggtacctaacgtttcccgaccctaccggtacggtaaccgagacgaacggaacgggccgggaacaccggtccccttacgtacgttcgtacacgtttacgtttacggaacgaaaccggcccgacccgtacggacggtacctccccggaacgtcttccgaccgtcggtaccctaaccctaccgtaacggaacgggtaaaccacgttacggttaccctttacgggttaccaacccgtaggtacccggtacgggttaccggggaccttacgggaacgggaccgggtaaagngggttacggacgggttcgtaaggtaaccgttaagttcgtaggacctaggacccgtaccggtaagtacggttacgtaaccgttaccgttacgtttccgaccgaccggattacgtcgtacaccgttctagaccgaccgaccaccggtaccaccgtctacgacctcttaccctcctcccgaccttccgtatcctacgg

SEQ ID NO: 198070 - DNA, 703 bp, Homo sapiens
  misc_feature: GYAE6OF01B51SD.23.83.H06.1.454.CMB.1.raw
tcagacgcgagtatcacgaccggtgctcgatttagatcacgtgcgtcgcggggagctgtgggctcagaagcagagttctggggtgtctccaccatggcctggacccctctctggctcactctcctcactctttgcatagggtctgtggtttcttctgggctgactcaggagcctgctatgtctgtggccgtgggacagacagtcaggatcacctgccgaggagacagcctcgagggaccattcccgccacctcggtaccagcagaagccgggacacggcccctctacgttgtcattcgtttaggacgaacgaccggcctacgacgggactccccgacgtacttaccgtctcggcctaccaccgtcaacgggaacacgacgtcttacgttacgacctatccgacgtcggggctcgacgggacggaagtagtggaggtcgtaggtagttaagtttattcggacacggaccgtacccgggacgtacggttacggttaacttcccggttttacccgtttccggacccgtaaccccgggtacctacggttcggttacccgtacccggttaccttacggttaccgaacccgtaccccggtaaaccgggtaccccctaaacccccggtaccgttacccgttacccgtaccccgtttacccgtttaccccggttcccccccgtaccccttccccgttccgttaaaccccgg

SEQ ID NO: 198071 - DNA, 660 bp, Homo sapiens
  misc_feature: GYAE6OF01EST9Y.23.83.H06.1.454.CMB.1.raw
  modified_base (415)..(415): a, c, t, g, unknown or other
  misc_feature (415)..(415): n is a, c, g, or t
tcagacgcgagtatcacgaccggtgctcgatttagatcacgtgcgtcgcgggtcccttcctatgataagagaggcctggaggttcctccttagctgtgggctcagaagcagagttctggggtgtctccaccatggcctggacccctctctggctcactctcctcactcttgcatagggtctgtggtttcttctgggctgactcaggagcctgctatgtctgtggccgtgggacagacagtcaggatcaccgtgccgaggacgacagcctcgaacgggaccacgttccccgcccacgtcggtacccaggccgaaggaacgcccgggacacggtccccctacttacttgtactattccgtttaggaacgaaacccggcccggccctacgacgggacctaccccggacgtactttccncgtcggcccttacccaccgtacgaacgggaaccctaccgtacgtcgtttaccggttacgacccgtactccgaaccggttcgggggaccctcggaacgggacggaacgagtcggaggctaggtaacgttatttagtcgacgtacgacccgaccgggactaggtacgttaaccttcgtttacccgttcgacccgacccgggtctacggtcgttacccgtaccgttcctaagccacggcccgaaaccg

SEQ ID NO: 198072 - DNA, 814 bp, Homo sapiens
  misc_feature: GYAE6OF01DPXKC.23.83.H06.1.454.CMB.1.raw
  modified_base (224)..(224): a, c, t, g, unknown or other
  misc_feature (224)..(224): n is a, c, g, or t
tcagacgcgagtatcacgaccggtgctcgatttagatcacgtgcgtcgcggggagctgtgggctcagaagcagagttctggggtgtctccaccatggcctggacccctctctggctcactctcctcactctttgcatagggtctgtggtttcttctgggctgactcaggagcctgctatgtctggtggccgtgggacagacagtcaggatcacctgccgagganacacgcctcgaggaccacttcccgccacctcggtaaccagacgaaggaacggaccgggaccacggtccccctacttaccgtttcggtacctacgtttccggttttaggtaaaccggaaacccgggtacccggtcccctacggaacgggtaccctacccccggaaccgtactttcccgttcgtccgggacccttacccgacccgtacggaacgggtaaccacgacgtcctttcgttacgaacctacgtcgaacggtggggtcctacggaagggaccgggtaaataggtacgggtaacgggtacgttaggttaaggtttaacgtttacgttcggaaccgtaccggtaccccggaaacccggggtagtaacgggtttacgggttaaaacctttccccgggtttttaaccgttttaccccggacccgggtaaaccccgggttaacctacggtttccggggttacccctacccggtttaccgtttaaccgcccggaaccgtaaccccggaaccggtaccccctaaaccccgtcgttaccgtacccctacccgtttcccttaccccgtacccctacccttccgtaccgttaacccg

SEQ ID NO: 198073 - DNA, 841 bp, Homo sapiens
  misc_feature: GYAE6OF01A9OFT.23.83.H06.1.454.CMB.1.raw
  modified_base (156)..(156): a, c, t, g, unknown or other
  misc_feature (156)..(156): n is a, c, g, or t
  modified_base (170)..(170): a, c, t, g, unknown or other
  misc_feature (170)..(170): n is a, c, g, or t
tcagacgcgagtatcacgaccggtgctcgatttagatcacgtgcgtcgcggggagctgtgggctcagaagcagagttctggggtgtctccaccatggcctggacccctctctggctcactctcctcactctttgcatagggtctgtggtttcttcngggctgactcaggncctgctatgtctgtggcgtgggacagacagtcaggactcacgtgccgaggagacgagcctacgacggggacctacgttcccgaccgtacccgttacggtaaccacggacaacgggaacgggcccgggtaaaccgaccgggtcccccttacgttaacggttcgttaccgtacgtttaccggtttacggtaaccggaaaacccggtacccggtacccttaccgggaacgggtaacccgtaccccccggtaacgtaaccgtttccggtccgttacccgggtacccttaccccgaacccggtaacccgtaacggggaaaccctaccggtacggtacccgtttaacggttaccgggaacccttacgtaaccggttacggtacccgggggttacttaacggaaccggggtacgggtaaacgtacggttacgggacgggttacgtacggtaagttagtttacgtacggtaccgacgtaccggaccggtacgtaggtacggttaaccgttaccggtttaccttaccggaccgtaacccggtaccttacggtaccggttaccgcccggtttaaccgttacgtaccgaccggtaccccgaaaccggtaccctaaccccggtccgtacgtaacccgtaccgttaccctacccgttaccccgaccttcccgtaaccgtacccg

SEQ ID NO: 198074 - DNA, 749 bp, Homo sapiens
  misc_feature: GYAE6OF01DC1C2.23.83.H06.1.454.CMB.1.raw
tcagacgcgagtatcacgaccggtgctcgatttagatcacgtgcgtcgcggggtcccttcctatgataagagaggcctggaggttcctccttagctgtgggctcagaatcagagttcgtggggtgtcctccacatggcctcggacccctctcgtgctcactctcctcacttcttgcagtggtctgttggtttcttcgtgggctgactcgaggactcctgcttatgtcgtggtcggaccggtgggacacgacgtacgtcgaggactaccgaccgtggaccggagggaacgaccgacgccgtacggaacgggtacctacgtccccgaccctacggtcggtaacccaggacgaacggaaccgggcccgggaccaccggtccccttattacgttcgtacctagtttcgttaacgggtaaccgaaccccggcccggtaccccgtcggaaccgggtaccccgtaccccggtaacgttacctttccgtaccgttccggtaccccttacccgacccgtacgggaaacggaacccacgttaaccggttccttacggttacgacctaagtccgtacggtccgggtacacgggtaacggaccggtaagacgtgggtagtcgtaaggttacgttaagtttacgcgaaccggtacgacccgggtaccggtagtacggttagttaccgtttaccggtttacgtaccggacccgtaccggtctacggtccgtactccgttactagccgaccgtacccgaacccg

SEQ ID NO: 198075 - DNA, 727 bp, Homo sapiens
  misc_feature: GYAE6OF01B0Z1A.23.83.H06.1.454.CMB.1.raw
  modified_base (171)..(171): a, c, t, g, unknown or other
  misc_feature (171)..(171): n is a, c, g, or t
tcagacgcgagtatcacgaccggtgctcgatttagatcacgtgcgtcgcggggagctgtgggctcagaagcagagttctggggtgtctccaccatggcctggacccctctctggctcactctcctcactctttgcatagggtctgtggtttcttctgtgctgactcgaggncctgctatgtctggtggccgtgggacagacagtcagactcactgccgaggacgacagcctacgacgggaccacttcccgccaccgtcggtaccacgacaacggaacggcccgggaacaccggtcccccttacgttacgtttcggtacctagtttccggttttacgggaaacggaaacccggtacccgggtacccctacggaaccggggtaccccttacccccggaaccgttaactttccctaccggtccggtaccctacccaacccgtacggaacggggtaaacctaccgtacggtcccgtttaccggttacgaacccgtagtaccgtaaccggttcggggtacctacgggaacgggacggtaagtagtacggacggtactaggtagttagttacgtcgacgtaccgaccgaccggtatacggtagttaacttaccgttaccttcgaccgtaccggactacgtcgtaccaccgttctacgtcccgacgtacccgaacgacccctacccgtacgttaccgactacccttccgttacccgtcccctaccgtccctacg

SEQ ID NO: 198076 - DNA, 603 bp, Homo sapiens
  misc_feature: GYAE6OF01AYLCW.23.83.H06.1.454.CMB.1.raw
  modified_base (327)..(327): a, c, t, g, unknown or other
  misc_feature (327)..(327): n is a, c, g, or t
  modified_base (467)..(467): a, c, t, g, unknown or other
  misc_feature (467)..(467): n is a, c, g, or t
tcagacgcgagtatcacgaccggtgctcgatttagatcacgtgcgtcgcggggtcccttcctatgataagagaggcctggaggttcctccttagctgtgggctcagaagcagagttctgggggtgtctccaccatggcctggacccctctctggctcactctcctcactctttgcatagggtctgtggtttcttctgggctgactcaggagcctgctatgtctgtggccgtgggacagacagtcaggatcacctgccgaggagacagcctcagggaccacttcccgcccacctggtacccagcaggaacgccgggacacggcccctntacttgtcattcgttgtaacgaaaccgcccggccctcgacgggactccccgacgtacttccgtctcggcctccacctcgaacgggaaccacgagtcctttcgtcgtaccactcgacggtcgggctacgagggacggaagngtaggagggctggattagtttagtacgacaggtcccgaccgggataggttaggttaacttccggtttacccgttcgacccgtacccgggctacgtcggtccgtacccgttacttacgccgaccgcccgtaacccgg

SEQ ID NO: 198077 - DNA, 676 bp, Homo sapiens
  misc_feature: GYAE6OF01ES3CW.23.83.H06.1.454.CMB.1.raw
  modified_base (228)..(228): a, c, t, g, unknown or other
  misc_feature (228)..(228): n is a, c, g, or t
  modified_base (231)..(231): a, c, t, g, unknown or other
  misc_feature (231)..(231): n is a, c, g, or t
  modified_base (235)..(235): a, c, t, g, unknown or other
  misc_feature (235)..(235): n is a, c, g, or t
  modified_base (276)..(276): a, c, t, g, unknown or other
  misc_feature (276)..(276): n is a, c, g, or t
  modified_base (283)..(283): a, c, t, g, unknown or other
  misc_feature (283)..(283): n is a, c, g, or t
tcagacgcgagtatcacgaccggtgctcgatttagatcacgtgcgtcgcggggagctgtgggctcagaagcagagttctggggtgtctccaccatggcctggacccctctctggctcactctcctcactctttgcagtagggtctgttggtttcttcgtgggctgactcgaggcgcctgctatgtcgtggtcggccgtggacagacagtcagatcaccgtgcgagganacngccncgacggaccactccgccacgtcggacagcagacgccggacncgccctntactgtctcgttcgtttacgacgaaccgcccgtccgtacgacgggtacctaccccgacgtacttcgtccgtcgtccctccaccgtacgacggaacctacgtcgtcttcgtaccgacctagtccgtacggtcgggactacggaacgggtacggaagtgtacgggtagtcgtaggtaagttagttagttcgacgtaccgtccggtaccgggtaacgtacgggttacgttaacgtttaccgtttacccgttaccgacccgtacccggtacgtacgttccgtaccgtacccgtcgttaccgtaccgacccgtacccgaaccggtacccctaacccgtcgtaccgttccctaacccgttcgttacccccgttcccctaccccttcctaccgttacccg

SEQ ID NO: 198078 - DNA, 688 bp, Homo sapiens
  misc_feature: GYAE6OF01C0TCH.23.83.H06.1.454.CMB.1.raw
  modified_base (121)..(121): a, c, t, g, unknown or other
  misc_feature (121)..(121): n is a, c, g, or t
  modified_base (203)..(203): a, c, t, g, unknown or other
  misc_feature (203)..(203): n is a, c, g, or t
tcagacgcgagtatcacgaccggtgctcgatttagatcacgtgcgtcgcgggtcccttcctatgataagagaggcctggagttcctccttagctgtggctcagaagcagagttctggggtntctccacatggcctcggacccctctcgtgctcactcctcctcacttcttgctagtaggtctgttgtttcttgtggctgactnaggactcctgactatgtcgtggtcggccgtaggacagactagtcaggtactccgactcggacggaggacaacgcgtccgtacggacggtacctacgttcccgacccgtaaccggtaccgtaaccaacgacgaacggaaccggacccggaacgcccgtacccttactacgttcgtacgtcttacggttaacggaacgaaaccggacccggtcccgtacggaacggtaccctccccgtacgttactcgtaccgtcgacctaccgacgtacgaacggaacaccgtcgtacttcgtatacctacgtcgacggtcggctaggacggagagtcgacggtgcgtaagtacgttgtacgtcgacacggtaccacggtacgtacggttacgtaacgttaccgtttacccgtacccggtacccggtaaccggtaccgttacgtacgtaccgtaccccgtttagtacccgtaccgacccgaacccggtaaaccccg

SEQ ID NO: 198079 - DNA, 709 bp, Homo sapiens
  misc_feature: GYAE6OF01C0XLC.23.83.H06.1.454.CMB.1.raw
  modified_base (85)..(85): a, c, t, g, unknown or other
  misc_feature (85)..(85): n is a, c, g, or t
  modified_base (109)..(109): a, c, t, g, unknown or other
  misc_feature (109)..(109): n is a, c, g, or t
  modified_base (170)..(170): a, c, t, g, unknown or other
  misc_feature (170)..(170): n is a, c, g, or t
  modified_base (234)..(234): a, c, t, g, unknown or other
  misc_feature (234)..(234): n is a, c, g, or t
  modified_base (667)..(667): a, c, t, g, unknown or other
  misc_feature (667)..(667): n is a, c, g, or t
  modified_base (696)..(696): a, c, t, g, unknown or other
  misc_feature (696)..(696): n is a, c, g, or t
tcagacgcgagtatcacgaccggtgctcgatttagatcacgtgcgtcgcggggagctgtgggctcagaagcagagttctggggtntctccaccatggcctggacccctntctgctcactctctcactcttgcatgggtctgtggttttctcgtgggctagactcgaggcncctgctagttgtctgtcggacgtggacagctagtcaggactccaccgtggaccgaggacgtacncgtccctaggaacggcctaccttcccggaccctaccggtacggtaccacgacgaaggaaccggcccgggactaccggtccccttacctagttcgtaccttagttccgtttaacggaaccggaaccccggtacccggtcccaggtaccgggtccctacccccggtaactcgttcctacgtccgacctacccgtacgtacgaacggtaactacgtacgtcccgtttacggaccaccgtacgccgtcgggtcggtcctacgagggtacgagtcgacggtaggtcttaggtacttagtctaggccgacggtccggaccggttaagtcgttacgttaaccgtttaccgttccgttaccggaccgtaccgtacggtcgttaccgacccgttaacgtttccgtaaccgacggtacccgaccgtacggacccccttaccgntaccgtacctccgtccgtcccgtaccccnccctgacctccgg

SEQ ID NO: 198080 - DNA, 523 bp, Homo sapiens
  misc_feature: GYAE6OF02G0QQG.23.83.H06.1.454.CMB.1.raw
tcagacgcgagtatcacgaccggtgctcgatttagatcacgtgcgtcgcggggagctgtgggctcagaagcagagttctggggtgtctccaccatggcctggacccctctctggctcactctcctcactctttgcatagggtctgtggtttcttctgggctgactcaggagcctgctatgtctgtggccgtgggacagacagtcaggatcacctgccgaggagacagcctcagggaccattccgcacctggtaccagcagaagccgggacaggcccctctacttgtcatctttggtagaaacgaccggccctcagggactccccgaccgattctctggctccacctcagggaacacagcttcgtgaccatcactggggctcaggcggaagatgaggctgagtattattgcagcacccgggacagtggtaatcgttacctttcgcacccgggcatggtcaccgtccttagtcacgcccaaggcccaacccactcgtccactctcgttccccacccttcctctac

SEQ ID NO: 198081 - DNA, 555 bp, Homo sapiens
  misc_feature: GYAE6OF02GH0CV.23.83.H06.1.454.CMB.1.raw
  modified_base (282)..(282): a, c, t, g, unknown or other
  misc_feature (282)..(282): n is a, c, g, or t
  modified_base (527)..(527): a, c, t, g, unknown or other
  misc_feature (527)..(527): n is a, c, g, or t
  modified_base (532)..(532): a, c, t, g, unknown or other
  misc_feature (532)..(532): n is a, c, g, or t
  modified_base (544)..(544): a, c, t, g, unknown or other
  misc_feature (544)..(544): n is a, c, g, or t
  modified_base (551)..(551): a, c, t, g, unknown or other
  misc_feature (551)..(551): n is a, c, g, or t
tcagacgcgagtatcacgaccggtgctcgatttagatcacgtgcgtcgcggggagctgtgggctcagaagcagagttctggggtgtctccaccatggcctggacccctctctggctcactctcctcactctttgcatagggtctgtggtttcttctgggctgactcaggagcctgctatgtctgtggccgtgggacagacagtcaggatcacctgccgaggagacagcctcagggaccattccgccacctggtaccagcagaacgccgggacacggcccctntacttgtcatctttaggacgaacggaccggccctcgacgggactccccggacgtattcctctcggcctcccacctcacgggaacacgagtccttcgttgaccagtcacgtcggggctcgaggcggaagatggaggctagagttattagttgacacgccgaccggataggtacgtacttccgtttaccgttcgaccgtacccggactagtcgtccacgttctacgcacgaccgaacgacccacccntcacnctctccgtcccncccttcnctac

SEQ ID NO: 198082 - DNA, 807 bp, Homo sapiens
  misc_feature: GYAE6OF02JTT01.23.83.H06.1.454.CMB.1.raw
  modified_base (171)..(171): a, c, t, g, unknown or other
  misc_feature (171)..(171): n is a, c, g, or t
  modified_base (283)..(283): a, c, t, g, unknown or other
  misc_feature (283)..(283): n is a, c, g, or t
tcagacgcgagtatcacgaccggtgctcgatttagatcacgtgcgtcgcggggagctgtgggctcagaagcagagttctggggtgtctccaccatggcctggacccctctctggctcactctcctcactctttgcatagggtctgtggtttcttctgggctgactcaggancctgctatgtctgtggccgtgggacagacagtcaggatcacctgccgaggagactagcctgagggaccattccgccacctggtaaccagcagaacgccggacaggccccctntacttggcattcttcggaagaaaccgaccggcctcgaacgggactccccggaacgtacttcctacgtcggccttacccgaccttccgaacggggaaaccctacaaccgggtccttttaccggttaaccgaaccccgtaagtttcccgtaaccgtcgggggggtacccttaccggaaacggggtccggaaaacgggtacgttacgggtaaacgggtaccgttacgggtaacgtttaaacgtttaacggttcggtaaccggtaacggacccggtaacccgggggtaacgtagggttaaacgggttaaacgttttaccggtttaaccgttttttaaccggaccggttaaacccccgggtaccgtaaacgtttccgggtacccgtaaacccggttccgtttaacggtacccgtaacggtaccccggtaaaccgggtaccccaaacccccgtaacgttacccggttaaccgtacccgttcccgttaacccgggtttcccccgtaaccccgttccctacccgttaacccg

SEQ ID NO: 198083 - DNA, 526 bp, Homo sapiens
  misc_feature: GYAE6OF02G4I4A.23.83.H06.1.454.CMB.1.raw
  modified_base (293)..(293): a, c, t, g, unknown or other
  misc_feature (293)..(293): n is a, c, g, or t
  modified_base (335)..(335): a, c, t, g, unknown or other
  misc_feature (335)..(335): n is a, c, g, or t
tcagacgcgagtatcacgaccggtgctcgatttagatcacgtgcgtcgcggggagctgtgggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagttggtaccagcagaagccaggacaggccccagcacttgcatttangaataaaaatagtcggccctcgagggatcccagaccgattcnctggctccagttcaggagacacagcttcctagaccatcacgtgggctcgagggcgaagagtgaggctgactatttcgtagtaaccgtcccgggacaacgaggtggtgacgtatacgttaagtttgggtattcgggcggaagggaccaaggctacggacccgtactaacggtcacggcccgaggcctcccgg

SEQ ID NO: 198084 - DNA, 758 bp, Homo sapiens
  misc_feature: GYAE6OF02I413G.23.83.H06.1.454.CMB.1.raw
  modified_base (337)..(337): a, c, t, g, unknown or other
  misc_feature (337)..(337): n is a, c, g, or t
tcagacgcgagtatcacgaccggtgctcgatttagatcacgtgcgtcgcggggtcccttcctatgataagagaggcctggaggttcctccttagctgtgggctcagaagcagagttctgggggtgtctccaccatggcctggacccctctctggctcactctcctcactcttgcataggtctgtggtttctctgggctgactcgaggagcctgctatgtctgtggccgtagggacagacagtcaggactccaccgtgccggaggagacagcctcgagggaccctattcccggaccaccgtggaccagcgaaggaacggtccgggacacggtcccctntacgttcgtctattcgtttaggaacgaaaccgcccggcctacgacgggacctccccgacgtattccgtcgtcggcccttccgaaccgtacgaacgggtaaaccacgtaacgtccgtttaccggttacgaacccgtagtaccgtaacggtcggggtaccttacggaaccggggtaacgggaaacggtaagtacgggtaacgggtaccgttaaggtaacgtttaacgtttaagttacggacgtaaccggacccggtaaacccgggtaacgttaagggttaacgggtttaaccgtttcccggttttaacccgttttacccgacccgggttaaccccgggtaacccgttacgttaccgggttaacccgttacccggtttaacccgttaaccggtacccgtaaccggtacccccgtaaaccccggg

SEQ ID NO: 198085 - DNA, 523 bp, Homo sapiens
  misc_feature: GYAE6OF02GC0YG.23.83.H06.1.454.CMB.1.raw
  modified_base (320)..(320): a, c, t, g, unknown or other
  misc_feature (320)..(320): n is a, c, g, or t
  modified_base (428)..(428): a, c, t, g, unknown or other
  misc_feature (428)..(428): n is a, c, g, or t
  modified_base (458)..(458): a, c, t, g, unknown or other
  misc_feature (458)..(458): n is a, c, g, or t
tcagacgcgagtatcacgaccggtgctcgatttagatcacgtgcgtcgcggggtcccttcctatgataagagaggcctggaggttcctccttagctgtgggctcagaagcagagttctggggtgtctccaccatggcctggacccctctctggctcactctcctcactctttgcatagggtctgtggtttctctgggctgactcaggagcctgctatgtctgtggccgtgggacagacagtcaggatcacctgccgaggagacagcctcagggaccattccgccacctggtaccagcagaacgccgggacacggcccctntacttgtcatcttggagaaacgccggcctcagggactccccgacgattctctggcctccacctcagggaacacagcttcgtgaccatcacgtgggctcgaggcgaagntgaggctgagtattatgcagccgaccgganagtgtatcgttaccgtttcgaccacccggacagtcggtcaccggtccttagcacgcccgtaacgg

SEQ ID NO: 198086 - DNA, 607 bp, Homo sapiens
  misc_feature: GYAE6OF02GJTTN.23.83.H06.1.454.CMB.1.raw
  modified_base (282)..(282): a, c, t, g, unknown or other
  misc_feature (282)..(282): n is a, c, g, or t
  modified_base (448)..(448): a, c, t, g, unknown or other
  misc_feature (448)..(448): n is a, c, g, or t
tcagacgcgagtatcacgaccggtgctcgatttagatcacgtgcgtcgcggggagctgtgggctcagaagcagagttctggggtgtctccaccatggcctggacccctctctggctcactctcctcactctttgcataggtctgtggtttcttctgggctgactcaggagcctgctatgtctgtggccgtgggacagacagtcaggatcacctgccgaggagacagcctcgagggaccattccgccacctggtaccagcagaacgccgggacacggcccctntacttgcatctttggtaagaaaccgaccggcctcgagggactccccgaccgattctctcggctcccacctcgaaggacacagccttacgtcgaacctatccgacgtcgggctcgaggacggaagagtggacggctgacgttattagttgcgagaccgacccggganaggttacggtaacttccgttacctttcgccgtacccggactagtcgtacaccgttacttagtactaccgacccgtaacgggacccctaaccccgtaccttacggtacctaaccgtccgtttccgttacccccgaaccccctttccgtacccttaacccg

SEQ ID NO: 198087 - DNA, 699 bp, Homo sapiens
  misc_feature: GYAE6OF02JYRI4.23.83.H06.1.454.CMB.1.raw
  modified_base (259)..(259): a, c, t, g, unknown or other
  misc_feature (259)..(259): n is a, c, g, or t
  modified_base (283)..(283): a, c, t, g, unknown or other
  misc_feature (283)..(283): n is a, c, g, or t
  modified_base (390)..(390): a, c, t, g, unknown or other
  misc_feature (390)..(390): n is a, c, g, or t
tcagacgcgagtatcacgaccggtgctcgatttagatcacgtgcgtcgcggggagctgtgggctcagaagcagagttctggggtgtctccaccatggcctggacccctctctggctcactctcctcactctttgcatagggtctgtggtttcttctgggctgactcaggagcctgctatgtctgtggccgtgggacagacagtcaggatcacctgccgaggagactagcctgagggaccattccgccaccgtggtaccngcagaaggccggacacggcccctntactgtcacttcgttaggtaacgaaccgtaccggtccctacgaacggggactcccccgaaccgtatttccgtctcgggccttacccgaccgttcgaacgggaaaccncgaacggtcctttaccggttcgaacccataccgacgtgggggcctacgacgggacgaaagacgttggacgggtctaggtaacgttattacgttgaacgtacggaccgacccgggatacggttcgggtaaactttccggtttaacctttcggaccggtaacccgggacctagttccgggtacaaccccggtttactaacggtaccgccccggtaaacgggccccctaaacccgtagttcccggtaactacccgtttacccgttccggtttaacccccaccccctttaccctaccgtaaccctttaccccg

SEQ ID NO: 198088 - DNA, 560 bp, Homo sapiens
  misc_feature: GYAE6OF02JDOQH.23.83.H06.1.454.CMB.1.raw
  modified_base (280)..(280): a, c, t, g, unknown or other
  misc_feature (280)..(280): n is a, c, g, or t
  modified_base (298)..(298): a, c, t, g, unknown or other
  misc_feature (298)..(298): n is a, c, g, or t
  modified_base (428)..(428): a, c, t, g, unknown or other
  misc_feature (428)..(428): n is a, c, g, or t
tcagacgcgagtatcacgaccggtgctcgatttagatcacgtgcgtcgcggggagctgtgggctcagaagcagagttctggggtgtctccaccatggcctggacccctctctggctcactctcctcactctttgcatagggtctgtggtttcttctgggctgactcaggagcctgctatgtctgtggccgtgggacagacagtcaggatcacctgccgaggagacagcctcagggaccattccgccactggtaccagcagaagccgggacacggcccctntacttgcattcttggtanaaacgccggcctcagggactccccgacgacttctacgtgcctccacctcaggaacacagccttgtagaccatcacgtgggctcgaggacgagagtcgaggtctgagttattatgacagccgacccggganagtggtacttcgttacctttccgcgtacccggactacgttcgtacctaccgttccgtacgtacgacgacccgaacggtacccaaccctacgtacgtccacttcctccgttaccccaccttaccctactaccg

SEQ ID NO: 198089 - DNA, 708 bp, Homo sapiens
  misc_feature: GYAE6OF02J0J7F.23.83.H06.1.454.CMB.1.raw
  modified_base (154)..(154): a, c, t, g, unknown or other
  misc_feature (154)..(154): n is a, c, g, or t
  modified_base (287)..(287): a, c, t, g, unknown or other
  misc_feature (287)..(287): n is a, c, g, or t
  modified_base (359)..(359): a, c, t, g, unknown or other
  misc_feature (359)..(359): n is a, c, g, or t
tcagacgcgagtatcacgaccggtgctcgatttagatcacgtgcgtcgcggggagctgtgggctcagaagcagagttctggggtgtctccaccatggcctggacccctctctggctcactctcctcactctttgcataggtctgtggttcttcngggctgactcaggagcctgctatgtctgtggccgttgggacagacagtcaggatcacctggaccgaggagacaggccctgacgggaccactccgccaccgtcggtacagcagaaggccggtacacggcccctntacttgtccagttcttggagtaaaccggccgcctcgacgggcctaccccgacgattcgtaccgtgcctaccncccgacgtacggaaccgtacaggtccttacgttcgaaccctattacccacgggtttggggacccttacgagggtaccggtaaggactagggacggacgttggtaacgttaagttacgttacggacgtacggtacccggtacccgggtaacgtaggtttaacggtaacgtttaccccggtttttaccgttccgggtacccggtaacccggggtacctaaccggttcggttacccggtacccgtttacccgttaaggtccccgtaacggtccccgtaaaccggccccaaacccgtaccgttcgtaccgtaccttccgtacccgttcccccgaccctttccctattaacccg

SEQ ID NO: 198090 - DNA, 660 bp, Homo sapiens
  misc_feature: GYAE6OF02HK5VR.23.83.H06.1.454.CMB.1.raw
  modified_base (287)..(287): a, c, t, g, unknown or other
  misc_feature (287)..(287): n is a, c, g, or t
tcagacgcgagtatcacgaccggtgctcgatttagatcacgtgcgtcgcggggagctgtgggctcagaagcagagttctggggtgtctccaccatggcctggacccctctctggctcactctcctcactctttgcatagggtctgtggtttcttctgggctgactcaggagcctgctatgtctgtggccgtgggacagacagtcaggatcacctgaccgaggagacagcctcgacgggaccacttccgccacctggtaccagccagaacgccgggacacggcccctntacgtgtcacttcgtttaggacgaaacgccggcctagacgggactccccgaccgtattcctcgtcggtcctcccgaaccgtcgaacggggaaccactacgtccgtttcgttacgaaccctatccgacgtcggggctcgagggacggtaagagtaggacgtacgtaggtaagttattagttacgacgtacggccgaacccgggactaggtacggttaacttcggtttacccgtttcgacccgtacccggtacgtagttcggtacctaccggttccttacggtaccacggtaccccgaacggccccaaaccccgtactaccggtacctacccgttccgtacccgtttacccccaccccgttccttaccctaaccg

SEQ ID NO: 198091 - DNA, 667 bp, Homo sapiens
  misc_feature: GYAE6OF02JB8XE.23.83.H06.1.454.CMB.1.raw
  modified_base (208)..(208): a, c, t, g, unknown or other
  misc_feature (208)..(208): n is a, c, g, or t
  modified_base (243)..(243): a, c, t, g, unknown or other
  misc_feature (243)..(243): n is a, c, g, or t
  modified_base (266)..(266): a, c, t, g, unknown or other
  misc_feature (266)..(266): n is a, c, g, or t
  modified_base (269)..(269): a, c, t, g, unknown or other
  misc_feature (269)..(269): n is a, c, g, or t
  modified_base (548)..(548): a, c, t, g, unknown or other
  misc_feature (548)..(548): n is a, c, g, or t
tcagacgcgagtatcacgaccggtgctcgatttagatcacgtgcgtcgcggggtcccttcctatgataagagaggcctggaggttcctccttagctgtgggctcagaagcagagttctggggtgtctccaccatggcctggacccctctctggctcactctcctcactctttgcataggtctgtggtttctctgggctgactcaggancctgctatgtctggttcggccggtagggacagacngtcaggactcacctgccgagganacngcctcacggggaccacttcccggcctaccgtggtaaccaggccaaggaacgcccggggactacgggccccctacgtacttggcacgttcgttttcggaaacgtaaaccggaccccgggttccctacggaacgggggtccctaccccccgggtactacgtttcctccgtccgggtaccttccccaaccgtccgaaggggtaaacccctacgacgtcccgttcgttacggaaccctgtaccgacggtcgggccttacggacggacggaagacctggacggnttagaggtttactagttcgacgtacgcccgacgggtacaggtaggttactccgttttaccgttcgacccggtaaccggcctacgtcgtccaccgtttccgtatccgacgccctaaccgg

SEQ ID NO: 198092 - DNA, 585 bp, Homo sapiens
  misc_feature: GYAE6OF02GL294.23.83.H06.1.454.CMB.1.raw
  modified_base (323)..(323): a, c, t, g, unknown or other
  misc_feature (323)..(323): n is a, c, g, or t
  modified_base (442)..(442): a, c, t, g, unknown or other
  misc_feature (442)..(442): n is a, c, g, or t
tcagacgcgagtatcacgaccggtgctcgatttagatcacgtgcgtcgcggggtcccttcctatgataagagaggcctggaggttcctccttagctgtgggctcagaagcagagttctggggtgtctccaccatggcctggacccctctctggctcactctcctcactctttgcatagggtctgtggtttcttctgggctgactcaggagcctgctatgtctgtggccgtgggacagacagtcaggatcacctgccgaggagacagcctcagggaccattcccgccacctggtaccagcaggaacgccgggacacggcccctntacttgtcattctttggacgaaacgccggcctcgagggactccccgacgattctctggcctccacctcgacgggaacacagcttcgtcgaccatcacgtggggctcgagggacggaagngtggaggcgttaggagttagttattcgacgagaccgacccgggacaggtaggtaacttccggtttaccgtttccggaccgtaacccggggacctagttcggtacctacccggttccgttacgtaccgacgaccccgtaaccgg

SEQ ID NO: 198093 - DNA, 647 bp, Homo sapiens
  misc_feature: GYAE6OF02HMRY1.23.83.H06.1.454.CMB.1.raw
  modified_base (360)..(360): a, c, t, g, unknown or other
  misc_feature (360)..(360): n is a, c, g, or t
tcagacgcgagtatcacgaccggtgctcgatttagatcacgtgcgtcgcggggagctgtgggctcagaagcagagttctggggtgtctccaccatggcctggacccctctctggctcactctcctcactctttgcatagggtctgtggtttcttctgggctgactcaggagcctgctatgtctgtggccgtgggacagacagtcaggatcacctgccgaggagacagcctcgagggaccattcccgccaccgtggtaaccagacaggaacggcccgggacacgggcccctctacgttgtacagttccgtttagggaacgaaaccgccggccctacgacgggacctccccgacgtattccncgtcggcctccacgtcgaggacacgacgtcttcgtcgacctatcacgtcgggctcgacgggacgaagagtggacggcgtaggtattagtttatcgacgacggaccgacccgggactacggtaggttaacgttccggttttaacccttttccggacccgtacccgggacctacgttcggtacctaccgttacttacggtccacggtaccccgaacggacccctaacccgtactacgtcctaaccgttccgttaccggttacccccgtccccgttaccctacgtaaccg

SEQ ID NO: 198094 - DNA, 559 bp, Homo sapiens
  misc_feature: GYAE6OF02GM8NQ.23.83.H06.1.454.CMB.1.raw
  modified_base (283)..(283): a, c, t, g, unknown or other
  misc_feature (283)..(283): n is a, c, g, or t
  modified_base (428)..(428): a, c, t, g, unknown or other
  misc_feature (428)..(428): n is a, c, g, or t
tcagacgcgagtatcacgaccggtgctcgatttagatcacgtgcgtcgcggggagctgtgggctcagaagcagagttctggggtgtctccaccatggcctggacccctctctggctcactctcctcactctttgcatagggtctgtggtttcttctgggctgactcaggagcctgctatgtctgtggccgtgggacagacagtcaggatcacctgccgaggagacagcctcgagggaccattccgccacctggtaccagcagaacgccgggacacggcccctntacttgcatcttggacgaacgaccggcctcgaggactccccgacgattctctcggctccacctcagggaacacagtcttcgtgaccatcacgtgggctcgaggcggaagagtgaggctagtagttattagtgcgagcgaccgganagtgtaacttcgttacctttcgccgaccggactacgtcggtacctacgtccttagtcacgtacccgaacggacccaacccgtacgtacgtaccgtacttccgtccgttacccctacccttcctactaaccg

SEQ ID NO: 198095 - DNA, 797 bp, Homo sapiens
  misc_feature: GYAE6OF02IT7SX.23.83.H06.1.454.CMB.1.raw
tcagacgcgagtatcacgaccggtgctcgatttagatcacgtgcgtcgcggggagctgtgggctcagaagcagagttctggggtgtctccaccatggcctggacccctctctggctcactctcctcactctttgcatagggtctgtggtttctctgggctgactcaggagcctgctatgtctgtggccgtgggacagacagtcaggactcaccgtgccgaggacgacacgcctacgacgggacccacttcccgccctaccgttacggtacccgagaccgaaggaacggccgggaacgaccggtacccccttcgttaaccgtttcgtacctacgtttccgttttagggtaacggtaaaaccggaccccggcccctacggacgggtaccgtacccccgtaccgtactttccgtcgtccggtaccttaccccgacccttacgaaccggggtaaccacgtaacggtccgtttacgttacgaaccctaacgttccgaccggttcggggaccttaccggacgggtaccggaaaggtacgtagggacggtcgtaggtagttacgtttagtcgacgacgtacccgaccggacgtaggtcggttaactttccgttttaaccgtttccggacccgtacccgggacgtacgttcgggtacccgtaaccgttaccgttacgtacccgtaaccggtaccccggtaaaccggtaaccccgtaaacccccgtaccgttacgttaccccgttaccgttacccggttttaccccggttccccccgtaccccgtttaccccgttaccctaacccg

SEQ ID NO: 198096 - DNA, 753 bp, Homo sapiens
  misc_feature: GYAE6OF02FMFEW.23.83.H06.1.454.CMB.1.raw
tcagacgcgagtatcacgaccggtgctcgatttagatcacgtgcgtcgcggggagctgtgggctcagaagcagagttctggggtgtctccaccatggcctcggacccctctctggctcactctcctcactctttgcagtagggtctgttggtttcttcgtgggctgactcgaggagcctgctatgtctggtggccgtgggacagacagtcaggatccaccgtgccgaggacgacacgcctacgacgggacctacgttccccgcctacctgggtaacccaggccgaaggaacggcccgggacaccggccccctagtaccttgtacctattcgttttaggaacggaaaccgacccggccctacgacgggacctcccccggaccgtactttccgtcgtcggcctcccaccgtacgaacgggaaccaccgacgtccttcgttacgacctatccgacggtcgggcctacggacgggacggaagcgtagggagtacgtaggtaagttattagttcggacgacggaccggaacccgggtatacgggttacggttaacgtttccggtttacccgttttaccggacccgtaacccgggtaccttacgttacccgggttacccgtaacccggtttccgttaacggtcccgaaccggaccccggtaaacccggtaccccctaaaccccgtaccgttccgtaacccgtacccgtttacccgttaccccggttacccccggtccccttacccgtacccgttacccg

SEQ ID NO: 198097 - DNA, 681 bp, Homo sapiens
  misc_feature: GYAE6OF02GVMLC.23.83.H06.1.454.CMB.1.raw
  modified_base (124)..(124): a, c, t, g, unknown or other
  misc_feature (124)..(124): n is a, c, g, or t
  modified_base (148)..(148): a, c, t, g, unknown or other
  misc_feature (148)..(148): n is a, c, g, or t
tcagacgcgagtatcacgaccggtgctcgatttagatcacgtgcgtcgcggggtcccttcctatgataagagaggcctggaggttcctccttagctgtgggctcagaagcagagttctggggtntctccaccatggcctggacccctntctggctcactctcctcactctttgcataggtctgtggtttcttcgtgggctgactcgaggagcctgctatgtctggttcggccgtgggacagacagtcaggatcaccgtgccggagacgacacgccgtacgaacgggaccacgttcccgacccaacccgttcggtaccgagaccgaaggtaaccggcccggggaacctccgggtcccccttacgttaacgtttcgactaatttccgtttaggaaccgaaaccggcccgtacccgtacgaacgggtaccctaccccggtacgtactttccgtacgtcggaccctacccgtaccgtaggtacggaaccacgtacgtcttcggtacgacctatcgtacgtcgggctacggtacggaggaacgtgtaggacgtacgtggaacgtttacttagtcgctacgccggaaccgtacgtacggtacgttacgttccgtttaccgtttccgacccgtacccggaacgtcgtccggtacgtccgttaccgttcgacctacggacctaacccgg

SEQ ID NO: 198098 - DNA, 767 bp, Homo sapiens
  misc_feature: GYAE6OF02GO8WS.23.83.H06.1.454.CMB.1.raw
tcagacgcgagtatcacgaccggtgctcgatttagatcacgtgcgtcgcggggagctgtgggctcagaagcagagttctggggtgtctccaccatggcctggacccctctctggctcactctcctcactctttgcatagggtctgtggtttcttcgtgggctgactcgaggagcctgctatgtctggtcggccgtgggacagacagtcaggactcaccgtggccgaggacgacacgtccgtcgaacgggacctacgttcccgaccaccgtcggtaccagcgaagaacggcccggacgacggtcccctctacgttgtctattacgtttaggaacgaaaccggacccggccctacgacgggtaccctacccccgaccgtacttaccgtcgtacggtccctacccgaccgtacggaacgggtaaacccacggaaccgttccgtttaccggtactaaccctacgtaccgtaccgggttcggggtacctaccggacgggacgggtaaacgtacggtacggaggtccgtaggttaagtttactttacgtcggaacgtaccgacccggtaaccgggtagttacggttaaccggttaacgtttacccggtttaacccgtttaccggaccggtaaccccgggtacttacggtaccggttacccgtacccgtttacgttacgtcccgtaaccgaccccggaaccggtacccccaacccggtccttacccggtaccctacgttcccgttcccgttccccgtaccctccgtactacccg

SEQ ID NO: 198099 - DNA, 750 bp, Homo sapiens
  misc_feature: GYAE6OF02GCX43.23.83.H06.1.454.CMB.1.raw
  modified_base (109)..(109): a, c, t, g, unknown or other
  misc_feature (109)..(109): n is a, c, g, or t
  modified_base (173)..(173): a, c, t, g, unknown or other
  misc_feature (173)..(173): n is a, c, g, or t
  modified_base (206)..(206): a, c, t, g, unknown or other
  misc_feature (206)..(206): n is a, c, g, or t
tcagacgcgagtatcacgaccggtgctcgatttagatcacgtgcgtcgcggggagctgtgggctcagaagcagagttctggggtgtctccaccatggcctggacccctntctggctcactctcctcactctttgcatagggtctgttggtttcttcgtgggctgactcgaggngcctgctatgtctgtcggccggtgggacagacngtcaggctcaccgtgccgaggacacagcctcgacgggacctacgttcccgcctaccgtcggtaaccagcaacggaacggcccgggacaccggtccccctacgttacttcgtaccgtactttcgtttagggaacgaacccggcccgtcccgtacgaccgggtacctacccccggacgtacttcctcgtcggtcccttacccaccgtacggacggaaccacgtacgttaccgtttcggtaccgacctacgtccgtacgggtcggggtctaccggaagggaccggtaaagcggttacgggacggttcgtaggttacgttagtttacgtcgaccgacggacccggaccggtagtacggtttaacggttaccgttccgttttaaccgtttccggacccgtacccgggtacttagggttcccgtaaccgttaccgttacgtaccgccgtaaccggacccggtaaaccggtaaccccctaacccgtccgttacccgtacccttaccgttccgtttacccgttacccccttacccgttaccctcgtaacccg

SEQ ID NO: 198100 - DNA, 719 bp, Homo sapiens
  misc_feature: GYAE6OF02I69JJ.23.83.H06.1.454.CMB.1.raw
  modified_base (226)..(226): a, c, t, g, unknown or other
  misc_feature (226)..(226): n is a, c, g, or t
  modified_base (528)..(528): a, c, t, g, unknown or other
  misc_feature (528)..(528): n is a, c, g, or t
tcagacgcgagtatcacgaccggtgctcgatttagatcacgtgcgtcgcggggagctgtgggctcagaagcagagttctggggtgtctccaccatggcctggacccctctctggctcactctcctcactctttgcagtggtctgtggtttctcgtgggctgactcgaggacgcctgctatgtctgtggccgtggacagcagtcaggactcactgaccgaggacacncgcctgacgggacctacgttcccgacctaccgtcggtaccagacaaggaacggcccgggaacaccggtcccctattacgtgtctacgttcgtttaggaacgtaaaccgccggtccctacgaacgggtacctaccccggtaccgtacttccgtcgtccggtacctacccgtaacgtcggaacggaaccacgtacggtctttaccggtacgactacgtacgtacggtcggtctaacgggacggtacgaacgtgtacgacggtcgtaggtaacgttcttagacgtacgacgtaccggaaccggtntaccggttaaggttaccgtttaccggtttaaccgttccggaccggtacccggtacctacggttccgtaacccgtccggttaccttacggtaccgacccggtacccgtaacccggtaacctaacccgtacgttccgtaccgttaccttcccgggtttacccttccccggacccctttacgaccgttaaccgg

SEQ ID NO: 198101 - DNA, 917 bp, Homo sapiens
  misc_feature: GYAE6OF02JAAZF.23.83.H06.1.454.CMB.1.raw
  modified_base (110)..(110): a, c, t, g, unknown or other
  misc_feature (110)..(110): n is a, c, g, or t
  modified_base (170)..(170): a, c, t, g, unknown or other
  misc_feature (170)..(170): n is a, c, g, or t
  modified_base (588)..(588): a, c, t, g, unknown or other
  misc_feature (588)..(588): n is a, c, g, or t
tcagacgcgagtatcacgaccggtgctcgatttagatcacgtgcgtcgcggggagctgtgggctcaggaagcagagttctggggtgtctccaccatggcctggacccctntctggctcactctcctcactcttgcatggtctggttgtttctctgggctagctcgaggcncctgctacttgtctcggtcggtccgtacggggaccagtacgtacgtcgagggtacttccgaccgtcggaccggacgggaacacgtaccggtccctacgggaaccgggtcctaacccggttccccgaccgtaccccggttaggggtaacccccaggtacccgtaacggaaccgggtaccccggggtctaaaccccggggtcccccttaccttaaacggttttccggaccttacgtttacccggtttaggggaaaccgtaaacccggcccccggtaccgttaccggaacgggtacccttcccccgggaacttcttccggtaccgtccggacccttcccaaccgttacggaacgggtaaccagtaccgttaccgttcgtaaccgaactcccgtccacgggtttccgggtcgacggtacggngtaacggtgtcggacgtcggttactaaggttattaccggttagaccgtaccgtacccgtaacgggtaccgtaacgggttacgtaccggttttaacccggtttcccgttaacccgggtcccggtaaccccgggttacccgtacggtttacccgggttacccgttacccggttaaccggttttcccgggacccgttacccggtacccccgggtaaacccggtacccccggtaaaccccgttacccggtttaaccggtacccccgttaccgttcccccggtttaacccggttaccccccccggttaccgttacccctaccggttaaccccgg

SEQ ID NO: 198102 - DNA, 867 bp, Homo sapiens
  misc_feature: GYAE6OF02FTL1T.23.83.H06.1.454.CMB.1.raw
  modified_base (150)..(150): a, c, t, g, unknown or other
  misc_feature (150)..(150): n is a, c, g, or t
  modified_base (216)..(216): a, c, t, g, unknown or other
  misc_feature (216)..(216): n is a, c, g, or t
  modified_base (248)..(248): a, c, t, g, unknown or other
  misc_feature (248)..(248): n is a, c, g, or t
  modified_base (324)..(324): a, c, t, g, unknown or other
  misc_feature (324)..(324): n is a, c, g, or t
tcagacgcgagtatcacgaccggtgctcgatttagatcacgtgcgtcgcggggtcccttcctatgataagagaggcctggaggttcctccttagctgtgggctcagaagcagagtttctggggtgtctccaccagtggcctggacccctntctggctcactctcctcactctttgcagtagggtctgttggtttcttcgtgggctgactcgaggancctgctatgtcgtgtcggccgtgggacagacngtcaggatccgacgtggaccgagggacgacgacgcctacgacgggacctacgtcccgacccaccgtcggtaaccgngacgaaggaaccggccgggaacgccggtccccctacgttacgttcgtacctagtttacgttacggtaacggaaacccggtcccggtacccgtacggaaccggggtacccttacccccgggacgtacctttcgtaccgtccggtccctaccccgtacggtaccggaaccgggtaacctacgtacggttcccgtttacggttaccgaacccttacgtaccgtaccgggttaccggggtaccttaccgggaacggggtacggtaaacggtacggtaccgggtaaccggtcgttaacgggtaaggttttaacgttttacgggttaccgaaccggtaaccgggacccgggtaaaccccgggtaagtttaacggggtttaaccggttaccgtttttacccccgggttttaacccggttttccccggggaacccccggttaaccccggggtaccccgttaacgggtttaccccgggttacccccggttacccggttttaaaccccggttacccggtacccggtaaccccggttacccggaaaccccccgg

SEQ ID NO: 198103 - DNA, 917 bp, Homo sapiens
  misc_feature: GYAE6OF02JKYC7.23.83.H06.1.454.CMB.1.raw
  modified_base (226)..(226): a, c, t, g, unknown or other
  misc_feature (226)..(226): n is a, c, g, or t
  modified_base (261)..(261): a, c, t, g, unknown or other
  misc_feature (261)..(261): n is a, c, g, or t
tcagacgcgagtatcacgaccggtgctcgatttagatcacgtgcgtcgcggggtcccttcctatgataagagaggcctggaggttcctccttagctgtgggctcagaagcagagttctgggggttgtcctccaccatcggcctcggacccctctcgtggctacactctcctcacttcgttgactagttagggtcttggttgtttcttcgtggctagactcgaggcnctgctatgttcgtggtcggccggtaggaccagacngtacgaaggtctactaccgtcgaacggagacgacaccgccgtacggaccggtacctacgttccccgacctaccgtcggtaccgacgtacgaacggaaccggaccggaaccgccgggttaccccttgttaaccgttcgtaaccgtcgttttacggttaacggaaaccgtaaccggtcccggtacctaacggaaccggttcccccgaaaccccggtcttaaccgtttccgtcccgtaacgggttccctaaacccgaccggttaacggaaaccgggaacccttacggtacccgttttacccgggtttccgtaaacccgggaaccgtttaaccgtaccggttaccgggtaaccgggtccgttaacggaacggggtaaccgggtaagtacccgtaaaggggtccgtttgggtaacggtttaacgtttaacgtttaccgggttacggaccccggttaaaacgggcccccgggtaaaccgggttaacgttcggtttttaaaccggggtttacccttttaaccccgggtttttaccccggttaacccgggtaaaccccgttaaacccgggtaccgtttaaccggttaccccggttaaccccgttacccggtttccggttaacccggaccccggttaaccccgggtaccccggttaaaaccccgg

SEQ ID NO: 198104 - DNA, 639 bp, Homo sapiens
  misc_feature: GYAE6OF02I2PMV.23.83.H06.1.454.CMB.1.raw
tcagacgcgagtatcacgaccggtgctcgatttagatcacgtgcgtcgcggggagctgtgggctcagaagcagagttctggggtgtctccaccatggcctggacccctctctggctcactctcctcactctttgcatagggtctgtggtttcttctgggctgactcaggagcctgctatgtctgtggccgtgggacagacagtcaggatcacctgccgaggacacagcctgacgggaccattccgccacctggaccagcagaacgccgggacacggcccctctacttgtcattcgtttaggaacgaaaccgccggccctacgacgggactcccccgacgtacttcctctcggcctcccgacctcgaacgggaaccacgacgtcctttcgtacgaccctagtcctaaccggtggggccttacgacgggacggtaaagtacgtgggacggtctacggaagttaactttattcggacgtaacggcccgaacccggggactagggtacggttaaactttccggtttaacccgttttcggacccgtaacccgggactagttcggtaccctaaccgttcttacgcgacgaccgaacggcccaacccgtatcgacctacgttctccgtcccctcccttccacgtac

SEQ ID NO: 198105 - DNA, 498 bp, Homo sapiens
  misc_feature: GYAE6OF01BVHA9.18.59.F04.1.454.CMB.1.raw
  modified_base (431)..(431): a, c, t, g, unknown or other
  misc_feature (431)..(431): n is a, c, g, or t
  modified_base (493)..(498): a, c, t, g, unknown or other
  misc_feature (493)..(498): n is a, c, g, or t
tcagtacgagtatgcacgaccggtgctcgatttagtacacacacttagggattggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagccccaaactcatgatttatgatgtcactaatcggccctcaggggtttctaatcgcttctctggctccaagtctggcaacacggcctccctgacccatctctgggctccaggctgaggacgaggctgattattactgcagctcatatacaagcaccagcactctctatgtcttcggaactgggaccaaggtcaccgtcctaggtcagcccaaggccaacccnctgtcactctgttcccgccctcctccatacctcgtactgagcgggctggcaaggcgcatagnnnnnn

SEQ ID NO: 198106 - DNA, 454 bp, Homo sapiens
  misc_feature: GYAE6OF01ENQI3.18.59.F04.1.454.CMB.1.raw
  modified_base (448)..(454): a, c, t, g, unknown or other
  misc_feature (448)..(454): n is a, c, g, or t
tcagtacgagtatgcacgaccggtgctcgatttagtacacacacttagggattgggggctttgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaacccactgtcactctgttcccaccctcctccatactcgtactgagcgggctggcaaggcgcatagnnnnnnn

SEQ ID NO: 198107 - DNA, 319 bp, Homo sapiens
  misc_feature: GYAE6OF01A7MWC.18.59.F04.1.454.CMB.1.raw
  modified_base (317)..(319): a, c, t, g, unknown or other
  misc_feature (317)..(319): n is a, c, g, or t
tcagtacgagtatgcacgaccggtgctcgatttagtacacacacttagggattggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaacatcggaagtcagcccaaggctgcccctcggtcactctgttcccaccctcctccatactcgtactgagcgggctggcaaggcgcatagnnn

SEQ ID NO: 198108 - DNA, 494 bp, Homo sapiens
  misc_feature: GYAE6OF01D08KZ.18.59.F04.1.454.CMB.1.raw
  modified_base (485)..(485): a, c, t, g, unknown or other
  misc_feature (485)..(485): n is a, c, g, or t
  modified_base (490)..(494): a, c, t, g, unknown or other
  misc_feature (490)..(494): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctcctgaccatctctgggctccaggctgaggacgaggctgattatactgcagctcatatacaagcacagcactctctatgtcttcggaactgggaccaaggtcaccgtctagtcagcccaagcccaacccactgtccactctcgttccccgcctcctccatacctcgtactgagcgggctggcaaggcncatgnnnnn

SEQ ID NO: 198109 - DNA, 453 bp, Homo sapiens
  misc_feature: GYAE6OF01CYFTC.18.59.F04.1.454.CMB.1.raw
  modified_base (443)..(453): a, c, t, g, unknown or other
  misc_feature (443)..(453): n is a, c, g, or t
tcagtacgagtatgcacgaccggtgctcgatttagtacacacacttagggattgggggctttgtctgggtctcctggacagtcgatcaccatctcctgcactggaaccagcagtgacgttggtggttataactatgtctcctggtaccaacagcaccaggcaaagcccccaaactcatgatttatgatgtcagtaatcggccctcaggggtttctaatcgcttctctggctccaagtctggcaacacggcctcctgaccatctctgggctccaggctgaggacgaggctgattatactgcagctcatatacaagcagcagcactcaagtcttcggaactgggaccaaggtcacgtctaggcagcccaaaggcccaaccccactgtcactctcgttccccgccctcctccatactctactgagcgggctggcaaggcgcatagnnnnnnnnnnn

SEQ ID NO: 198110 - DNA, 516 bp, Homo sapiens
  misc_feature: GYAE6OF01BXKYU.18.59.F04.1.454.CMB.1.raw
  modified_base (444)..(444): a, c, t, g, unknown or other
  misc_feature (444)..(444): n is a, c, g, or t
  modified_base (500)..(500): a, c, t, g, unknown or other
  misc_feature (500)..(500): n is a, c, g, or t
  modified_base (507)..(511): a, c, t, g, unknown or other
  misc_feature (507)..(511): n is a, c, g, or t
tcagtacgagtatgcacgaccggtgctcgatttagtacacacacttagggagttggggctttgcctgggtcctgggcccagtctgccctgtacgtcgagcctgcctccgtgtctgggtctcctggacagtcgatcaccatctcctgccactggaaccagcagtgacgttggtggttataactatgtctcctggtaccaacagcacccaggccaaacgcccccaaactcatgactttatgatgtcagtaatcggccctcaggggtttctaatcgcttctctggcttccaagtctggcaacacggcctccctgacccatcctcgtgggcctccgaggctgaggacgaggctgatttattaactgtcagctcatactacaagcagcagcactcaagtctcggaactgggaccaagtcaccgtctagtcagcccaaggcccaacccgntcgcactctcgtcccaccctctaccatacctcgtactgacgcggctggacaaggcncatacgnnnnnggacg

SEQ ID NO: 198111 - DNA, 321 bp, Homo sapiens
  misc_feature: GYAE6OF01AG6L4.18.59.F04.1.454.CMB.1.raw
  modified_base (317)..(321): a, c, t, g, unknown or other
  misc_feature (317)..(321): n is a, c, g, or t
tcagtacgagtatgcacgaccggtgctcgatttagtacacacacttagggattggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaacatcggaagtcagcccaaggctgcccctcggtcactctgttcccaccctcctccatactcgtactgagcgggctggcaaggcgcatagnnnnn

SEQ ID NO: 198112 - DNA, 330 bp, Homo sapiens
  misc_feature: GYAE6OF01BSK0D.18.59.F04.1.454.CMB.1.raw
  modified_base (191)..(191): a, c, t, g, unknown or other
  misc_feature (191)..(191): n is a, c, g, or t
  modified_base (314)..(330): a, c, t, g, unknown or other
  misc_feature (314)..(330): n is a, c, g, or t
tcagtacgagtatgcacgaccggtgctcgatttagtacacacacttagggagttggggagagaagacaggattcaggacaatctccagcatggccggcttccctctcctcctcaccctcctcactcactgtgcagggtcctgggcccagtctgtgctgactcagccaccctcagcgtctgggacccccggnagagggtcaccatctcttgttctggaagcagctccaacatcggaagtcagcccaaggctgccccctggtcactctgttcccacctcctccatactcgtactgagcggctggcaggcgcatagnnnnnnnnnnnnnnnnn

SEQ ID NO: 198113 - DNA, 330 bp, Homo sapiens
  misc_feature: GYAE6OF01D82I6.18.59.F04.1.454.CMB.1.raw
  modified_base (317)..(330): a, c, t, g, unknown or other
  misc_feature (317)..(330): n is a, c, g, or t
tcagtacgagtatgcacgaccggtgctcgatttagtacacacacttagggattggggagagaagacaggattcaggacaatctccagcatggccggcttccctctcctcctcaccctcctcactcactgtgcagggtcctgggcccagtctgtgcttgactcagccaccctcagcgtctgggacccccggcagagggtcaccgatctcttgttctggaagcagctccaacatcggaagtcagcccaaggctgccccctggtcactctgttcccacctcctccatactcgtactgagcgggctggcaaggcgcatagnnnnnnnnnnnnnn

SEQ ID NO: 198114 - DNA, 499 bp, Homo sapiens
  misc_feature: GYAE6OF01C07X7.18.59.F04.1.454.CMB.1.raw
  modified_base (362)..(362): a, c, t, g, unknown or other
  misc_feature (362)..(362): n is a, c, g, or t
  modified_base (412)..(412): a, c, t, g, unknown or other
  misc_feature (412)..(412): n is a, c, g, or t
  modified_base (419)..(419): a, c, t, g, unknown or other
  misc_feature (419)..(419): n is a, c, g, or t
  modified_base (496)..(496): a, c, t, g, unknown or other
  misc_feature (496)..(496): n is a, c, g, or t
tcagtacgagtatgcacgaccggtgctcgatttagtacacacacttagggattgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttcaatcgcttctctggctccaagtctggcaacncggcctcctgaccatctctgggctccaggctgagacgagctgattatacngcagctnatatacaagcagcagcactcaagtcttcggaactgggaccaaggtcaccgtcctaggcagacccaaggcccaacccntcg

SEQ ID NO: 198115 - DNA, 323 bp, Homo sapiens
  misc_feature: GYAE6OF01CBKQM.18.59.F04.1.454.CMB.1.raw
  modified_base (317)..(323): a, c, t, g, unknown or other
  misc_feature (317)..(323): n is a, c, g, or t
tcagtacgagtatgcacgaccggtgctcgatttagtacacacacttagggattggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaacatcggaagtcagcccaaggctgcccctcggtcactctgttcccgccctcctccatactcgtactgagcgggctggcaaggcgcatagnnnnnnn

SEQ ID NO: 198116 - DNA, 532 bp, Homo sapiens
  misc_feature: GYAE6OF01D8DAA.18.59.F04.1.454.CMB.1.raw
  modified_base (301)..(301): a, c, t, g, unknown or other
  misc_feature (301)..(301): n is a, c, g, or t
  modified_base (394)..(394): a, c, t, g, unknown or other
  misc_feature (394)..(394): n is a, c, g, or t
tcagtacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgctatttaaaaggtgtccagtgtgaggtgcagctggtggagtctgggggaggcttggtaaagccggggggtccttagactcccctgtacagcctctggattcactttcagtaaggcctggatgaactgggtccncaggctccagggagggctggagtggtgcgtataaacaatgatggtggacaacagactacgctgcaccgtgaaaggcagatcaccatctcaagngatgaattacaaaagcacgctgtatctagacaaatgaacagctagagaaccgaggacacgagccgtagtattactcgtaccacactcccctagaacgcgtacaactactactacgtacgtataggacctgtgggtacg

SEQ ID NO: 198117 - DNA, 503 bp, Homo sapiens
  misc_feature: GYAE6OF01ATRDC.18.59.F04.1.454.CMB.1.raw
  modified_base (502)..(502): a, c, t, g, unknown or other
  misc_feature (502)..(502): n is a, c, g, or t
tcagtacgagtatgcacgaccggtgctcgatttagtacacacacttagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcaccaggcaaacgcccccaaactcatgatttatgatgtcactaatcggccctcagggtttctaatcgcttctctggctcaagtctggcaacacggcctccctgaccatctctgggctccaggctgaggacgaggctgattattactgcagctcatatacaagcaaccagcactctctatgtctcggaactcgggacaaggtcaccgtctaggtcagcccaaggccaacccnc

SEQ ID NO: 198118 - DNA, 505 bp, Homo sapiens
  misc_feature: GYAE6OF01BI7RA.18.59.F04.1.454.CMB.1.raw
  modified_base (495)..(495): a, c, t, g, unknown or other
  misc_feature (495)..(495): n is a, c, g, or t
  modified_base (500)..(505): a, c, t, g, unknown or other
  misc_feature (500)..(505): n is a, c, g, or t
tcagtacgagtatgcacgaccggtgctcgatttagtacacacacttagggattggggctttgcctgggtcctgggcccagtctgggctgacgcagccgccctcactgtctggggccccagggcagagggtcagcatcaactgcacttggaccagttccaacatcggggcaaattatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaggtcaccgtcctaagtcagcccaaggcccaaccctctgtccactctcgttcccaccctcctccatacctcgtactgacgcgggctggcaaggccgnatagnnnnnn

SEQ ID NO: 198119 - DNA, 465 bp, Homo sapiens
  misc_feature: GYAE6OF01AJNDN.18.59.F04.1.454.CMB.1.raw
  modified_base (443)..(443): a, c, t, g, unknown or other
  misc_feature (443)..(443): n is a, c, g, or t
  modified_base (449)..(465): a, c, t, g, unknown or other
  misc_feature (449)..(465): n is a, c, g, or t
tcagtacgagtatgcacgaccggtgctcgatttagtacacacacttagggattgggggctttgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtctaggtcagcccaaggcccaacccactgtcactctcgttcccaccctcctccatactcgtactgagcgggctggcaaggcncatagnnnnnnnnnnnnnnnnn

SEQ ID NO: 198120 - DNA, 506 bp, Homo sapiens
  misc_feature: GYAE6OF01D3L5W.18.59.F04.1.454.CMB.1.raw
  modified_base (198)..(198): a, c, t, g, unknown or other
  misc_feature (198)..(198): n is a, c, g, or t
  modified_base (424)..(424): a, c, t, g, unknown or other
  misc_feature (424)..(424): n is a, c, g, or t
  modified_base (432)..(432): a, c, t, g, unknown or other
  misc_feature (432)..(432): n is a, c, g, or t
  modified_base (445)..(445): a, c, t, g, unknown or other
  misc_feature (445)..(445): n is a, c, g, or t
tcagtacgagtatgcacgaccggtgctcgatttagtacacacacttagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacngtcgatcaccatctcctgcactggaaccagcagtgacgttggtggttataactatgtctcctggtaccaacagcaccaggcaaacgcccccaaactcatgatttatgatgtcactaatccggccctcgtaggggtttctaatcgcttctcgtggctcaagtctggcaacacggcctcctgaccatctctgggcctccgaggctgaggacgaggctgtattattacngcagctanatatacagcacancactctctatcgtctacgacgtgggaccaggtccacgtcagtcacgaccaagcccaacctc

SEQ ID NO: 198121 - DNA, 497 bp, Homo sapiens
  misc_feature: GYAE6OF01CW4X9.18.59.F04.1.454.CMB.1.raw
  modified_base (493)..(497): a, c, t, g, unknown or other
  misc_feature (493)..(497): n is a, c, g, or t
tcagtacgagtatgcacgaccggtgctcgatttagtacacacacttagggattggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagccccaaactcatgatttatgatgtcactaatcggccctcaggggtttctaatcgcttctctggctccaagtctggcaacacggcctccctgaccatctctgggctccaggctgaggcgaggctgattatactgcagctcatatacaagcaaccagcactctctatgtcttcggaactgggaccaaggtccaccgtcctaggtcagcccaaggcccaacccactgtcactctgttccccaccctcctccatacctcgtacctgagcggctggcaaggcgcatgnnnnn

SEQ ID NO: 198122 - DNA, 521 bp, Homo sapiens
  misc_feature: GYAE6OF01DBPBD.18.59.F04.1.454.CMB.1.raw
  modified_base (228)..(228): a, c, t, g, unknown or other
  misc_feature (228)..(228): n is a, c, g, or t
  modified_base (242)..(242): a, c, t, g, unknown or other
  misc_feature (242)..(242): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggnggttataactatgtctcctggtaccaacagcaccaggcaaacgccccaaactcatgatttatgatgtcactaatcggccctgagggtttctaatcgtcttctctggctcaagtctggcaacacggcctcctgaccatctctgggctccgaggctggaggacgaggctagatttagtactgcagctcaatactacaacgcaaccagcactctctatgtccttcggaactcgggacaacggtccaccgtcctaggtcacgacccaacggcccaaccctacg

SEQ ID NO: 198123 - DNA, 524 bp, Homo sapiens
  misc_feature: GYAE6OF01A49NE.18.59.F04.1.454.CMB.1.raw
  modified_base (305)..(305): a, c, t, g, unknown or other
  misc_feature (305)..(305): n is a, c, g, or t
  modified_base (325)..(325): a, c, t, g, unknown or other
  misc_feature (325)..(325): n is a, c, g, or t
tcagtacgagtatgcacgaccggtgctcgatttagtacacacacttagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgcccccaaactcatgatttangatgtcagtaatcggccctnagggtttctaatcgcttctctgctcaagtctggcaacacgcctcctgaccatctctgggctccgaggctgaggacgaggctagtattattactgcagctcatatacaagcagcagcactcaagtcttacggaacgtcgggaccaaggtccaccgttacctaagtccgacgacccaacggcccctaaaccccgtgtaccg

SEQ ID NO: 198124 - DNA, 468 bp, Homo sapiens
  misc_feature: GYAE6OF01CGVRV.18.59.F04.1.454.CMB.1.raw
  modified_base (445)..(445): a, c, t, g, unknown or other
  misc_feature (445)..(445): n is a, c, g, or t
  modified_base (451)..(468): a, c, t, g, unknown or other
  misc_feature (451)..(468): n is a, c, g, or t
tcagtacgagtatgcacgaccggtgctcgatttagtacacacacttagggattgggggctttgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattatactgcagctcatatacaagcaccagcactctctatgtcttcggaactgggaccaggtcaccgtctaggtcagcccaaggcccaaccccatcgtccactctcgttccccaccctcctccactactcgtactgacgcggctggcaaggcncatagnnnnnnnnnnnnnnnnnn

SEQ ID NO: 198125 - DNA, 504 bp, Homo sapiens
  misc_feature: GYAE6OF01BPXA1.18.59.F04.1.454.CMB.1.raw
  modified_base (423)..(423): a, c, t, g, unknown or other
  misc_feature (423)..(423): n is a, c, g, or t
  modified_base (449)..(449): a, c, t, g, unknown or other
  misc_feature (449)..(449): n is a, c, g, or t
  modified_base (498)..(498): a, c, t, g, unknown or other
  misc_feature (498)..(498): n is a, c, g, or t
  modified_base (500)..(500): a, c, t, g, unknown or other
  misc_feature (500)..(500): n is a, c, g, or t
  modified_base (502)..(502): a, c, t, g, unknown or other
  misc_feature (502)..(502): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcggatcaccatctcctgcactggaaccagcagtgacgttggtggttataactatgtctcctggtaccaacagcacccaggcaaagcccccaaactcatgatttatgatgtcactaatcggcctcaggggtttctaatcgcttctctggctccaagtctggcaacacggcctccctgaccatctctggctccaggctgagacgaggctgattatactgcagctcatatacaagcacagcactctctatgtcttcggaactgggaccaaggtcacgtctagtcagccaagccaacccnctgtcactctcgttcccgcccttccnccatacctcgtactgacgccggctggctaacgggccacactacggctancngncg

SEQ ID NO: 198126 - DNA, 452 bp, Homo sapiens
  misc_feature: GYAE6OF01DLFBD.18.59.F04.1.454.CMB.1.raw
  modified_base (378)..(378): a, c, t, g, unknown or other
  misc_feature (378)..(378): n is a, c, g, or t
  modified_base (442)..(452): a, c, t, g, unknown or other
  misc_feature (442)..(452): n is a, c, g, or t
tcagtacgagtatgcacgaccggtgctcgatttagtacacacacttagggattgggggctttgactgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattatactgcagctcatatacaagcagcagcactcaagtcttcggaactgggaccaggtcacgtctagcagcccaaggccaacccntcgtcactctcgttccccaccctcctccatacctcgtactgacgcggctggcaaggcgcatagnnnnnnnnnnn

SEQ ID NO: 198127 - DNA, 498 bp, Homo sapiens
  misc_feature: GYAE6OF01AWM09.18.59.F04.1.454.CMB.1.raw
  modified_base (487)..(487): a, c, t, g, unknown or other
  misc_feature (487)..(487): n is a, c, g, or t
  modified_base (493)..(498): a, c, t, g, unknown or other
  misc_feature (493)..(498): n is a, c, g, or t
tcagtacgagtatgcacgaccggtgctcgatttagtacacacacttagggattggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaacccactgtcactctcgttcccgccttcctccatacctcgtactgagcggctggcaaggcncatagnnnnnn

SEQ ID NO: 198128 - DNA, 509 bp, Homo sapiens
  misc_feature: GYAE6OF01BZ4E8.18.59.F04.1.454.CMB.1.raw
  modified_base (307)..(307): a, c, t, g, unknown or other
  misc_feature (307)..(307): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgcccccaaaactcatgatttangatgtcactaatcgccctcgagggtttctaatcgcttctctggctcaagtctggcaacacggcctccctgaccatctctgggctccgaggctgaggacgaggctgattatactgcagctcatataacaagcaaccagcactctctatgtcttcggaactgggaccaggtccaccgtcaggtcacgcccaaggcccaacccgc

SEQ ID NO: 198129 - DNA, 503 bp, Homo sapiens
  misc_feature: GYAE6OF01CV9KH.18.59.F04.1.454.CMB.1.raw
  modified_base (307)..(307): a, c, t, g, unknown or other
  misc_feature (307)..(307): n is a, c, g, or t
  modified_base (375)..(375): a, c, t, g, unknown or other
  misc_feature (375)..(375): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcaccaggcaaagcccccaaactcatgatttangatgtcactaatcggccctcagggtttctaatcgcttctctgctcaagtctggcaacacggcctcccngaccatctctgggctccagctgaggacgaggctgattattactgcagctcatatacagcaccagcactctactatgtcgttcggaactgggaacccaaggtcaccgtctaggtcagcccaaggacccc

SEQ ID NO: 198130 - DNA, 521 bp, Homo sapiens
  misc_feature: GYAE6OF01CBFOP.18.59.F04.1.454.CMB.1.raw
  modified_base (231)..(231): a, c, t, g, unknown or other
  misc_feature (231)..(231): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtggttataactatgtctcctggtaccaacagcacccaggcaaagcccccaaaactcatgatttatgatgtcactaatcggccctcgaggggtttctaatcgcttctctggctccaagtctggcaacacggcctcctgaccatctctgggctccaggctgaggcgagctgattattactgacagctcatactaacaagcagcagcactcaacgtctacggaacgtggaacctaggtccaaccgtctaacggtccaaggcccaaggcccctaaaccccg

SEQ ID NO: 198131 - DNA, 547 bp, Homo sapiens
  misc_feature: GYAE6OF01D1PR1.18.59.F04.1.454.CMB.1.raw
tcagtacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttgggtaaagccggggggtcccttagactcccctgtacagcctctggattcactttcagtaaggcctggatgaactgggtccgccaggctccgagggaaggggctggagtgggttggccgtattaaaaccaaactgatggtggacaacagactacgctgcaccgtgaaaggcagattcaccatctacaagagatgattacaaaaaggcaacgctgtatctgacaaatgaacagcctagagaaccgaggacacagccgtgtacttactgtaccacactcccctagaaacgcgtacaactactactaactaggtactggacctcg

SEQ ID NO: 198132 - DNA, 511 bp, Homo sapiens
  misc_feature: GYAE6OF01BRB8L.18.59.F04.1.454.CMB.1.raw
tcagtacgagtatggcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggcctcagggtttctaatcgcttctctggctccaagtctggcaacacggcctccctgaccatctctgggctcaggctgaggacgagctgatttatactgcagctcatatacaagccacagcactctctatgttcttcggatcgggaaccaaggtccacccgttcctaggtccacgcccgaaggaccccc

SEQ ID NO: 198133 - DNA, 523 bp, Homo sapiens
  misc_feature: GYAE6OF01BCHUT.18.59.F04.1.454.CMB.1.raw
  modified_base (345)..(345): a, c, t, g, unknown or other
  misc_feature (345)..(345): n is a, c, g, or t
  modified_base (514)..(514): a, c, t, g, unknown or other
  misc_feature (514)..(514): n is a, c, g, or t
  modified_base (519)..(523): a, c, t, g, unknown or other
  misc_feature (519)..(523): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagccccaaactcatgatttatgatgtcactaatcggcctcaggggtttctaatcgcttctctggctccaagtctggcaacacggccctccctgaccatcactgggctccaggctgaggatgaggctgactattacngccagtcctatgacatgaggctgagttggttcgtatgttcttcggatcgtcgggaccaagggtcaccgttcaagtcacgacccaaggcccaaccctctcgtaccacctcgttccgttccccgccctccctcctactactccgtactggacgcgggactggcaacggcgnatagnnnnn

SEQ ID NO: 198134 - DNA, 468 bp, Homo sapiens
  misc_feature: GYAE6OF01DVC83.18.59.F04.1.454.CMB.1.raw
  modified_base (387)..(387): a, c, t, g, unknown or other
  misc_feature (387)..(387): n is a, c, g, or t
  modified_base (447)..(447): a, c, t, g, unknown or other
  misc_feature (447)..(447): n is a, c, g, or t
  modified_base (453)..(468): a, c, t, g, unknown or other
  misc_feature (453)..(468): n is a, c, g, or t
tcagtacgagtatgcacgaccggtgctcgatttagtacacacacttagggattgggggctttgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctcctgaccatctctgggctccaggctgaggacgaggctgattattactgcagctcatatacaagcaccagcactctctatgtcttcggaactgggaccaaggtcaccgtctaggtcacgcccaaggcccaacccnctgtccactctcgttccccaccctcctccatacctcgtactgacgcgggctggcaaggcncatagnnnnnnnnnnnnnnnn

SEQ ID NO: 198135 - DNA, 504 bp, Homo sapiens
  misc_feature: GYAE6OF01CIZ8M.18.59.F04.1.454.CMB.1.raw
  modified_base (303)..(303): a, c, t, g, unknown or other
  misc_feature (303)..(303): n is a, c, g, or t
  modified_base (503)..(503): a, c, t, g, unknown or other
  misc_feature (503)..(503): n is a, c, g, or t
tcagtacgagtatgcacgaccggtgctcgatttagtacacacacttagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaatcatgatttangatgtcactaatcggccctcgaggggtttctaatcgcttctctggctccaagtctggcaacacggcctccctgaccatctctggctccgagctgaggacgaggctgattatactgcagctcatatacaagcaccagcactctctatcgtcttcggaacttgggaccaaggtcaccgtcaggtcagcccaagcccaacccnc

SEQ ID NO: 198136 - DNA, 499 bp, Homo sapiens
  misc_feature: GYAE6OF01DC0FO.18.59.F04.1.454.CMB.1.raw
  modified_base (411)..(411): a, c, t, g, unknown or other
  misc_feature (411)..(411): n is a, c, g, or t
  modified_base (418)..(418): a, c, t, g, unknown or other
  misc_feature (418)..(418): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgcccttactcagcctgcctccgtgtctgggtctcctggacagtcgatcaccatctcctgcactggaaccagcagtgacgttggtggttataactatgtctcctggtaccaacagcacccaggcaaagccccaaatcatgatttatgatgtcagtaatcggcctcgagggtttctaatcgcttctctgctcaagtctggcaacacggcctccctgaccatctctggctcaggctgagacgagctgattattacngcagctnatatacaagcagcagcactcaagtcttcgactggaaccaggtcacgtcaggtcacgcccaacggacccaaccctgtgtacc

SEQ ID NO: 198137 - DNA, 501 bp, Homo sapiens
  misc_feature: GYAE6OF01BLUZZ.18.59.F04.1.454.CMB.1.raw
  modified_base (496)..(501): a, c, t, g, unknown or other
  misc_feature (496)..(501): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtctaggtcacgcccaaggcccaacccactgtccactctcgttccccgccctcctccatactcgtactgacgcgggctggcaaggcgcatcnnnnnn

SEQ ID NO: 198138 - DNA, 569 bp, Homo sapiens
  misc_feature: GYAE6OF01BBWKK.18.59.F04.1.454.CMB.1.raw
  modified_base (237)..(237): a, c, t, g, unknown or other
  misc_feature (237)..(237): n is a, c, g, or t
  modified_base (561)..(561): a, c, t, g, unknown or other
  misc_feature (561)..(561): n is a, c, g, or t
  modified_base (568)..(568): a, c, t, g, unknown or other
  misc_feature (568)..(568): n is a, c, g, or t
tcagtacgagtatgcacgaccggtgctcgatttagtacacacacttaagggattagggggctttgcctgggtcctggcccagtctgccctgactcagcctgcctccgtggtctcgggtctcctggacagtcggatcaccatctcctgcactggaaccagcagtgacgttggtggttataactatgtctcctggtaccaacacgccacccaggcaaagcccccaaactcatgatttangatgtcactaatcggccctcaggggtttcaatcgctttctctggtcttacctaagtctggcaacacggccctccgtgaccactactctgggctccgagctgagacgaggctgattatactgcagtctacgtatatacaaagctacagcacgtctactattcgttcgttacgtaactgggaacctaacggtacctaaccgtaccttaacggtacacgacccaacggtcccaacccctactcgtaccactctacgtccccacccttccctccactacctccgtactcggacgtcgggacctggacctaacggcgaccaagtacggntagctgnc

SEQ ID NO: 198139 - DNA, 510 bp, Homo sapiens
  misc_feature: GYAE6OF01BEFNV.18.59.F04.1.454.CMB.1.raw
  modified_base (298)..(298): a, c, t, g, unknown or other
  misc_feature (298)..(298): n is a, c, g, or t
  modified_base (505)..(510): a, c, t, g, unknown or other
  misc_feature (505)..(510): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagccccaaactcatgatttatgatgtcactaatcggccctcaggggtttctaatcgcttctctggctcaagtctggcacacggcctccngaccatctctgggctccaggctgaggacgaggctgattatactgcagctcatatacaagcaccagcactctctatgtcttcggaactgggaaccaaggtccaccgtcctaggtcacgcccaacggcccaacccatcgccactcctcgttccccacctcctaccactacctcgtactcgaggccggctggcaacgggccacgatacgnnnnnn

SEQ ID NO: 198140 - DNA, 670 bp, Homo sapiens
  misc_feature: GYAE6OF01BYBDH.18.59.F04.1.454.CMB.1.raw
  modified_base (201)..(201): a, c, t, g, unknown or other
  misc_feature (201)..(201): n is a, c, g, or t
tcagtacgagtatgcacgaccggtgctcgatttagtacacacacttagggagttggggggggtctcaggaggcagcgctctcgggacgtctccaccatggcctgggctctgctattcctcaccctcctcactcagggcacagggtcctgggcccagtctgccctgactcagcctgccctcgtgtcgtggtctcgtggacgngtcgatcacatcctctgctacgtacggaaccagcgtagtcgtacggttggtagttaactaactgttcgtcctccgttacggtaaccaacacgtacccaaccgaggaaccaaacccggaccccctaaaactcctagtgtaatttagcgtagtcgtactaacgttaacgtccgtccctacggttacgggttactaagtccgtcttctacgtcggtcctaccgtagtcgtggacaacgccgcccgtcctacgacctacgttcctcggtcggtcctaccgacggtcgtaggaacggtacgacgtctagtatttacgtcgtgacagtctactaagtacaacgacgtaccgaacgacgcctacctcttacgttagttcgttaccggtacggtaacggttcgggtaaccgttacgggtccctacccggttacgtaacggtacctaaccgtacccgtaacggcccctaaacccgtcg

SEQ ID NO: 198141 - DNA, 325 bp, Homo sapiens
  misc_feature: GYAE6OF01AY6HN.18.59.F04.1.454.CMB.1.raw
  modified_base (318)..(325): a, c, t, g, unknown or other
  misc_feature (318)..(325): n is a, c, g, or t
tcagtacgagtatgcacgaccggtgctcgatttagtacacacacttagggattggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaacatcggaagtcagcccaaggctgccccctggtcactctgttcccgccctcctccatacctcgtactgagcgggctggcaaggcgcatagnnnnnnnn

SEQ ID NO: 198142 - DNA, 508 bp, Homo sapiens
  misc_feature: GYAE6OF01DYOF8.18.59.F04.1.454.CMB.1.raw
  modified_base (434)..(434): a, c, t, g, unknown or other
  misc_feature (434)..(434): n is a, c, g, or t
  modified_base (503)..(508): a, c, t, g, unknown or other
  misc_feature (503)..(508): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcacagcactctctatgtcttcggactgggaccaaggtccaccgtcctaggtcacgcccaacggcccaaccccnctcgtccactcctcgttccccgcccttccctccatcctcgtactgacgcgggctggcaggcgcatacgnnnnnn

SEQ ID NO: 198143 - DNA, 504 bp, Homo sapiens
  misc_feature: GYAE6OF01D3KMF.18.59.F04.1.454.CMB.1.raw
  modified_base (205)..(205): a, c, t, g, unknown or other
  misc_feature (205)..(205): n is a, c, g, or t
  modified_base (260)..(260): a, c, t, g, unknown or other
  misc_feature (260)..(260): n is a, c, g, or t
  modified_base (436)..(436): a, c, t, g, unknown or other
  misc_feature (436)..(436): n is a, c, g, or t
  modified_base (496)..(496): a, c, t, g, unknown or other
  misc_feature (496)..(496): n is a, c, g, or t
  modified_base (501)..(502): a, c, t, g, unknown or other
  misc_feature (501)..(502): n is a, c, g, or t
  modified_base (504)..(504): a, c, t, g, unknown or other
  misc_feature (504)..(504): n is a, c, g, or t
tcagtacgagtatgcacgaccggtgctcgatttagtacacacacttagggattggggagagagacccctcccctgggatcctgggcccagtctgccctgactcagcctgcctccgtgtctgggtctcctggacagtcgatcaccatctcctgcactggaaccagcagtgacgttggtggttataactatgtctcctggtaccaanagcacccaggcaaaagcccccaaatcatgatttatgatgtcactaatcggccctnaggggtttctaatcgcttctctggctccaagtctggcaacacggcctccctgaccatctctgggctccaggctgaggacgaggctgattatactgcagctcatatacaagcaaccagcactctctatgtcttcggaactgggaccaggtcaccgtctagtcagccaagccaacccntcgtctactctcgttcccaccctcctccatcctcgtactgaggcggtctggcaaggccanatagnngn

SEQ ID NO: 198144 - DNA, 551 bp, Homo sapiens
  misc_feature: GYAE6OF01BKAJ1.18.59.F04.1.454.CMB.1.raw
  modified_base (296)..(296): a, c, t, g, unknown or other
  misc_feature (296)..(296): n is a, c, g, or t
  modified_base (544)..(544): a, c, t, g, unknown or other
  misc_feature (544)..(544): n is a, c, g, or t
  modified_base (546)..(546): a, c, t, g, unknown or other
  misc_feature (546)..(546): n is a, c, g, or t
  modified_base (548)..(549): a, c, t, g, unknown or other
  misc_feature (548)..(549): n is a, c, g, or t
  modified_base (551)..(551): a, c, t, g, unknown or other
  misc_feature (551)..(551): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgcccccaaaactcatgattttatgatgtcactaatcggccctcgaggggtttcaatcgcttctctggctccaagtctggccaacncggccctccctgaccatctcgtgggctccgaggctggaggacgaggctgtattattactgcagctcaatactacaagcaaccagcactctactatcgtcttacggaactgggaaccaggtccaccgtctaggtcacgtcccaagcccaacccatcgtcacttccgttcgtcccccgcctcctacccattaccctcgtaacctcggaacggtcccgggtcttacggaccgacgggtcccgatagtacgnancnngn

SEQ ID NO: 198145 - DNA, 505 bp, Homo sapiens
  misc_feature: GYAE6OF01CRIEI.18.59.F04.1.454.CMB.1.raw
  modified_base (241)..(241): a, c, t, g, unknown or other
  misc_feature (241)..(241): n is a, c, g, or t
  modified_base (418)..(418): a, c, t, g, unknown or other
  misc_feature (418)..(418): n is a, c, g, or t
tcagtacgagtatgcacgaccggtgctcgatttagtacacacacttagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggnggttataactatgtctcctggtaccaacagcacccaggcaaagcccccaaaatcatgatttatgatgtcactaatcggccctcaggggtttctaatcgcttctctggctccaagtctggcaacacggcctcctgaccatctcgtgggctccaggctgaggacgaggctgattatacngcagctcatatacagcacagcactctctatcgtcttggaactgggaccaaggtcaccgtctagtcacgcccaaggcccaacccgtac

SEQ ID NO: 198146 - DNA, 512 bp, Homo sapiens
  misc_feature: GYAE6OF01BI7H5.18.59.F04.1.454.CMB.1.raw
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttatactatgtctcctggtaccaacagcaccaggcaaagcccccaaactcatgatttatgatgtcagtaatcggccctctagggtttctaagtcgcttctctggctcaagtctgcaacacgcctcctgaccatctctggctccgaggctgaggacgaggtctgtattagttactgcagctcatatacaagcaccagcactctctatcgtcttacggactgggaccaaggtccaccgttccaggtcacgacccaacgcccacccgtacg

SEQ ID NO: 198147 - DNA, 551 bp, Homo sapiens
  misc_feature: GYAE6OF01DRS1T.18.59.F04.1.454.CMB.1.raw
tcagtacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccggggggtcccttagactcccctgtacagcctctggattcactttcagtaaggcctggatgaactgggtccgcaggctccgagggaaggggctggagtgggttggccgtataaaaccaaaactgatggtagggacaacagactacgctgcaccgtgaaaggcagattcacatcacaagagatgaattacaaaaagcaacgctgtatctgacaaatgaacagcctagagaaaccgagaacacagccgtgtattactgtaacccacactccccagaaacgcgtacaactaactactaactacgtatggacctcgtgggaccg

SEQ ID NO: 198148 - DNA, 320 bp, Homo sapiens
  misc_feature: GYAE6OF01EDKLK.18.59.F04.1.454.CMB.1.raw
  modified_base (190)..(190): a, c, t, g, unknown or other
  misc_feature (190)..(190): n is a, c, g, or t
  modified_base (228)..(228): a, c, t, g, unknown or other
  misc_feature (228)..(228): n is a, c, g, or t
  modified_base (315)..(320): a, c, t, g, unknown or other
  misc_feature (315)..(320): n is a, c, g, or t
tcagtacgagtatgcacgaccggtgctcgatttagtacacacacttagggattggggagagaagacaggattcaggacaatctccagcatggccggcttccctctcctcctcaccctcctcactcactgtgcagggtcctgggcccagtctgtgctgactcagccaccctcagcgtctgggacccccggnagagggtcaccatctcttgttctggaagcagctccaantcggaagtcagcccaaggctgccccctggtcactctgttcccaccctcctccatactcgtactgagcgggctggcaaggcgcatagnnnnnn

SEQ ID NO: 198149 - DNA, 519 bp, Homo sapiens
  misc_feature: GYAE6OF01B2VAW.18.59.F04.1.454.CMB.1.raw
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcgccctcagggtttctaatcgcttctctggctccaagtctggcaacacggcctcctgaccatctctcgggctccaggctgaggacgaggctgattattactgcagctcatatacagccacagcactctctatgtcttacggaacgtcgggaacctaaggtccaccgtcctaggtccacgacccaacggcccaaccccgtacg

SEQ ID NO: 198150 - DNA, 514 bp, Homo sapiens
  misc_feature: GYAE6OF01DMC8A.18.59.F04.1.454.CMB.1.raw
  modified_base (304)..(304): a, c, t, g, unknown or other
  misc_feature (304)..(304): n is a, c, g, or t
  modified_base (423)..(423): a, c, t, g, unknown or other
  misc_feature (423)..(423): n is a, c, g, or t
tcagtacgagtatgcacgaccggtgctcgatttagtacacacacttagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcaccaggcaaaagcccccaaactcatgatttangatgtcataatcgcctgagggtttctaatcgcttctctggctccaagtctggcaacacggcctccctgacctatcctcgtgggcctccgaggctggacggacgaggctagattattacngctagctacatatacaacgcaacagcactctctatgtcttggaactgggaaccaggtccaccgtcaggtcacgcccaagcccaaccctacg

SEQ ID NO: 198151 - DNA, 326 bp, Homo sapiens
  misc_feature: GYAE6OF01BJ483.18.59.F04.1.454.CMB.1.raw
  modified_base (312)..(312): a, c, t, g, unknown or other
  misc_feature (312)..(312): n is a, c, g, or t
  modified_base (318)..(326): a, c, t, g, unknown or other
  misc_feature (318)..(326): n is a, c, g, or t
tcagtacgagtatgcacgaccggtgctcgatttagtacacacacttagggattggggagagaagacaggattcaggacaatctccagcatggccggcttccctctcctcctcaccctcctcactcactgtgcagggtcctgggcccagtctgtgctgactcagccaccctcagcgtctgggacccccgggcagagggtccaccatctcttgttctggaagcagctccaacatcggaagtcagcccaaggctcgcccctggtcactctcgttcccaccctcctccatactcgtactgagcggctggcaaggcncatagnnnnnnnnn

SEQ ID NO: 198152 - DNA, 557 bp, Homo sapiens
  misc_feature: GYAE6OF01BL3GP.18.59.F04.1.454.CMB.1.raw
  modified_base (414)..(414): a, c, t, g, unknown or other
  misc_feature (414)..(414): n is a, c, g, or t
tcagtacgagtatgcacgaccggtgctcgatttagtacacacacttagggattggggagctctgggagaggagccccagccttgggattcccaagtgttttcattcagtgatcaggactgaacacagaggactcaccatggagtttgggctgagcggtgtagtttcctaggctgacttagtttaaaggtgtccagtgtgaggtgcagctggtggagtctgggggaggcttggtaaaggccggggggtcccttagactcccctgtacagcctctggattcactttcagtaaggcctggatgaactgggtccgccaggctccgagggagggctggagtgggtggccgtataaaccaaactgatggtggacaacagactacgctgcaccgtgaaaggcagatcaccatctacaaganatgattacaaaagcacgctgtatctagacaatgaacagctagagaaccgaggacacgagccgtagtattactacgttaccactactccccgtagaaacgtcgtacaacctactactactaacgttactcggtaccgtaccggg

SEQ ID NO: 198153 - DNA, 508 bp, Homo sapiens
  misc_feature: GYAE6OF01EW8QV.18.59.F04.1.454.CMB.1.raw
  modified_base (371)..(371): a, c, t, g, unknown or other
  misc_feature (371)..(371): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgtttggtggttataactatgtctcctggtaccaacagcacccaggcaaaagcccccaaatcatgatttatgatgtcactaatcggccctcgaggggtttctaatcgcttctctggctccaagtctggcaacncggcctccctgaccatctctgggctccaggctgaggacgaggctgatttattactgcagctcatatacaagcaccgagcactctctatgttcgttcggaatgggaccaagtccaccgtctagcacgcccaaggcccc

SEQ ID NO: 198154 - DNA, 328 bp, Homo sapiens
  misc_feature: GYAE6OF01AQIU8.18.59.F04.1.454.CMB.1.raw
  modified_base (324)..(328): a, c, t, g, unknown or other
  misc_feature (324)..(328): n is a, c, g, or t
tcagtacgagtatgcacgaccggtgctcgatttagtacacacacttagggattggggagagaagacaggattcaggacaatctccagcatggccggcttccctctcctcctcaccctcctcactcactgtgcagggtcctgggcccagtctgtgctgactcagccaccctcagcgtctcgggacccccgggcagagggtcaccatctcttgttctggaagcagctccaacatcggaagtcagcccaaggctcgccccctcggtcactcctcgttcccaccctcctccatacctcgtactgacgcgggctggcaaggcgcatagnnnnn

SEQ ID NO: 198155 - DNA, 322 bp, Homo sapiens
  misc_feature: GYAE6OF01DI7N7.18.59.F04.1.454.CMB.1.raw
  modified_base (311)..(311): a, c, t, g, unknown or other
  misc_feature (311)..(311): n is a, c, g, or t
  modified_base (317)..(322): a, c, t, g, unknown or other
  misc_feature (317)..(322): n is a, c, g, or t
tcagtacgagtatgcacgaccggtgctcgatttagtacacacacttagggattggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaacatcggaagtcagcccaaggctgccccctggtcactctgttcccgcctcctcatactcgtactgagcgggctggcaagggcncatagnnnnnn

SEQ ID NO: 198156 - DNA, 669 bp, Homo sapiens
  misc_feature: GYAE6OF01BIMGC.18.59.F04.1.454.CMB.1.raw
  modified_base (228)..(228): a, c, t, g, unknown or other
  misc_feature (228)..(228): n is a, c, g, or t
  modified_base (252)..(252): a, c, t, g, unknown or other
  misc_feature (252)..(252): n is a, c, g, or t
  modified_base (303)..(303): a, c, t, g, unknown or other
  misc_feature (303)..(303): n is a, c, g, or t
  modified_base (363)..(363): a, c, t, g, unknown or other
  misc_feature (363)..(363): n is a, c, g, or t
  modified_base (379)..(379): a, c, t, g, unknown or other
  misc_feature (379)..(379): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataactntgtctcctggtaccaacagcaccaggcaaacgcccccaaatcatgatttangatgtcactaatcggccctcgtaggggtttactaatcgtctttctctcggctaccagtcnggcaacacggcctccngaccatctcgtggcctccgaggctggacgggacgagggtctaggtaatttaacgttacgtgaccgtagtccttacgtaattaacgtaaccaagacccaacccgacgtacctaaccttaccttaccgttaacgttcggttacccgtttaacccggggtaaaccgttccgggggaaacccgttaaacggggttaccccgtaacccccgggtttacccggttaaaccggggttacccaacccggtaacccccggtaaaacccgggtacccccaaaaccccccggttaacccgg

SEQ ID NO: 198157 - DNA, 525 bp, Homo sapiens
  misc_feature: GYAE6OF01EKUE5.18.59.F04.1.454.CMB.1.raw
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcaccaggcaaacgcccccaaactcatgatttatgatgtcactaatcggccctgagggtttctaatcgcttctctggctccaagtctggcaacacggcctcctgaccatctcgtggctccgagctagagacgaggctgattattactgcagctacatatacaagcaccagcactctactatcgtaccttacggaacgtcgggaacctaaggtccaccgtccgtacggtcacgacccgaacgcccaacccctacg

SEQ ID NO: 198158 - DNA, 517 bp, Homo sapiens
  misc_feature: GYAE6OF01CKTA8.18.59.F04.1.454.CMB.1.raw
  modified_base (508)..(508): a, c, t, g, unknown or other
  misc_feature (508)..(508): n is a, c, g, or t
  modified_base (514)..(517): a, c, t, g, unknown or other
  misc_feature (514)..(517): n is a, c, g, or t
tcagtacgagtatgcacgaccggtgctcgatttagtacacacacttagggattggggagagagacccctcccctgggatcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagccccaaatcatgatttatgatgtcagtaatcggccctcaggggttttctaatcgcttctctggctccaagtctggcaacacggcctccctgaccatctctgggctccaggctgaggacgaggctgattattactgcagctcatatacaagcacagcactctctatgtctttcggaactgggaccaaggtcaccgtcctaggtcagcccaaaggccaaccccgactgtccactctcgttccccgcccttccccaatacctcgtaactgacgcgggctggaccaagggcncatagnnnn

SEQ ID NO: 198159 - DNA, 492 bp, Homo sapiens
  misc_feature: GYAE6OF01ECFYR.18.59.F04.1.454.CMB.1.raw
  modified_base (422)..(422): a, c, t, g, unknown or other
  misc_feature (422)..(422): n is a, c, g, or t
  modified_base (484)..(492): a, c, t, g, unknown or other
  misc_feature (484)..(492): n is a, c, g, or t
tcagtacgagtatgcacgaccggtgctcgatttagtacacacacttagggattgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaaagcccccaaactcatgatttatgatgtcagtaatcggccctcaggggtttctaatcgcttctctggctccaagtctggcaacacggcctccctgaccatctctgggctccaggctgaggacgaggctgattatactgcagctcatatacaagcagcagcactcaagtcttcggaactgggaccaaggtcaccgtctaggtcagcccaaggccaaccccntcgtcactctcgttcccgccctcctccatacctcgtactgacgcgggctggcaggcgcatgnnnnnnnnn

SEQ ID NO: 198160 - DNA, 555 bp, Homo sapiens
  misc_feature: GYAE6OF01EWWFE.18.59.F04.1.454.CMB.1.raw
  modified_base (519)..(519): a, c, t, g, unknown or other
  misc_feature (519)..(519): n is a, c, g, or t
tcagtacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggattttccttgctgctatttaaaaggtgtccagtgtgaggtgcagctggtggagtctgggggaggcttggtaaagccgggggggtcccttagactcccctgtacagcctctggattcactttcagtaaggcctggatgaactgggtccgccaggctccgagggaaggggctgggagtgggtggccgtattaaaaccaaaactgatggtagggacaacagactacgctgcacccgtgaaaggcagatcaccatctcaagagatgattacaaaaagcaacgactgtatctgacaaatgaacagacctgaagaaccgaggaaccacgacgccgtagtattactagtaccacactcccctagaacncgtacaactactaactactaacgtactggcctacgg

SEQ ID NO: 198161 - DNA, 510 bp, Homo sapiens
  misc_feature: GYAE6OF01BNEMU.18.59.F04.1.454.CMB.1.raw
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactccatgatttatgatgtcactaatcggccctcaggggtttctaatcgcttctctggctccaagtctggcaacacggcctccctgaccatctctgggctcaggctgaggacgaggctgattatactgcagctcatatacaagcacagcactctctatgttctcggaactgggacccaaggtccaccgttcctaggtccagtcccgaaggacccc

SEQ ID NO: 198162 - DNA, 545 bp, Homo sapiens
  misc_feature: GYAE6OF01B5JPU.18.59.F04.1.454.CMB.1.raw
  modified_base (229)..(229): a, c, t, g, unknown or other
  misc_feature (229)..(229): n is a, c, g, or t
  modified_base (243)..(243): a, c, t, g, unknown or other
  misc_feature (243)..(243): n is a, c, g, or t
  modified_base (253)..(253): a, c, t, g, unknown or other
  misc_feature (253)..(253): n is a, c, g, or t
  modified_base (303)..(303): a, c, t, g, unknown or other
  misc_feature (303)..(303): n is a, c, g, or t
tcagtacgagtatgcacgaccggtgctcgatttagtacacacacttagggagttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggngttataactntgtctcctggtaccaacagcaccaggcaaacgccccaaatcatgatttangatgtcactaactcgcctcgtagggtttctaatcgtcttctctggtctccaagtctcggtcaacgaccggccctccgtacgaccctatctcgtcgggtcctccgaggtctaggaggacgaggctagtattattactgcagctcatataacagacaccagcactctctagtcgtcgttacggaacgtcgggaccaacggtccaccgtccgtacggtcacgaccctaacggcccaacccgtacg

SEQ ID NO: 198163 - DNA, 550 bp, Homo sapiens
  misc_feature: GYAE6OF01DIGBO.18.59.F04.1.454.CMB.1.raw
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcctggtaccaacagcaccaggcaaacgcccccaaactcatgatttatgatgtcactaatccggccctcgtacggggtttctaacgtcgtcctttctctggtctccaagtctggacaacgacgccctcctgaccatctctcgggctccgaggctagaggacgaggctgatttatactgcagtctcatataaccaagctaaccagctactctacttatcgttccttacggaacgttgggacccaaggtcccaccgttcctaggtaccacgaccccaacggccccaaccccgtacg

SEQ ID NO: 198164 - DNA, 513 bp, Homo sapiens
  misc_feature: GYAE6OF01AWCSA.18.59.F04.1.454.CMB.1.raw
  modified_base (252)..(252): a, c, t, g, unknown or other
  misc_feature (252)..(252): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactntgtctcctggtaccaacagcaccaggcaaacgcccccaaaactcatgatttatgatgtcactaatcggcctcgagggtttctaatcgcttctctggctcaagtctggcaacacggcctcctgaccatctctgggctccaggcctgaggcgagctgattattactgcagctacatatacagcaccagcactctctatgtacttcggaacgtcgggaccaggtccaccgtcctagggtcacgacccaaggccccaaccctacg

SEQ ID NO: 198165 - DNA, 630 bp, Homo sapiens
  misc_feature: GYAE6OF01EPFVF.18.59.F04.1.454.CMB.1.raw
tcagtacgagtatgcacgaccggtgctcgattttagtacacacactttagggtagttgggggctttgtctagggtctcctggacagtcgatcaccatctcctgcactggaaccagtcgtagtgacgttggtggttataacgttatgtcctcctgggtaccaactagcacccaggcaaagccccaaactcatgtatttatgatgtcagtaatcggaccctcagggtttctaatcgcttctctggctccaagtctggcaacacggtcctcctgaccatctacgtgggcctccgaggctgacggacgacggctgtattatactgcacgtcctcattactacgaagtccagcagcacgtcaagtcttacggaacgtgggaaccaaggtcctaccgtcctacggtccacgacccaaacggcccaaaccccgtgtacgtaccaaccgttacttaccggtttcccccgacccttcctacctaactttaccttccgttacttcgacggtccgggtacttacgggacctaaacgggtccgtaacgtaacgttacggactacgtaccgtacgacgtaacggctacgtacgtagacgtaagtaaccgtacgtcgtcgtacgacgtacacactctcgtcgtc

SEQ ID NO: 198166 - DNA, 499 bp, Homo sapiens
  misc_feature: GYAE6OF01CO2CK.18.59.F04.1.454.CMB.1.raw
  modified_base (451)..(451): a, c, t, g, unknown or other
  misc_feature (451)..(451): n is a, c, g, or t
  modified_base (464)..(464): a, c, t, g, unknown or other
  misc_feature (464)..(464): n is a, c, g, or t
  modified_base (470)..(470): a, c, t, g, unknown or other
  misc_feature (470)..(470): n is a, c, g, or t
  modified_base (472)..(472): a, c, t, g, unknown or other
  misc_feature (472)..(472): n is a, c, g, or t
  modified_base (494)..(499): a, c, t, g, unknown or other
  misc_feature (494)..(499): n is a, c, g, or t
tcagtacgagtatgcacgaccggtgctcgatttagtacacacacttagggagttgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcaccaggcaaagcccccaaatcatgatttatgatgtcactaatcggcctcaggggtttctaatcgcttctctggcttccaagtctggcaacacggcctcccctgaccatctctgggctccaggctggaggacgaggctgattattactgcagctcatatacaagcaccagcactctctatgtcttggactgggacaaggtccacgtccaggtcacgcccaacggccaacccactgtaccactcctcgtcccnccctctcccatcncgtacngngccgggctggcaggcgcagtannnnnn

SEQ ID NO: 198167 - DNA, 512 bp, Homo sapiens
  misc_feature: GYAE6OF01DNQ63.18.59.F04.1.454.CMB.1.raw
  modified_base (345)..(345): a, c, t, g, unknown or other
  misc_feature (345)..(345): n is a, c, g, or t
  modified_base (480)..(480): a, c, t, g, unknown or other
  misc_feature (480)..(480): n is a, c, g, or t
  modified_base (500)..(500): a, c, t, g, unknown or other
  misc_feature (500)..(500): n is a, c, g, or t
  modified_base (507)..(512): a, c, t, g, unknown or other
  misc_feature (507)..(512): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctgaggggttctaatcgcttctctggctccaagtctggcaacacggcctccctgaccatctctgggctccaggctgaggacgaggctgactattacngccagtcctatgacatgaggctgagttggttcgtatgtcttcggatcgtgggacaaggtcaccgtctaagtcagacccaaggcccaacccatcgtacactctccgttccccgccctcctaccattacctcgtacngagccgggctggacaggccnagtacgnnnnnn

SEQ ID NO: 198168 - DNA, 525 bp, Homo sapiens
  misc_feature: GYAE6OF01A7XSL.18.59.F04.1.454.CMB.1.raw
  modified_base (516)..(516): a, c, t, g, unknown or other
  misc_feature (516)..(516): n is a, c, g, or t
  modified_base (519)..(520): a, c, t, g, unknown or other
  misc_feature (519)..(520): n is a, c, g, or t
  modified_base (522)..(522): a, c, t, g, unknown or other
  misc_feature (522)..(522): n is a, c, g, or t
  modified_base (524)..(525): a, c, t, g, unknown or other
  misc_feature (524)..(525): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggcctcaagtctggcaacacggcctccctgaccatctctgggctccaggctgaggacgagctgattatactgcagctcatatacaagcagcagcactcaagtcttcggaactgggacccaaggtcaccgtctgggtcacgcccaaggcccaacccactcgtccactccttccgttccccgcccttccctcctactacctccgtactgacggccgggtcgtcggaccaagggccgacagtacgnacnncngnn

SEQ ID NO: 198169 - DNA, 499 bp, Homo sapiens
  misc_feature: GYAE6OF01EI9C8.18.59.F04.1.454.CMB.1.raw
  modified_base (490)..(490): a, c, t, g, unknown or other
  misc_feature (490)..(490): n is a, c, g, or t
  modified_base (495)..(499): a, c, t, g, unknown or other
  misc_feature (495)..(499): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaaccccactcgtcactctcgttcccaccctcctccatacctcgtactgagcgggctggcaggcgnatagnnnnn

SEQ ID NO: 198170 - DNA, 507 bp, Homo sapiens
  misc_feature: GYAE6OF01AP5SZ.18.59.F04.1.454.CMB.1.raw
  modified_base (252)..(252): a, c, t, g, unknown or other
  misc_feature (252)..(252): n is a, c, g, or t
  modified_base (378)..(378): a, c, t, g, unknown or other
  misc_feature (378)..(378): n is a, c, g, or t
  modified_base (434)..(434): a, c, t, g, unknown or other
  misc_feature (434)..(434): n is a, c, g, or t
  modified_base (446)..(446): a, c, t, g, unknown or other
  misc_feature (446)..(446): n is a, c, g, or t
  modified_base (468)..(468): a, c, t, g, unknown or other
  misc_feature (468)..(468): n is a, c, g, or t
  modified_base (501)..(501): a, c, t, g, unknown or other
  misc_feature (501)..(501): n is a, c, g, or t
  modified_base (503)..(506): a, c, t, g, unknown or other
  misc_feature (503)..(506): n is a, c, g, or t
tcagtacgagtatgcacgaccggtgctcgatttagtacacacactttaggggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaatcatgatttatgatgtcagtaatcggccctnaggggttttcaatcgcttctctggctccaagtctggcaacacggccctccctgaccatctctgggctccgaggctgaggacgaggctgattacttactgcagctcatatacaagcacagcactctntatcgttctcggaactggaccaaggtcacgtctagtcacgacccacgcccaacccntcgtcacttccncgttccccacctctcacttacncgtatcgagcgggtctggacaggcacagtacgnannnnc

SEQ ID NO: 198171 - DNA, 458 bp, Homo sapiens
  misc_feature: GYAE6OF01ASXNF.18.59.F04.1.454.CMB.1.raw
  modified_base (381)..(381): a, c, t, g, unknown or other
  misc_feature (381)..(381): n is a, c, g, or t
  modified_base (444)..(458): a, c, t, g, unknown or other
  misc_feature (444)..(458): n is a, c, g, or t
tcagtacgagtatgcacgaccggtgctcgatttagtacacacacttagggattgggggctttgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcacagcactctctatgtctcggactgggaccaggtcacgtctagcacgcccaaggcccaacccntcgtcactctcgtcccgccctcctccactactcgtactgacgcggctggcgaaggcgcatagnnnnnnnnnnnnnnn

SEQ ID NO: 198172 - DNA, 509 bp, Homo sapiens
  misc_feature: GYAE6OF01D2CNR.18.59.F04.1.454.CMB.1.raw
  modified_base (228)..(228): a, c, t, g, unknown or other
  misc_feature (228)..(228): n is a, c, g, or t
  modified_base (305)..(305): a, c, t, g, unknown or other
  misc_feature (305)..(305): n is a, c, g, or t
  modified_base (421)..(421): a, c, t, g, unknown or other
  misc_feature (421)..(421): n is a, c, g, or t
  modified_base (428)..(428): a, c, t, g, unknown or other
  misc_feature (428)..(428): n is a, c, g, or t
  modified_base (505)..(505): a, c, t, g, unknown or other
  misc_feature (505)..(505): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtggttataactatgtctcctggtaccaacagcacccaggcaaagcccccaaactcatgatttangatgtcactaatcggccctgagggtttctaatcgcttctctggctccaagtctggcaacacggcctccctgaccattctctgggcctccgaggctgaggacgaggctgatttatcngcagctnataatacaagcagcagcactcaagtctacggaactggaaccaggtccaccgtcagtcacgacccaagcccaacccgntacg

SEQ ID NO: 198173 - DNA, 552 bp, Homo sapiens
  misc_feature: GYAE6OF01DW0D6.18.59.F04.1.454.CMB.1.raw
  modified_base (240)..(240): a, c, t, g, unknown or other
  misc_feature (240)..(240): n is a, c, g, or t
  modified_base (387)..(387): a, c, t, g, unknown or other
  misc_feature (387)..(387): n is a, c, g, or t
tcagtacgagtatgcacgaccggtgctcgatttagtacacacacttagggattgggggggtctcaggaggcagcgctctcgggacgtctccaccatggcctggctctgctattcctcaccctcctcactcagggcacagggtcctgggcccagtctgccctgactcagcctgcctccgtgtctgggtctcctggacagtcgatcaccatctcctgcactggaaccagcagtgacgttggnggttataactatgtctcctggtaccaacagcacccaggcaaagcccccaaaatcatgatttatgatgtcactaatcgccctcagggtttctaatcgctttctctggctccgtaaagtctggcaaacacggccctcctgaccatctcngggctcaggctgaggacgaggctgatttatactgcagctcaatataacaagcaaccagcaactctctagtcgttccttacggaacgttcgggaacctaaacgggtccaacccggtaccgtaacggttccaacggaccccaaacgggacccaaaccccccgtaacg

SEQ ID NO: 198174 - DNA, 527 bp, Homo sapiens
  misc_feature: GYAE6OF01CVSHZ.18.59.F04.1.454.CMB.1.raw
  modified_base (251)..(251): a, c, t, g, unknown or other
  misc_feature (251)..(251): n is a, c, g, or t
tcagtacgagtatgcacgaccggtgctcgatttagtacacacacttagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactntgtctcctggtaccaacagcaccaggacaaacgcccccaaatcatgatttatgatgtcactaatcggccctcgagggtttctaatcgcttctctggctcaagtctggcaacacgcctcctgaccatctcgtgggctccgaggctggaggacgaggctagattatactgcagctcatatacaagccaccagcactctactatgtaccttacggaacgtcgggaacctaaggtccacccggtctacggtcaacgacccaacggcccaaaccccgtacg

SEQ ID NO: 198175 - DNA, 543 bp, Homo sapiens
  misc_feature: GYAE6OF01DRIQN.18.59.F04.1.454.CMB.1.raw
  modified_base (228)..(228): a, c, t, g, unknown or other
  misc_feature (228)..(228): n is a, c, g, or t
  modified_base (364)..(364): a, c, t, g, unknown or other
  misc_feature (364)..(364): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtggttataactatgtctcctggtaccaacagcacccaggcaaacgcccccaaatcatgatttatgatgtcactaatcggccctgagggtttctaatcgctttctctgctcaagtctggcaacncgccctccctgaccatcctcgtcgggctccgaggctagacggacgaggctgatttatactgacagctcaatatacaagccacagccactctactatcgtacgttcggaacttcgggaacctaacgggtccacccggttcctacggtccaacggaccccaaacggcccaaaccccgtacg

SEQ ID NO: 198176 - DNA, 528 bp, Homo sapiens
  misc_feature: GYAE6OF01AR2RN.18.59.F04.1.454.CMB.1.raw
  modified_base (301)..(301): a, c, t, g, unknown or other
  misc_feature (301)..(301): n is a, c, g, or t
  modified_base (370)..(370): a, c, t, g, unknown or other
  misc_feature (370)..(370): n is a, c, g, or t
  modified_base (462)..(462): a, c, t, g, unknown or other
  misc_feature (462)..(462): n is a, c, g, or t
  modified_base (493)..(493): a, c, t, g, unknown or other
  misc_feature (493)..(493): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggccaaaacgccccccaaaaccntgtatttatgatgtcactaatccggcctcgtagggtttctaatcgcttctctggctcagtctggcaacncggcctccctgaccatctcgtcgggcctccgaggctggacggacgaggctgtatttattactgcagctcatactacaagcacagccactctntatcgtcttacggaacgtggaccaaggtccnccgtctaggccacgacccaaggcccaaccctgtcg

SEQ ID NO: 198177 - DNA, 542 bp, Homo sapiens
  misc_feature: GYAE6OF01CGYG4.18.59.F04.1.454.CMB.1.raw
  modified_base (241)..(241): a, c, t, g, unknown or other
  misc_feature (241)..(241): n is a, c, g, or t
  modified_base (251)..(251): a, c, t, g, unknown or other
  misc_feature (251)..(251): n is a, c, g, or t
  modified_base (301)..(301): a, c, t, g, unknown or other
  misc_feature (301)..(301): n is a, c, g, or t
tcagtacgagtatgcacgaccggtgctcgatttagtacacacacttagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggngttataactntgtctcctggtaccaacagcaccaggcaaacgccccaaatcatgatttangatgtcactaatcgccctcgtagggtttctaatcgtcttctctggtctcaagtctcggacaacgacgcctcctgacctatctcgtggctccgaggctggacgacgagctagatttatactgcagctcaatactaacagccaacacgcactctactatcgtaccgttcggaacgtcggaaccaacggttccacccggttacctacgggtccaacgacccgaacggcccctaaaccccgtacg

SEQ ID NO: 198178 - DNA, 504 bp, Homo sapiens
  misc_feature: GYAE6OF01A3IJG.18.59.F04.1.454.CMB.1.raw
  modified_base (305)..(305): a, c, t, g, unknown or other
  misc_feature (305)..(305): n is a, c, g, or t
  modified_base (504)..(504): a, c, t, g, unknown or other
  misc_feature (504)..(504): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttangatgtcactaatcggccctcaggggtttctaatcgcttctctggctccaagtctggcaacacggcctccctgaccatctctcgggctccaggctgaggacgaggctgatttattactgcagctcatatacaagcaccagcactctctatgtcttcggaactgggacaggtcaccgtcctaggcagcccaagccaacccn

SEQ ID NO: 198179 - DNA, 521 bp, Homo sapiens
  misc_feature: GYAE6OF01C0CRT.18.59.F04.1.454.CMB.1.raw
  modified_base (227)..(227): a, c, t, g, unknown or other
  misc_feature (227)..(227): n is a, c, g, or t
  modified_base (241)..(241): a, c, t, g, unknown or other
  misc_feature (241)..(241): n is a, c, g, or t
  modified_base (251)..(251): a, c, t, g, unknown or other
  misc_feature (251)..(251): n is a, c, g, or t
  modified_base (397)..(397): a, c, t, g, unknown or other
  misc_feature (397)..(397): n is a, c, g, or t
  modified_base (512)..(512): a, c, t, g, unknown or other
  misc_feature (512)..(512): n is a, c, g, or t
tcagtacgagtatgcacgaccggtgctcgatttagtacacacacttagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggngttataactntgtctctggtacaacagcaccaggcaaacgcccccaaatcatgatttatgatgtacactaatcgccctcgtaggggtttctaatcgctttctctggctccaagtctggacaacgacggcctcctgaccatctcgtgggctccgggntggaggacgaggctagatttatactgcagctcatatacaagcagcagcactcaagtctacggaactgggaaccaaggtcacccggtctacggtcacgacccaaggacccaacccngtcgtaccc

SEQ ID NO: 198180 - DNA, 534 bp, Homo sapiens
  misc_feature: GYAE6OF01EGPKY.18.59.F04.1.454.CMB.1.raw
  modified_base (375)..(375): a, c, t, g, unknown or other
  misc_feature (375)..(375): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcctggtaccaacagcaccaggcaaacgcccccaaaatcatgatttatgatgtcactaatccggccctcgtaggggtttctaatcgcttctctggctcaagtctggcaacacgcctccngaccatctctgggctcgaggctggaggacgaggctagatttattactgcagctacatactaacaacgcaccagcactctctatgttcgtcggaacgtcgggaacctaacggtccaccggttccacgggtccaacgccccaaacggccccaacccctacg

SEQ ID NO: 198181 - DNA, 508 bp, Homo sapiens
  misc_feature: GYAE6OF01EVWC0.18.59.F04.1.454.CMB.1.raw
  modified_base (253)..(253): a, c, t, g, unknown or other
  misc_feature (253)..(253): n is a, c, g, or t
  modified_base (303)..(303): a, c, t, g, unknown or other
  misc_feature (303)..(303): n is a, c, g, or t
  modified_base (362)..(362): a, c, t, g, unknown or other
  misc_feature (362)..(362): n is a, c, g, or t
  modified_base (369)..(369): a, c, t, g, unknown or other
  misc_feature (369)..(369): n is a, c, g, or t
  modified_base (418)..(418): a, c, t, g, unknown or other
  misc_feature (418)..(418): n is a, c, g, or t
  modified_base (444)..(444): a, c, t, g, unknown or other
  misc_feature (444)..(444): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactntgtctcctggtaccaacagcaccaggcaaagcccccaaatcatgatttangatgtcactaatcggccctcgaggggtttctaatcgcttctctgctcaagtctggcacncgctccngaccatctctgggctccgaggctgaggacgaggctgatttattactgcngctgatatacaagccacagcactctntatcgtcttcggaactcgggaccaaggtcaccgtctaggtccagcccaaggccccaacctaccg

SEQ ID NO: 198182 - DNA, 518 bp, Homo sapiens
  misc_feature: GYAE6OF01AWY1H.18.59.F04.1.454.CMB.1.raw
  modified_base (253)..(253): a, c, t, g, unknown or other
  misc_feature (253)..(253): n is a, c, g, or t
  modified_base (512)..(512): a, c, t, g, unknown or other
  misc_feature (512)..(512): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttgggtgttataactntgtctcctggtaccaacagcacccaggcaaacgcccccaaaatcatgatttatgatgtcagtaatcggccctcgtaggggtttctaatcgtcttctctgctcaagtctggcacacgcctcctgaccatctcgtgggcctccgaggctggacggacgaggctagatttacttacgtgcagtctactatactaacagcagcagcactcagtctcggaacgtggaccaggtccacgtcgtagtcacgcccaaggcccaaccncgtacg

SEQ ID NO: 198183 - DNA, 505 bp, Homo sapiens
  misc_feature: GYAE6OF01EXS9J.18.59.F04.1.454.CMB.1.raw
  modified_base (306)..(306): a, c, t, g, unknown or other
  misc_feature (306)..(306): n is a, c, g, or t
  modified_base (325)..(325): a, c, t, g, unknown or other
  misc_feature (325)..(325): n is a, c, g, or t
  modified_base (419)..(419): a, c, t, g, unknown or other
  misc_feature (419)..(419): n is a, c, g, or t
  modified_base (426)..(426): a, c, t, g, unknown or other
  misc_feature (426)..(426): n is a, c, g, or t
  modified_base (453)..(453): a, c, t, g, unknown or other
  misc_feature (453)..(453): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgcccccaaaatcatgatttangatgtcactaatcggcctntagggtttctaatcgcttctctggctcaagtctggcaacacggcctcctgaccatctcgtgggctccgaggctgaggacgagctgattattacngcagctnatatacaagcaaccagcactctctatntctggaactgggaactaggtccacgtcaggtcagcccaaggcccaacccgtc

SEQ ID NO: 198184 - DNA, 499 bp, Homo sapiens
  misc_feature: GYAE6OF01EKYP7.18.59.F04.1.454.CMB.1.raw
  modified_base (427)..(427): a, c, t, g, unknown or other
  misc_feature (427)..(427): n is a, c, g, or t
  modified_base (493)..(493): a, c, t, g, unknown or other
  misc_feature (493)..(493): n is a, c, g, or t
  modified_base (495)..(499): a, c, t, g, unknown or other
  misc_feature (495)..(499): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcacgtctagtcagcccaaggcccaacccnctgtcactctcgttccccgccttcctccatacctcgtactgacgcgggctggcaacggcgcatagnannnnn

SEQ ID NO: 198185 - DNA, 614 bp, Homo sapiens
  misc_feature: GYAE6OF01CKJ3G.18.59.F04.1.454.CMB.1.raw
  modified_base (301)..(301): a, c, t, g, unknown or other
  misc_feature (301)..(301): n is a, c, g, or t
  modified_base (305)..(305): a, c, t, g, unknown or other
  misc_feature (305)..(305): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttatactatgtctctgtaccaacagcaccagacaaacgccccaatcatgatttangatntacactaatccgcctagtacgggttctaatcgtcttctcgtggtctctaagtctcggaccaacgtaccggtccctccctagaccctattcctcgtcgggcctccgaggtctaggacggacgagtctagtactttattacgtgactacgtctacaattactaacgaacgcaacgtacagcctaacgttactaaaccggttcgtaaccgggaaccgtacgggtaaaccgtaacgggttcccgtaacccggttaccgtaaccgggtaccgaaacccggacccccggtaaaaccggtcccccctaaaccccgg

SEQ ID NO: 198186 - DNA, 514 bp, Homo sapiens
  misc_feature: GYAE6OF01D8W6P.18.59.F04.1.454.CMB.1.raw
  modified_base (248)..(248): a, c, t, g, unknown or other
  misc_feature (248)..(248): n is a, c, g, or t
  modified_base (253)..(253): a, c, t, g, unknown or other
  misc_feature (253)..(253): n is a, c, g, or t
  modified_base (375)..(375): a, c, t, g, unknown or other
  misc_feature (375)..(375): n is a, c, g, or t
  modified_base (429)..(429): a, c, t, g, unknown or other
  misc_feature (429)..(429): n is a, c, g, or t
  modified_base (437)..(437): a, c, t, g, unknown or other
  misc_feature (437)..(437): n is a, c, g, or t
  modified_base (441)..(441): a, c, t, g, unknown or other
  misc_feature (441)..(441): n is a, c, g, or t
tcagtacgagtatgcacgaccggtgctcgatttagtacacacacttagggagttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttanaactntgtctcctggtaccaacagcaccaggcaaacgcccccaaactcatgatttatgatgtcactaatcgccctcgagggtttctaatcgtcttctctggctccaagtctggcaacgacgcctccngacctatctcgtggctccgaggctgaggacgaggctagtattatactgcagctnatatacancacnacactctctatcgtctacggacgtcggacaggtccaccgtctacggtcacgcccgaacgccccaacccgtacg

SEQ ID NO: 198187 - DNA, 509 bp, Homo sapiens
  misc_feature: GYAE6OF01CPDRW.18.59.F04.1.454.CMB.1.raw
  modified_base (505)..(509): a, c, t, g, unknown or other
  misc_feature (505)..(509): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagccccaaactcatgatttatgatgtcactaatcggcctcaggggtttctaatcgcttctctggctccaagtctggcaacacggcctccctgaccatctctgggctccaggctgaggacgaggctgattatactgcagctcatatacaagcacagcactctctatcgtcttcggaactggaccaaggtccacgtctacggtcacgacccaaggccaacccactcgtcactctcgttccccacctcctcccatacctcgtactcgagccgggctcgggcaacggtcgacacgtagcnnnnn

SEQ ID NO: 198188 - DNA, 770 bp, Homo sapiens
  misc_feature: GYAE6OF01CMAKD.18.59.F04.1.454.CMB.1.raw
  modified_base (228)..(228): a, c, t, g, unknown or other
  misc_feature (228)..(228): n is a, c, g, or t
  modified_base (242)..(242): a, c, t, g, unknown or other
  misc_feature (242)..(242): n is a, c, g, or t
  modified_base (307)..(307): a, c, t, g, unknown or other
  misc_feature (307)..(307): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggngttataactatgtctcctggtaccaacagccaccaggcaaacgcccccaaaactcatgtatttangatgtacactaatccggcccttcgaggggtttctaattccgtctttctcgtcggcctacccgtaagttcgtacgggacctaaaccgacccgggtccccttaccccgtacggaccctaagttcccgtaccggttcggggcccttacccggaagggtcccgttagggaacgggtaccgggaagggtccttagggtaactttttaacgtttaacccgtgggaccctaagggtacccttaaccgtaagtttaaacgtaaacccgaaacggtaccccaaacccgtaacggtaccctaaccgttccgttaccgttaacgtttaccggtttacccggttttaacccggggaaaaccggttttccgggggaaaccccttaaacggggttcccctaaccccgggtttacccgttaacggggttacccaaccggtacccccgaaaccgggtaccccctaaaccccccggtacg

SEQ ID NO: 198189 - DNA, 538 bp, Homo sapiens
  misc_feature: GYAE6OF01ANLQT.18.59.F04.1.454.CMB.1.raw
  modified_base (452)..(452): a, c, t, g, unknown or other
  misc_feature (452)..(452): n is a, c, g, or t
  modified_base (501)..(501): a, c, t, g, unknown or other
  misc_feature (501)..(501): n is a, c, g, or t
  modified_base (533)..(538): a, c, t, g, unknown or other
  misc_feature (533)..(538): n is a, c, g, or t
tcagtacgagtatgcacgaccggtgctcgatttagtacacacacttagggattgggggctttgcctgggtccctgggcccagtctgccctgactcagcctgccctccgtgtctgggtctcctggacagtcgatcaccatctcctgcactggaaccagcagtgacgttggtggttataactatgtctcctggtaccaacagccacccaggacaaacgccccccaaaactcatgtatttatgatgtcaactaatcggccctcgtaggggtttctaatcgcttctctggctccaagtctggcaacgacggccctccctgaccatcctcgtgggcctccgaggctgaggacgaggctgatttatactgcagctcatataacaagcagcagcactcaagtcttcggaactgggaaccaggtccaccgtcgtacggtcacgcccgaagcccaaccccntcgtcaacctctaccgttccccacccttcctaccactacctcgttacgnggacgccgggctcggacaaggccacagtcgcnnnnnn

SEQ ID NO: 198190 - DNA, 552 bp, Homo sapiens
  misc_feature: GYAE6OF01DSA8F.18.59.F04.1.454.CMB.1.raw
  modified_base (236)..(236): a, c, t, g, unknown or other
  misc_feature (236)..(236): n is a, c, g, or t
  modified_base (373)..(373): a, c, t, g, unknown or other
  misc_feature (373)..(373): n is a, c, g, or t
tcagtacgagtatgcacgaccggtgctcgatttagtacacacactttagggtagttgggggctggggtctcaggaggtcagcgctcttcgggacggtctccaccatggcctgggctctgctattcctcaccctcctcactcagggcacagggtcctgggcccagtctgccctgactcagcctgcctccgtgtctggtctcctggacagtcgatcaccatctcctgcactggaaccngcagtgacgttggtgttataactatgtctcctggtaccaacagcacccaggcaaacgcccccaaactcatcgatttatgattgtcactaatcgccctcgagggtttctaatcgcttctctgctcaagtctggcaacncggcctcctgaccatctctcggctccagctgagcgagctagtatttattactgtactagtctcaattactaacaacgaccaaccagcctaacttccgtctagttcgtaccgttacggaacgttcgggaacctaaggtaccacccgttcctaaggtccaacggccccgtaaggtaccccc

SEQ ID NO: 198191 - DNA, 529 bp, Homo sapiens
  misc_feature: GYAE6OF01D8K4G.18.59.F04.1.454.CMB.1.raw
  modified_base (228)..(228): a, c, t, g, unknown or other
  misc_feature (228)..(228): n is a, c, g, or t
  modified_base (326)..(326): a, c, t, g, unknown or other
  misc_feature (326)..(326): n is a, c, g, or t
  modified_base (385)..(385): a, c, t, g, unknown or other
  misc_feature (385)..(385): n is a, c, g, or t
  modified_base (452)..(452): a, c, t, g, unknown or other
  misc_feature (452)..(452): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtggttataactatgtctcctggtaccaacagcaccaggcaaacgcccccaaaactcatgatttatgatgtcactaatcggccctnagggtttctaatcgcttctctggctccaagtctggcaacacggcctcctgaccatctcngggcctcaggctgaggacgaggctgattatactgcagctcatactaacaagcaccagcactctactntcgtcttacggaacgtgggaaccaggtccaccggtcaacgggtccaacggccccaaacggcccctaaaccccgtacg

SEQ ID NO: 198192 - DNA, 495 bp, Homo sapiens
  misc_feature: GYAE6OF01EA85T.18.59.F04.1.454.CMB.1.raw
  modified_base (376)..(376): a, c, t, g, unknown or other
  misc_feature (376)..(376): n is a, c, g, or t
  modified_base (430)..(430): a, c, t, g, unknown or other
  misc_feature (430)..(430): n is a, c, g, or t
  modified_base (486)..(486): a, c, t, g, unknown or other
  misc_feature (486)..(486): n is a, c, g, or t
  modified_base (491)..(495): a, c, t, g, unknown or other
  misc_feature (491)..(495): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaaagcccccaaatcatgatttatgatgtcactaatcggccctcaggggtttctaatcgcttctctggctccaagtctggcaacacggcctccctgaccatctctgggctccaggctgaggacgaggctgattattactgcagctcaatatacaagcaacagcactctntatcgtcttcggaactgggaccaaggtcaccgtcagtcagcccaagccaacccntcgtccactctcgttccccacctcctccatctcgtactgagcgggctggcaaggcncatgnnnnn

SEQ ID NO: 198193 - DNA, 560 bp, Homo sapiens
  misc_feature: GYAE6OF01EU94T.18.59.F04.1.454.CMB.1.raw
tcagtacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggattttccttgctgctattttaaaggtgtccagtgtgaggtgcagctggtggagtcgtgggggaggcgttgggtaaaggccgggggggtcccttaggacctcccctgtacagcctctggattcactttcagtaaggcctggatgaacgtgggtccgccgaggctccgaggggaaggggctgggagtgggtggccgtaattaaaaccaaactgatggtaggacaacgagactacgctgcacccgtgaagcagatcacatctacaagagatagaattacaaaagcaacgctgtatctagacaatcgaacagactagaacgaaccgaggaacacgacgaccgtagtacttactcgtaccacactccctagaacgcgtacaactactactactacgtactcgctcgg

SEQ ID NO: 198194 - DNA, 630 bp, Homo sapiens
  misc_feature: GYAE6OF01EIHN8.18.59.F04.1.454.CMB.1.raw
  modified_base (205)..(205): a, c, t, g, unknown or other
  misc_feature (205)..(205): n is a, c, g, or t
  modified_base (251)..(251): a, c, t, g, unknown or other
  misc_feature (251)..(251): n is a, c, g, or t
  modified_base (527)..(527): a, c, t, g, unknown or other
  misc_feature (527)..(527): n is a, c, g, or t
tcagtacgagtatgcacgaccggtgctcgattttagtacacacacttagggattgggggctttaggcctgggtcctgggcccagtcttgccctgactcagccttgccttcgtgtctgggtctcctggacagtcgatcaccatctcctgcactgggaaccagcagttggtacgttggtggttataacttatgtctcctggtacaanagcaccaggcaacgccccaaatcagtgatttatgatgtcgactacncggcctcgtagggtttctaatcgcttctctggtctcctaagttctcggcaacgacgtcctcctggacctactctcgtcgggctccgaggtcgtaggaggtacggaggctagtaatttacttacgtgacgaacgtctacgaaacttatacaagcagcagacactactaacgttccttacggaacttacgggaacctaacggtaccaaccgtacctaaggtcctacgacccgtaacggtcccaaccctactacgtccaaccttccgtccgttaccccncccgttaccctaccgaacgttacccgtccggttacgtcggtacggtccgggtcgttacgggactaacgggtccgtaccgaagttaccgctcgacgactgctcg

SEQ ID NO: 198195 - DNA, 496 bp, Homo sapiens
  misc_feature: GYAE6OF01A6DWY.18.59.F04.1.454.CMB.1.raw
  modified_base (422)..(422): a, c, t, g, unknown or other
  misc_feature (422)..(422): n is a, c, g, or t
  modified_base (486)..(488): a, c, t, g, unknown or other
  misc_feature (486)..(488): n is a, c, g, or t
  modified_base (490)..(496): a, c, t, g, unknown or other
  misc_feature (490)..(496): n is a, c, g, or t
tcagtacgagtatgcacgaccggtgctcgatttagtacacacacttagggattgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtctaggtcagcccaaggcccaacccntcgtcactctcgttccccgccctcctccatactcgtactgacgcggctggcaaggcgacatcgnnntnnnnnnn

SEQ ID NO: 198196 - DNA, 531 bp, Homo sapiens
  misc_feature: GYAE6OF01CQ4YZ.18.59.F04.1.454.CMB.1.raw
  modified_base (300)..(300): a, c, t, g, unknown or other
  misc_feature (300)..(300): n is a, c, g, or t
  modified_base (417)..(417): a, c, t, g, unknown or other
  misc_feature (417)..(417): n is a, c, g, or t
tcagtacgagtatgcacgaccggtgctcgatttagtacacacacttagggattggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcaccaggcaaagccccaaatcatgatttangatgtacactaatcggccctcgaggggtttctaatcgtcttctctggctccaagtctggcaacacggcctccctgaccatctcgtggctccaggctgagacgagctgattagtactncagctacagtactacaagcaccagctaactctctatcgtcgttcggaacgttcgggaaccaaggtccctaccgtcctacggtccacggaccccaacgggacccaacccgtaccg

SEQ ID NO: 198197 - DNA, 522 bp, Homo sapiens
  misc_feature: GYAE6OF01CV26Q.18.59.F04.1.454.CMB.1.raw
  modified_base (228)..(228): a, c, t, g, unknown or other
  misc_feature (228)..(228): n is a, c, g, or t
  modified_base (518)..(518): a, c, t, g, unknown or other
  misc_feature (518)..(518): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtggttataactatgtctcctggtaccaacagcacccaggacaaacgcccccaaatcatgatttatgatgtcagtaatcggccctcaggggtttctaatcgcttctctggctcaagtctggcaacacggcctccctgaccatctctgggctccaggctgaggacgaggctgatttatactgcagctcataatacaagcagcagcactcaaagttcctacggaactcgggaaccaaggtccacccggtcctaggtcacgaccccaaggcccaaccccgntacg

SEQ ID NO: 198198 - DNA, 515 bp, Homo sapiens
  misc_feature: GYAE6OF01DV95N.18.59.F04.1.454.CMB.1.raw
  modified_base (304)..(304): a, c, t, g, unknown or other
  misc_feature (304)..(304): n is a, c, g, or t
  modified_base (423)..(423): a, c, t, g, unknown or other
  misc_feature (423)..(423): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcaccaggcaaagcccccaaactcatgatttangatgtcactaatcggccctcgaggggtttctaatcgcttctctgctccaagtctggcaacgacggccctcctgacccatctctgggctccgaggctgaggacgaggctgatttattacngcagctcatatacaagcaccagcactctctatgtcttacggaactgggaccaggtcaccgtctaaggtcaacgcccaacggcccaacccgtc

SEQ ID NO: 198199 - DNA, 457 bp, Homo sapiens
  misc_feature: GYAE6OF01C9UKP.18.59.F04.1.454.CMB.1.raw
  modified_base (393)..(393): a, c, t, g, unknown or other
  misc_feature (393)..(393): n is a, c, g, or t
  modified_base (418)..(418): a, c, t, g, unknown or other
  misc_feature (418)..(418): n is a, c, g, or t
  modified_base (429)..(429): a, c, t, g, unknown or other
  misc_feature (429)..(429): n is a, c, g, or t
  modified_base (437)..(437): a, c, t, g, unknown or other
  misc_feature (437)..(437): n is a, c, g, or t
  modified_base (446)..(446): a, c, t, g, unknown or other
  misc_feature (446)..(446): n is a, c, g, or t
  modified_base (450)..(457): a, c, t, g, unknown or other
  misc_feature (450)..(457): n is a, c, g, or t
tcagtacgagtatgcacgaccggtgctcgatttagtacacacacttagggattgggggctttgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctcctgaccatctctgggctccaggctgaggacgaggctgattattactgcagctcatatacaagcaccagcactctctatcgtcttacggaactgggaaccaaggtccaccgtcctaggtcacgcccaaggcccaaccccnctgccactctcgttcccgccctccncatctcgtacngacgcggntggcaggcnatgnnnnnnnn

SEQ ID NO: 198200 - DNA, 523 bp, Homo sapiens
  misc_feature: GYAE6OF01D5T5D.18.59.F04.1.454.CMB.1.raw
  modified_base (307)..(307): a, c, t, g, unknown or other
  misc_feature (307)..(307): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaatcatgatttangatgtcagtaatcggcctcagggtttcaatcgcttctctggctccaagtctggcaacacggcctccctgaccatctctgggctcgaggctggaggacgaggctgatttatctgcagctacatatactaagcagcagcactacaagttcttacggaacttgggaacctaggtccaacccggttcctagggtccacgccccaaggccccaaacccccg

SEQ ID NO: 198201 - DNA, 559 bp, Homo sapiens
  misc_feature: GYAE6OF01CW1WM.18.59.F04.1.454.CMB.1.raw
  modified_base (556)..(556): a, c, t, g, unknown or other
  misc_feature (556)..(556): n is a, c, g, or t
  modified_base (559)..(559): a, c, t, g, unknown or other
  misc_feature (559)..(559): n is a, c, g, or t
tcagtacgagtatgcacgaccggtgctcgatttagtacacacacttagggattggggagagagacccctcccctgggatcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgcccccaaaactcatgatttatgatgtcaactaatccgggccctcgtaggggttttactaatcgtcttctctggctccaagtctggacaacaccggcctccctgaccatctcgtcgggctccgaggctgacggacgagctagatttatactgcagctacatatacaagacacagacactctctatgtactcggaactcgggaccagtctaccgtcgtagtcacgacccaacggcccaaccccgatcgtactacttccttccgttacccctaccctcctaccctactaccgttacgtacgtcggacggcgggcctggaccgaaggccgacaagtcgntgn

SEQ ID NO: 198202 - DNA, 514 bp, Homo sapiens
  misc_feature: GYAE6OF01CTQ9D.18.59.F04.1.454.CMB.1.raw
  modified_base (228)..(228): a, c, t, g, unknown or other
  misc_feature (228)..(228): n is a, c, g, or t
  modified_base (325)..(325): a, c, t, g, unknown or other
  misc_feature (325)..(325): n is a, c, g, or t
  modified_base (415)..(415): a, c, t, g, unknown or other
  misc_feature (415)..(415): n is a, c, g, or t
  modified_base (419)..(419): a, c, t, g, unknown or other
  misc_feature (419)..(419): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtggttataactatgtctcctggtaccaacagcaccaggcaaacgcccccaaactcatgatttatgatgtcactaatcggccctnagggttctaatcgcttctctgctccaagtctggcaacacgcctcctgaccatctctggactccaggctggagacgaggctgattattacngacngctcatctaacagccacagcactctactatcgtcttacggaacgtgggacctaggtccaccgtcctaggtccagacccaacgcccaacccctacg

SEQ ID NO: 198203 - DNA, 464 bp, Homo sapiens
  misc_feature: GYAE6OF01CEJ1D.18.59.F04.1.454.CMB.1.raw
  modified_base (250)..(250): a, c, t, g, unknown or other
  misc_feature (250)..(250): n is a, c, g, or t
  modified_base (259)..(259): a, c, t, g, unknown or other
  misc_feature (259)..(259): n is a, c, g, or t
  modified_base (302)..(302): a, c, t, g, unknown or other
  misc_feature (302)..(302): n is a, c, g, or t
  modified_base (313)..(313): a, c, t, g, unknown or other
  misc_feature (313)..(313): n is a, c, g, or t
  modified_base (322)..(322): a, c, t, g, unknown or other
  misc_feature (322)..(322): n is a, c, g, or t
  modified_base (381)..(381): a, c, t, g, unknown or other
  misc_feature (381)..(381): n is a, c, g, or t
  modified_base (399)..(399): a, c, t, g, unknown or other
  misc_feature (399)..(399): n is a, c, g, or t
  modified_base (441)..(441): a, c, t, g, unknown or other
  misc_feature (441)..(441): n is a, c, g, or t
  modified_base (443)..(443): a, c, t, g, unknown or other
  misc_feature (443)..(443): n is a, c, g, or t
  modified_base (445)..(464): a, c, t, g, unknown or other
  misc_feature (445)..(464): n is a, c, g, or t
tcagtacgagtatgcacgaccggtgctcgatttagtacacacacttagggagttgggggctttgtctgggtctcctggacagtcgatcaccatctcctgcactggaaccagcagtgacgttggtggttataactatgtctcctggtaccaacagcacccaggcaaagcccccaaactcatgatttatgatgtcactaatccggccctcgaggggtttcaagtcgcttctctggctccaagtctggcaacncggcctccngaccatctctgggctccaggctgaggacgaggctgattatacngcagctcatanacaagcacngcactctctatcgtctacggactggacagtcaccgtctagcacgcccaagcccaacccntcgccactctcgtccccncctccacatctcgactgacgcggctggcgaaggcacagtagnancnnnnnnnnnnnnnnnnnnnn

SEQ ID NO: 198204 - DNA, 680 bp, Homo sapiens
  misc_feature: GYAE6OF01EV676.18.59.F04.1.454.CMB.1.raw
  modified_base (176)..(176): a, c, t, g, unknown or other
  misc_feature (176)..(176): n is a, c, g, or t
  modified_base (227)..(227): a, c, t, g, unknown or other
  misc_feature (227)..(227): n is a, c, g, or t
  modified_base (266)..(266): a, c, t, g, unknown or other
  misc_feature (266)..(266): n is a, c, g, or t
  modified_base (286)..(286): a, c, t, g, unknown or other
  misc_feature (286)..(286): n is a, c, g, or t
  modified_base (298)..(298): a, c, t, g, unknown or other
  misc_feature (298)..(298): n is a, c, g, or t
  modified_base (321)..(321): a, c, t, g, unknown or other
  misc_feature (321)..(321): n is a, c, g, or t
tcagtacgagtatgcacgaccggtgctcgatttagtacacacacttagggattggggctttgcctgggtcctgggccagtctgccctgactcagcctgcctccgtgtctgggtctcctggacagtcgatcaccatctcctgcactggaaccagcagtgacgttggtgttataactntgtctcctggtaccaacagcacccaggcaaagccccaaatcaatgatttangatgtcagtaactcggccttgagggtttcaatcgcttcnctggctccagtctggcaacncggtccatccgntacagtcctcgtcggcctacggngtctaggacgtcgaggtactagtaacttacgtcgacgtacgtacgtacgtactataacgtaacgaacgtcctacggactacctacgttctacgttacgtcgttacgttacggtaacgttacgggaaccgttacggaactttcccgtaaacggtttcccaggtaccccgtaaagggtcccctaaaaccccggtcttaacccggtacctacggtttacccgtacggtttacccccgtaccgtttaccccgtacccgtaacgttaccccgtacggttaaaccttccgggtaaacgtccgggtactccggggtaccttaaacgggcccgtaacgtacgttacgtactaggtctcgtactacgg

SEQ ID NO: 198205 - DNA, 514 bp, Homo sapiens
  misc_feature: GYAE6OF01AB9CW.18.59.F04.1.454.CMB.1.raw
  modified_base (325)..(325): a, c, t, g, unknown or other
  misc_feature (325)..(325): n is a, c, g, or t
  modified_base (431)..(431): a, c, t, g, unknown or other
  misc_feature (431)..(431): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctnaggggtttctaatcgcttctctggctccaagtctggcaacacggcctccctgaccatctctgggctccaggctgaggacgaggctgtattatactgcagctcatanacaagcaccagcactctctatcgtctacggaacgtgggaccaaggtccaccgtctacggtcacgcccaagccccaaccctacc

SEQ ID NO: 198206 - DNA, 508 bp, Homo sapiens
  misc_feature: GYAE6OF01BUDE7.18.59.F04.1.454.CMB.1.raw
  modified_base (503)..(508): a, c, t, g, unknown or other
  misc_feature (503)..(508): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaggtcaccgtcctaggtcacgcccaaggcccaaccccactcgtccactcctcgttccccgccctccctccactacctcgtactgacgcgggctggcaggcacatagnnnnnn

SEQ ID NO: 198207 - DNA, 498 bp, Homo sapiens
  misc_feature: GYAE6OF01CP40M.18.59.F04.1.454.CMB.1.raw
  modified_base (430)..(430): a, c, t, g, unknown or other
  misc_feature (430)..(430): n is a, c, g, or t
  modified_base (477)..(477): a, c, t, g, unknown or other
  misc_feature (477)..(477): n is a, c, g, or t
  modified_base (491)..(491): a, c, t, g, unknown or other
  misc_feature (491)..(491): n is a, c, g, or t
  modified_base (493)..(495): a, c, t, g, unknown or other
  misc_feature (493)..(495): n is a, c, g, or t
  modified_base (497)..(498): a, c, t, g, unknown or other
  misc_feature (497)..(498): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccagacaaagccccaaaactcatgatttatgatgtcactaatcggccctcaggggtttctaatcgcttctctggctccaagtctggcaacacggcctccctgaccatctctgggctccaggctgaggacaggctgattatactgcagctcatatacagcaccagcactctctatgtcttcggaactggaccaaggtccaccgtctaggtcacgcccaaggcccaacccnctcgtcactctacgttcccgcctcccatctcgctgagcgggctgggnaacgggcacatagnannngnn

SEQ ID NO: 198208 - DNA, 324 bp, Homo sapiens
  misc_feature: GYAE6OF01BJ4AF.18.59.F04.1.454.CMB.1.raw
  modified_base (318)..(324): a, c, t, g, unknown or other
  misc_feature (318)..(324): n is a, c, g, or t
tcagtacgagtatgcacgaccggtgctcgatttagtacacacacttagggattggggagagaagacaggattcaggacaatctccagcatggccggcttccctctcctcctcaccctcctcactcactgtgcagggtcctgggcccagtctgtgctgactcagccaccctcagcgtctcgggacccccggcagagggtcaccatctcttgttctggaagcagctccaacatcggaagtcagcccaaggctcgcccctcggtcactctcgttcccgccctcctcatactcgtactgaggcggctggcaaggcgcatagnnnnnnn

SEQ ID NO: 198209 - DNA, 501 bp, Homo sapiens
  misc_feature: GYAE6OF01EGQEX.18.59.F04.1.454.CMB.1.raw
  modified_base (371)..(371): a, c, t, g, unknown or other
  misc_feature (371)..(371): n is a, c, g, or t
  modified_base (497)..(501): a, c, t, g, unknown or other
  misc_feature (497)..(501): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaaatcatgatttatgatgtcagtaatcggccctcaggggttttctaatcgcttctctggctccaagtctggcaacacggcctcctgaccatctctgggctccaggctgaggacgaggctgattatactgcagctcatatacagcagcagcactnaatctacggactgggaccaaggtcaccgtcctaggtcacgcccaaggcccaacccatcgtcactctcgttcccgccctcctccactactcgtactgacgcggtcgtcggcaacggcacgatacgcnnnnn

SEQ ID NO: 198210 - DNA, 560 bp, Homo sapiens
  misc_feature: GYAE6OF01DY3P9.18.59.F04.1.454.CMB.1.raw
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgccccaaactcatgatttatgatgtcactaatcggccctcgagggtttctaatcgtcttctctcggctaccaagtcctggacaacacggcctccctgaccatcctcgtgggctccgaggctggaaggcgaggctagtattacttactgctagcctacattaactaacaacgtccaaccagcctaactctactatcgttacgttacggaacgttcgggaaccaacgggtccaacccggttcctaaggtcaaccggtcccaaccggtaaccccc

SEQ ID NO: 198211 - DNA, 520 bp, Homo sapiens
  misc_feature: GYAE6OF01C8Y0E.18.59.F04.1.454.CMB.1.raw
  modified_base (423)..(423): a, c, t, g, unknown or other
  misc_feature (423)..(423): n is a, c, g, or t
  modified_base (431)..(431): a, c, t, g, unknown or other
  misc_feature (431)..(431): n is a, c, g, or t
  modified_base (435)..(435): a, c, t, g, unknown or other
  misc_feature (435)..(435): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctctggtaccaacagcaccaggacaaacgccccaaactcatgtatttatgatgtacactaatcggccctcgtagggtttctaatcgtcttctctgctctaagtctggcaacacgcctcctgaccatctcgtggctccgggctggaggacgaggctagtattattacngcagctanatanacaagcacagcactctctatcgtctacggacgtcggaacaaggtccaccgtcgtaggacacgacccgagacccaaccctgtaccg

SEQ ID NO: 198212 - DNA, 519 bp, Homo sapiens
  misc_feature: GYAE6OF01C1HZQ.18.59.F04.1.454.CMB.1.raw
  modified_base (369)..(370): a, c, t, g, unknown or other
  misc_feature (369)..(370): n is a, c, g, or t
  modified_base (437)..(437): a, c, t, g, unknown or other
  misc_feature (437)..(437): n is a, c, g, or t
  modified_base (514)..(519): a, c, t, g, unknown or other
  misc_feature (514)..(519): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgccccaaactcatgatttatgatgtcactaatcggccctctaggggtttctaatcgcttctctggctccaagtctggcaacacggccctcctgaccatctctgggctccgagctgaggacgagctgattactactgcagctacatatacaagcaaccnncactctctatgtccttacggaactgggaaccaaggtccacgtcctagtcacgcccaagcccaacccntcgacactcctacgttccccacctctacccattacctcgtactgacgtccgggctggacaagggtccactagtacgnnnnnn

SEQ ID NO: 198213 - DNA, 540 bp, Homo sapiens
  misc_feature: GYAE6OF01A0T87.18.59.F04.1.454.CMB.1.raw
  modified_base (253)..(253): a, c, t, g, unknown or other
  misc_feature (253)..(253): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactntgtctcctggtaccaacagcaccaggcaaacgcccccaaactcatgatttatgatgtcactaatcggccctcgagggtttctaatcgcttctctggctccaagtctggcaacacggccctccgtgacctactctcgtgggcctccgaggctaggacggacgagctgtatttactacgtgcagtctacatataacagccaccagcactctactattcgtacttacggaacgtcgggaccaacggtccacccgtcgtacggtcacgacccaacggccccaacccgtacg

SEQ ID NO: 198214 - DNA, 753 bp, Homo sapiens
  misc_feature: GYAE6OF01D7A0I.18.59.F04.1.454.CMB.1.raw
  modified_base (232)..(232): a, c, t, g, unknown or other
  misc_feature (232)..(232): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgcccccaaactcatgatttangatgtcactaatcggccctcgagggttcttatcgtcttctctgcgtcctacgtactcgtcgaaccacggcccgtccctcgaccgactctcgtcggcgtccacggcgtcgaggacgacggtacgtcgtagttatttattagtcacgtctacctaataactaacaacgacctaacccacgacctaccttaccttaccttacgtttacgttccgtttaacccgggtaaaccggtacgggtaaccccgtaaacggttacccgtaaccccggttacccttaacggggttaccaacccggaaacccctaacccgggaaccccctaacccccctaaccgttcgttacccgtaacccctttccgtttccccggtttaccccccgttccccccttacccttaccccgtaacctttaacccgttacccgttaccggttaccgggaacggggtcccccgggggttcgttaaccggggacccgaaaccggggacccggtaccgttaaaaccgttgggaccagtcccgatcgcg

SEQ ID NO: 198215 - DNA, 508 bp, Homo sapiens
  misc_feature: GYAE6OF01B6MGP.18.59.F04.1.454.CMB.1.raw
  modified_base (228)..(228): a, c, t, g, unknown or other
  misc_feature (228)..(228): n is a, c, g, or t
  modified_base (304)..(304): a, c, t, g, unknown or other
  misc_feature (304)..(304): n is a, c, g, or t
  modified_base (362)..(362): a, c, t, g, unknown or other
  misc_feature (362)..(362): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtggttataactatgtctcctggtaccaacagcaccaggcaaagcccccaaactcatgatttangatgtcactaatcgccctcagggtttctaatcgcttctctggctcaagtctggcaacncgcctccctgaccatctctgggctccaggctgaggacgaggctgattatactgcagctcatactacaagcacagcaactctctatgtcttacggaacgtcgggaccaaggtcaccgtctaggtccagacccaacgcccaacccgtc

SEQ ID NO: 198216 - DNA, 571 bp, Homo sapiens
  misc_feature: GYAE6OF01BSLFA.18.59.F04.1.454.CMB.1.raw
  modified_base (228)..(228): a, c, t, g, unknown or other
  misc_feature (228)..(228): n is a, c, g, or t
  modified_base (242)..(242): a, c, t, g, unknown or other
  misc_feature (242)..(242): n is a, c, g, or t
  modified_base (303)..(303): a, c, t, g, unknown or other
  misc_feature (303)..(303): n is a, c, g, or t
  modified_base (446)..(446): a, c, t, g, unknown or other
  misc_feature (446)..(446): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggngttataactatgtctcctggtaccaacagcaccaggcaaagccccaaaactcatgatttangatgtcagtaatcggcctcgaggggtttctaagtcgcttctcgtggcctaccgaagtctggacaacgaccggcctccctgacctatctacgtgggcctccgaggctggacggacgaggctgatttagtactgcacgctgatanaacagcagtacagtacactctaaacgttcgttacggaaactcggggaaccctaagggttcccacccggttacctagggtaccaaccggtaccccgaaacgggcccctaaaccccgtgttacccgg

SEQ ID NO: 198217 - DNA, 811 bp, Homo sapiens
  misc_feature: GYAE6OF01C2ZU3.18.59.F04.1.454.CMB.1.raw
  modified_base (233)..(233): a, c, t, g, unknown or other
  misc_feature (233)..(233): n is a, c, g, or t
  modified_base (314)..(314): a, c, t, g, unknown or other
  misc_feature (314)..(314): n is a, c, g, or t
tcagtacgagtatgcacgaccggtgctcgatttagtacacacacttagggagttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgccacgtggaaaccngcagtgacgttggtagttaataacgtatgtctcctggtaccaacagcaccaggacaaacgccccaaatcaatcgtatttangatgtcaactaagtccggaccctcgtaggggtttactaacgtcgtctttctcgtcgggtcctaccgtaagtccgtacgggaccaaaccgaccggtcccctaccccgtacggaccctaacgttccgtaccggttcggggccttaccccggaaggggtccgttacgggaacgggaaccgggtaacgggtacgttaacgggttaaactttttaacggttaaccgttcggtaaccgtacggtaccttaactaaacgtttaacgttaaaccaacggtacccgaacccgtaacggtacccttaaccgttaccttaccgttaaacggtttccggttacccggttttaacccggggaaaaccggtttaccggggggaaaccccttaaaaccgggggttcccccgtaaacccccgggtttacccggttaaacggggtaccccgtaaacccggggtaacccccgtaaaaccccgggaaccccccttaaaacccccccggttaaccgg

SEQ ID NO: 198218 - DNA, 524 bp, Homo sapiens
  misc_feature: GYAE6OF01BJR04.18.59.F04.1.454.CMB.1.raw
  modified_base (519)..(519): a, c, t, g, unknown or other
  misc_feature (519)..(519): n is a, c, g, or t
  modified_base (521)..(524): a, c, t, g, unknown or other
  misc_feature (521)..(524): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaaagcccccaaaatcatgatttatgatgtcactaatcggccctcaggggtttctaatcgcttctctggctccaagtctggcaacacggcctccctgaccatctctgggctccaggctgaggacgaggctgattattactgcagctcatatacaagcaaccagcactctcctatgtcttcggaactggaccaaggtccaccgtcctaggtcagccccaaggcccaaccccactgtccacctcctacgttccccgtccctccctcccacttacctccgtactggacgcgggctcgggcgaaggcgacagtacnannnn

SEQ ID NO: 198219 - DNA, 517 bp, Homo sapiens
  misc_feature: GYAE6OF01ATV6W.18.59.F04.1.454.CMB.1.raw
  modified_base (243)..(243): a, c, t, g, unknown or other
  misc_feature (243)..(243): n is a, c, g, or t
  modified_base (304)..(304): a, c, t, g, unknown or other
  misc_feature (304)..(304): n is a, c, g, or t
  modified_base (434)..(434): a, c, t, g, unknown or other
  misc_feature (434)..(434): n is a, c, g, or t
  modified_base (455)..(455): a, c, t, g, unknown or other
  misc_feature (455)..(455): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggngttataactatgtctctggtaccaacagcaccaggcaaacgcccccaaactcatgatttangatgtcactaatcggccctgacgggtttctaatcgtcttctctggctccaagtctggcaacaccggcctccctgacctatctctcgggctccgaggctggacggacgaggctgatttatactgcagctanatataacagccacagcatctntatgtcttacggactgggaccaggtccaccgtctacggtcacgacccaacgcccaaccctcg

SEQ ID NO: 198220 - DNA, 521 bp, Homo sapiens
  misc_feature: GYAE6OF01EW834.18.59.F04.1.454.CMB.1.raw
  modified_base (304)..(304): a, c, t, g, unknown or other
  misc_feature (304)..(304): n is a, c, g, or t
  modified_base (369)..(369): a, c, t, g, unknown or other
  misc_feature (369)..(369): n is a, c, g, or t
  modified_base (521)..(521): a, c, t, g, unknown or other
  misc_feature (521)..(521): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaatcatgatttantgatagtacagtactcggccgttcagggttctatcgcttctctgctcagtctgcacacgctcctnaccactcgctcggctccagggctagaggacgaggcttgtattattactgcagctacaataatacaagcagcacgacactcgtaacgtactacgggaactcgggaccaacggtccaccgtccacggtccacggaccccaacggccaacccgtn

SEQ ID NO: 198221 - DNA, 569 bp, Homo sapiens
  misc_feature: GYAE6OF01BVRQ1.18.59.F04.1.454.CMB.1.raw
tcagtacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtggggggaggcttgggtaaaggccgggggggtcccttaggacctcccctgtacagcctctggattcactttcagtaaggcctggatgaactgggtccgccaggctccgagggagggctggagtgggtggccgtaataaaaccaaactgagtggtggacaacagactacgctgacacccgtagaaaggcagacttcaccatctacaagagatagaattacaaaaagcaacgctagtatctagacaaatcgaacagacctagaacgaaccgaggaccacgacgtcgtagtacttacgtacgtaccacactcccctagaacgtcctacaactactactacgtacgtatcggcctcgg

SEQ ID NO: 198222 - DNA, 326 bp, Homo sapiens
  misc_feature: GYAE6OF01D5N60.18.59.F04.1.454.CMB.1.raw
  modified_base (317)..(326): a, c, t, g, unknown or other
  misc_feature (317)..(326): n is a, c, g, or t
tcagtacgagtatgcacgaccggtgctcgatttagtacacacacttagggattggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaacatcggaatcagcccaaggctgccccctggtcactctgttccccgccctcctccatactcgtactgagcgggctggcaaggcgcatagnnnnnnnnnn

SEQ ID NO: 198223 - DNA, 540 bp, Homo sapiens
  misc_feature: GYAE6OF01EWCQI.18.59.F04.1.454.CMB.1.raw
  modified_base (439)..(439): a, c, t, g, unknown or other
  misc_feature (439)..(439): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcctggtaccaacagcaccaggcaaacgccccaaactcatgatttatgatgtcactaatcgccctcgaggggttttctaattgcttctctggctccaagtctggacaacgaccggcctccctgaccattctctgggcctccgaggtcctggaggacgaggctgtatttattacgtgcagtctnatactacagcacagcactctactatcgttcttacggaacgtcgggaacctaacggtccaccgtcctacggtcaacgccccaacggccccaaaccccgtacg

SEQ ID NO: 198224 - DNA, 637 bp, Homo sapiens
  misc_feature: GYAE6OF01BNC19.18.59.F04.1.454.CMB.1.raw
  modified_base (227)..(227): a, c, t, g, unknown or other
  misc_feature (227)..(227): n is a, c, g, or t
  modified_base (253)..(253): a, c, t, g, unknown or other
  misc_feature (253)..(253): n is a, c, g, or t
  modified_base (270)..(270): a, c, t, g, unknown or other
  misc_feature (270)..(270): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaaccngcagtgacgttggtaggttataactntgtctcctggtaccaanagccacccaggacaaacgcccccaaatcatgatttatgatgtacagtaactcgcctcgtagggtttcaagtcgtcttctcgtggcctacctaagtctggaccaacgaccggtccctccctagacctattcctcgtggtcctccgagggcttaggaacgggaccgaggtctagtaactttatactcgactacgtctacaattaactaaccgaagctaacggcaacgacctaactacgtaacggttaccttaccgggtaaaccgtccgggaaacctaaccgggtacccgttaacccggttacccgtaagggtacccaaaccgggacccccgtaaaaccggacccccttaaaccccgcgtttaaccccgg

SEQ ID NO: 198225 - DNA, 499 bp, Homo sapiens
  misc_feature: GYAE6OF01AGBKN.18.59.F04.1.454.CMB.1.raw
  modified_base (250)..(250): a, c, t, g, unknown or other
  misc_feature (250)..(250): n is a, c, g, or t
  modified_base (489)..(489): a, c, t, g, unknown or other
  misc_feature (489)..(489): n is a, c, g, or t
  modified_base (494)..(499): a, c, t, g, unknown or other
  misc_feature (494)..(499): n is a, c, g, or t
tcagtacgagtatgcacgaccggtgctcgatttagtacacacacttagggattggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctnaggggtttctaatcgcttctctggctccaagtctggcaacacggcctccctgacccatctctgggctccaggctgaggacgaggctgattatactgcagctcatatacaagcaccagcactctctatgtcttcggaactgggaccaaggtcaccgtctaggtcagcccaaggcccaacccactgtcactctcgttcccaccctcctcccatacctcgtactgagcgggctggcaaggcnatagnnnnnn

SEQ ID NO: 198226 - DNA, 519 bp, Homo sapiens
  misc_feature: GYAE6OF01C5KMN.18.59.F04.1.454.CMB.1.raw
  modified_base (308)..(308): a, c, t, g, unknown or other
  misc_feature (308)..(308): n is a, c, g, or t
tcagtacgagtatgcacgaccggtgctcgatttagtacacacacttagggattgggggctggggtctcaggaggcagcgctctcgggacgtctccaccatggcctgggcgctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcctggtaccaacagcacccaggcaaacgccccaaaactcatgatttangatgtcactaatcggccctcgagggtttctaatcgtcttctctggctcaagtctggcaacacggcctcctgaccactctctgggcctccgaggtctgaggacgaggctgtattattactgcagctacatatacaagcagcagcactcaacgttctacggaactgggaaccaggtcctaccgtctaggtcacggcccaacggcccaaccccg

SEQ ID NO: 198227 - DNA, 645 bp, Homo sapiens
  misc_feature: GYAE6OF01A3TIB.18.59.F04.1.454.CMB.1.raw
  modified_base (227)..(227): a, c, t, g, unknown or other
  misc_feature (227)..(227): n is a, c, g, or t
  modified_base (251)..(251): a, c, t, g, unknown or other
  misc_feature (251)..(251): n is a, c, g, or t
  modified_base (268)..(268): a, c, t, g, unknown or other
  misc_feature (268)..(268): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctctggacagtcgatcaccatctcctgcactggaaccngcagtgacgttggtgttataactntgtctcctggtaccaanagcaccaggacaaacgcccccaaactcatgtatttatgatgtacactaatccgcctcgtagggtttactaatcgtcttctctcggtctccaagtcgtggaccaacgaccggtccctcccgtcgaccctactcctcgtcggcctccgacggtcgtggacggacgaggcgttagtaattacgttacgtcgactacgtctactatactaacgaacgcgaacccgagtccctaaccgttaccttcgttacgttcggttaccgtttaccgggtaaccggttcggggaacccgtaacgggtcccgtaaccccgggttacccgttaaccgggtaccgaccgaacccccggtaaacccggtacccccgaaacccccgttaaccgg

SEQ ID NO: 198228 - DNA, 515 bp, Homo sapiens
  misc_feature: GYAE6OF01C3CPX.18.59.F04.1.454.CMB.1.raw
  modified_base (354)..(354): a, c, t, g, unknown or other
  misc_feature (354)..(354): n is a, c, g, or t
  modified_base (415)..(415): a, c, t, g, unknown or other
  misc_feature (415)..(415): n is a, c, g, or t
  modified_base (435)..(435): a, c, t, g, unknown or other
  misc_feature (435)..(435): n is a, c, g, or t
  modified_base (496)..(515): a, c, t, g, unknown or other
  misc_feature (496)..(515): n is a, c, g, or t
tcagtacgagtatgcacgaccggtgctcgatttagtacacacacttagggattgggggctttgcctgggtgctgttggtaccaggagacatagttataaccaccatctcctgcactggaaccagcagtgacgttggtggttataactatgtctcctggtaccaacagcacccaggcaaacgccccccaaactcatgatttatgatgtcactaatccggccctcgaggggtttctaatcgcttctctggcctccaagtctggcaaccacggccctccctgacccatctcgtcgggcctccgaggctggaggacgaggctagtatttattacgtgcagctcatatacaagccacancactctatatgtctacggaactgggaccaggtcaccgtcagtcacgcccagccccaacccntgtccactcttacgtccccncctccacctactacccgtatcggacggccggtctacgggaccaacgggtccactagtacgnnnnnnnnnnnnnnnnnnnn

SEQ ID NO: 198229 - DNA, 588 bp, Homo sapiens
  misc_feature: GYAE6OF01CQ5CJ.18.59.F04.1.454.CMB.1.raw
  modified_base (228)..(228): a, c, t, g, unknown or other
  misc_feature (228)..(228): n is a, c, g, or t
  modified_base (307)..(307): a, c, t, g, unknown or other
  misc_feature (307)..(307): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataactatgtctcctggtaccaacagcaccaggacaaacgcccccaaaactccatgatttangatgtacactaatccgcctcgagggtttctaatcgcttctctcggctccgaagtcgtcggacaaccgtacgccctcctcgacctatcctcgtcgggcctccgagtctggacggacgaggctagtatttatacgtgcagtctacatactaacagaccaccagcctaactctacttagtcgttaccttacggaaccgttcgggaaccctaacgggtccctaaccccggttaccgtacgggttaccaaccggacccctaaccgggaaccccaaccccgttaccg

SEQ ID NO: 198230 - DNA, 655 bp, Homo sapiens
  misc_feature: GYAE6OF01A4CC2.18.59.F04.1.454.CMB.1.raw
  modified_base (252)..(252): a, c, t, g, unknown or other
  misc_feature (252)..(252): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactntgtctcctgtaccaacagcaccaggacaaacgccccaaactcatgatttatgatgtacacttaactccggtccctcgtacggggtttactaacgtcgtctttctctcggtctccgtaacgtcgtaggaccaacgaccggcccttccccgtagaaccctacgttccgttccgtacgggtcctccgaacgggtccgttaggaacgggaccggtaagggtccttagtaatttaacttacgtcgcgtacgtcttactataactaacgaacgacctaaccgaacgtcctaacttcctaccttagttcgttaccgttacggtaaaccgttcgggtaaccctaacggttcccgacccgttaccgtacggttaccaacggaccccaaccggaccccgaaaccccgtaccgg

SEQ ID NO: 198231 - DNA, 517 bp, Homo sapiens
  misc_feature: GYAE6OF01EJ49X.18.59.F04.1.454.CMB.1.raw
  modified_base (246)..(246): a, c, t, g, unknown or other
  misc_feature (246)..(246): n is a, c, g, or t
  modified_base (323)..(323): a, c, t, g, unknown or other
  misc_feature (323)..(323): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctctggacagtcgatcaccatctcctgcactggaaccagcagtgacgttggtgttanaactatgtctcctggtaccaacagcaccaggcaaacgcccccaaatcatgatttatgatgtacactaatcggccctnagggtttctaatcgcttctctgctcaagtctaggcaacacggcctcctgaccatctctcgggctccgaggctgaggacgaggctgtatttattactgcagctacatataacaagtacaccagcactctatatgtcctacggaactcgggacaaggtccaccgtctacggtcacgacccaaggcccaacccgtac

SEQ ID NO: 198232 - DNA, 519 bp, Homo sapiens
  misc_feature: GYAE6OF01AXF4C.18.59.F04.1.454.CMB.1.raw
  modified_base (511)..(511): a, c, t, g, unknown or other
  misc_feature (511)..(511): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcgaggggtttctaatcgtcttctctggctccagtctggcaacacggcctcctgaccatctcgtgggctccgaggctgaggacgagctgatttatactgcagctcatatacaagcagcagcactcaagtctacggactgggaccaaggtccaccgtccgtagtcacgtacccaacggaccccaacccngtcgtacc

SEQ ID NO: 198233 - DNA, 555 bp, Homo sapiens
  misc_feature: GYAE6OF01D48JM.18.59.F04.1.454.CMB.1.raw
  modified_base (372)..(372): a, c, t, g, unknown or other
  misc_feature (372)..(372): n is a, c, g, or t
tcagtacgagtatgcacgaccggtgctcgatttagtacacacacttagggattggggggggtctcaggaggcagcgctctcgggacgtctccaccatggcctggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcctggtaccaacagcaccaggcaaagcccccaaactcatgatttatgatgtcactaatcgccctcaggggtttctaatcgcttctctggctcaagtctggtcaacacggccctccngaccatctcgtcggctcgagctggagacgagctagatttacttactgcagtctacatactacaacgccaccagacacttctacttatcgtaccgttacggtaacgtcgggaaccctaacgggttcccacccggttaccgtaacggtccgaaccgaccccaacggacccccaaccccgtacccg

SEQ ID NO: 198234 - DNA, 589 bp, Homo sapiens
  misc_feature: GYAE6OF01AEXC2.18.59.F04.1.454.CMB.1.raw
  modified_base (228)..(228): a, c, t, g, unknown or other
  misc_feature (228)..(228): n is a, c, g, or t
  modified_base (252)..(252): a, c, t, g, unknown or other
  misc_feature (252)..(252): n is a, c, g, or t
  modified_base (305)..(305): a, c, t, g, unknown or other
  misc_feature (305)..(305): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataactntgtctcctggtaccaacagcaccaggacaaacgcccccaaactcatgtattangatgtacactaacgtcggccctgtagggtttctaatcgtcttctcgtcggctaccgaagtctggacaacgaccggtccctccctgaccctatcctcgtcgggcctccgaggtctaggacggacgaggtctagtattactacgtgcagtctacaatactaacaacgcctaacgacgtcctactctacttagtcgttaccgtacggaaccgtcgggaacccgtaaggtcccgaaccggttccgtacggtaccaccggaccccgaacggaccccctaacccgtaccg

SEQ ID NO: 198235 - DNA, 473 bp, Homo sapiens
  misc_feature: GYAE6OF01CJCJW.18.59.F04.1.454.CMB.1.raw
  modified_base (303)..(303): a, c, t, g, unknown or other
  misc_feature (303)..(303): n is a, c, g, or t
  modified_base (314)..(314): a, c, t, g, unknown or other
  misc_feature (314)..(314): n is a, c, g, or t
  modified_base (326)..(326): a, c, t, g, unknown or other
  misc_feature (326)..(326): n is a, c, g, or t
  modified_base (391)..(391): a, c, t, g, unknown or other
  misc_feature (391)..(391): n is a, c, g, or t
  modified_base (432)..(432): a, c, t, g, unknown or other
  misc_feature (432)..(432): n is a, c, g, or t
  modified_base (461)..(473): a, c, t, g, unknown or other
  misc_feature (461)..(473): n is a, c, g, or t
tcagtacgagtatgcacgaccggtgctcgatttagtacacacacttagggattgggggctttgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctcctgaccatcctctgggctccaggctggaggacgaggctgatttattacngcagctcatanacaagccaaccngcactctctatgtctcggaactgggaccaaggtcaccgtctaggcagcccaaggcccaacccctntcgtcactctcgttccccaccctcctccactacctcgtacngagccgggctcgggcaacgggcacatagnnnnnnnnnnnnn

SEQ ID NO: 198236 - DNA, 503 bp, Homo sapiens
  misc_feature: GYAE6OF01BLQT2.18.59.F04.1.454.CMB.1.raw
  modified_base (355)..(355): a, c, t, g, unknown or other
  misc_feature (355)..(355): n is a, c, g, or t
  modified_base (498)..(503): a, c, t, g, unknown or other
  misc_feature (498)..(503): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggcctcaggggttctaatcgcttctctggctccaagtctggcaacacggcctccctgaccatctctgggctccaggctgaggacgaggctgattattactgcagctcatanacaagcaccagcactctctattgtcttcggaactgggacctaaggtcaccgtctaggtcagcccaacggccaaccccactgtccactctcgttccccgcccttccctcactcctcgtactgacggcggctggcaggcgcatgnnnnnn

SEQ ID NO: 198237 - DNA, 505 bp, Homo sapiens
  misc_feature: GYAE6OF01BRDH3.18.59.F04.1.454.CMB.1.raw
  modified_base (434)..(434): a, c, t, g, unknown or other
  misc_feature (434)..(434): n is a, c, g, or t
  modified_base (500)..(505): a, c, t, g, unknown or other
  misc_feature (500)..(505): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttcaatcgcttctctggctccaagtctggcaacacggcctccctgaccatctctgggctccaggctgaggacgaggctgattattactgcagctcatatacaagcaccagcactctctatgtcttcggaactcgggaaccaaggtcaccgtcctaggtcagcccaaggcccaacccnctgcactctcgtccccacctcccaccatacctccgtactcggacgcggctggcacggcgcagtagnnnnnn

SEQ ID NO: 198238 - DNA, 505 bp, Homo sapiens
  misc_feature: GYAE6OF01BX1YL.18.59.F04.1.454.CMB.1.raw
  modified_base (305)..(305): a, c, t, g, unknown or other
  misc_feature (305)..(305): n is a, c, g, or t
  modified_base (359)..(359): a, c, t, g, unknown or other
  misc_feature (359)..(359): n is a, c, g, or t
  modified_base (367)..(367): a, c, t, g, unknown or other
  misc_feature (367)..(367): n is a, c, g, or t
  modified_base (418)..(418): a, c, t, g, unknown or other
  misc_feature (418)..(418): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcaccaggcaaacgcccccaaactcatgatttangatgtcactaatcgcctcgagggtttctaatcgcttctctgctcagtctgcacncgcctccngaccatctctcggctccgaggctgaggacgaggctgattatactgcagctnatatacagcaccagcactctctatgttccgtcggaacgtcgggaccaggtccaccgtcacggtcacgacccacggcccaacccgtac

SEQ ID NO: 198239 - DNA, 661 bp, Homo sapiens
  misc_feature: GYAE6OF01CZ3IV.18.59.F04.1.454.CMB.1.raw
  modified_base (224)..(224): a, c, t, g, unknown or other
  misc_feature (224)..(224): n is a, c, g, or t
  modified_base (248)..(248): a, c, t, g, unknown or other
  misc_feature (248)..(248): n is a, c, g, or t
tcagtacgagtatgcacgaccggtgctcgatttagtacacacacttagggagttggggggggtctcaggaggcagcgctctcgggacgtctccaccatggcctggctctgctattcctcaccctcctcactcagggcacagggtcctgggcccagtctgccctgactcagcctgcctcgtgtctggtctcctggacagtcgatcaccatctcctgcatggaacngcagtgacgttggtgttataactntgtctcgtgtaccaacagccaccaggacaaacgccccaaatcatgtactttatgatgtacactaacgtccgtacctcgtacgggtttactaacgtcgtcctttcgtcgttcggtacctaccgtaagttcgtacggacctaaaccgaccgggtccctacccgtagaaccctacgttaccgtccggtcggtcccttacccgacgggtacctagggaacggtacggacggtactacggttaatttaacgtacgtgtaccagtacctactaacgtaactaacgacgtaccaaccgtacgactaaccgtcttacgttagttccgttacgttaacggaaccgttcgggaacctaacgggtccctaacccggtcgttaacgggtccaaccggaccccaaccggacccctaaccccgtacg

SEQ ID NO: 198240 - DNA, 520 bp, Homo sapiens
  misc_feature: GYAE6OF01DUPBY.18.59.F04.1.454.CMB.1.raw
  modified_base (360)..(360): a, c, t, g, unknown or other
  misc_feature (360)..(360): n is a, c, g, or t
  modified_base (369)..(369): a, c, t, g, unknown or other
  misc_feature (369)..(369): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctctggtaccaacagcaccagcaaagcccccaaactcatgatttatgatgtcactaatcggccctgagggtttctaatcgcttctctgctccaagtctggcaacncggcctccngaccatctctgggcctccgaggctggaggacgaggctgattattactgcagctcataatacaagcacagcactctactatcgtaccgttacggaacgtcgggaaccacggtcacccgttctacggtcacgcccaacggcccaacccgtacg

SEQ ID NO: 198241 - DNA, 516 bp, Homo sapiens
  misc_feature: GYAE6OF01AY18L.18.59.F04.1.454.CMB.1.raw
  modified_base (253)..(253): a, c, t, g, unknown or other
  misc_feature (253)..(253): n is a, c, g, or t
  modified_base (482)..(482): a, c, t, g, unknown or other
  misc_feature (482)..(482): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactntgtctcctggtaccaacagcaccaggcaaacgcccccaaactcatgatttatgatgtcactaatcggcctctagggtttctaatcgcttctctggctcaagtctgacacacggcctcctgaccatctcgtgggctcgagctgaggacgaggctagattatacgtgctagctcatatacaagccacagcactctctatcgttctacggacgtcgggacctaaggttaccnccgtaggcacgacccaaggcccaacccgtctacg

SEQ ID NO: 198242 - DNA, 585 bp, Homo sapiens
  misc_feature: GYAE6OF01AL50C.18.59.F04.1.454.CMB.1.raw
  modified_base (355)..(355): a, c, t, g, unknown or other
  misc_feature (355)..(355): n is a, c, g, or t
tcagtacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggagcttggtaagccggggggtcctagactcccctgtacagcctctggattcactttcagtaaggcctggatgaactgggtccgccaggcttccgggaaggctggagtgggttggccgtattagaagcaaagctaanagttacgcgacagcatatgctgcgtcggtgaaaggcaggttcaccgtctccagaatgatacaaagaacacggacgtatactagacaatagaacagaccgtacgaaacgacggacgacgtaccgtagtattacgtacgtacgtagacgtaaggtaggtagttacgtagtttaggggtaggttagtacggacggtaaacgggggggtactacggtaacgcgtaaggtacggg

SEQ ID NO: 198243 - DNA, 517 bp, Homo sapiens
  misc_feature: GYAE6OF01CH2QE.18.59.F04.1.454.CMB.1.raw
  modified_base (430)..(430): a, c, t, g, unknown or other
  misc_feature (430)..(430): n is a, c, g, or t
  modified_base (443)..(443): a, c, t, g, unknown or other
  misc_feature (443)..(443): n is a, c, g, or t
  modified_base (509)..(509): a, c, t, g, unknown or other
  misc_feature (509)..(509): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcaccaggcaaacgcccccaaactcatgatttatgatgtacactaatccggccctcaggggtttctaatcgtcttctctggctccaagtctggcaacacggcctccctgaccatctctgggcctcaggctgaggacgaggctgtattatactgcagctnatatacagcacancactcaagtctacggaactggaaccaggtccaccgtctacgtcacgacccaacggacccaaccccnctgtaccc

SEQ ID NO: 198244 - DNA, 494 bp, Homo sapiens
  misc_feature: GYAE6OF01EI3NX.18.59.F04.1.454.CMB.1.raw
  modified_base (233)..(233): a, c, t, g, unknown or other
  misc_feature (233)..(233): n is a, c, g, or t
  modified_base (409)..(409): a, c, t, g, unknown or other
  misc_feature (409)..(409): n is a, c, g, or t
  modified_base (423)..(423): a, c, t, g, unknown or other
  misc_feature (423)..(423): n is a, c, g, or t
  modified_base (488)..(490): a, c, t, g, unknown or other
  misc_feature (488)..(490): n is a, c, g, or t
  modified_base (493)..(494): a, c, t, g, unknown or other
  misc_feature (493)..(494): n is a, c, g, or t
tcagtacgagtatgcacgaccggtgctcgatttagtacacacacttagggattgggggctttgcctgggtccttgggcccagtctgccctgactcagcctgcctccgtgtctgggtctcctggacagtcggatcaccatctcctgcactggaaccagcagtgacgttggtggttataactatgtctcctggtaccaacagcacccaggcaaagcccccaaactcatgatttangatgtcactaatcggcctcaggggtttctaatcgcttctctggctccaagtctggcaacacggcctccctgaccatctctgggctccagctgaggacgagctgattatactgcagctcatatacagcaccagcactctctatgtcttcggaactgggacaaggtcaccgtcagtcngccaagccaacccntgcactctcgttcccaccctcctccatctcgtactcgacgcgggctgggacaggccacagtacgnnntcnn

SEQ ID NO: 198245 - DNA, 530 bp, Homo sapiens
  misc_feature: GYAE6OF01DJF9C.18.59.F04.1.454.CMB.1.raw
  modified_base (228)..(228): a, c, t, g, unknown or other
  misc_feature (228)..(228): n is a, c, g, or t
  modified_base (428)..(428): a, c, t, g, unknown or other
  misc_feature (428)..(428): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataactatgtctcctggtaccaacagcaccaggcaaacgcccccaaactcatgatttatgatgccactaatccggccctcgtagggtttctaatcgcttctctggctcaagtctggcaacacggcctccctgacccatctcgtgggcctccgaggctggaggacgaggctagatttattacgngcagctcataatacaagccaccagctactctctattgtcgttcggaacgtcgggacctaaggtccaccgtctaggtcacgacccgaacgcccaacccctacg

SEQ ID NO: 198246 - DNA, 586 bp, Homo sapiens
  misc_feature: GYAE6OF01DLUQX.18.59.F04.1.454.CMB.1.raw
  modified_base (344)..(344): a, c, t, g, unknown or other
  misc_feature (344)..(344): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttaatactatgtctcctggtaccaacagcacccaggcaaacgccccaaatcatgatttatgatgtcactaatcgccctgtagggtttctatcgtcttntctcggctcctaagtctggacaacacgccctcctgaccatcgtctgggcctccgaggtctgacgggacgtaggtcctgtaattacgttctcgtacagtctacattaactaaccgtaacgccaaccagtacctacttcctacttagttcgttaccgttacggtaaacgttcgggaaaccgtaacggtcccgtacccgttaccgttaacggacccaccgggaccccgtaacgggtaaacccccc

SEQ ID NO: 198247 - DNA, 519 bp, Homo sapiens
  misc_feature: GYAE6OF01DCSYM.18.59.F04.1.454.CMB.1.raw
  modified_base (427)..(427): a, c, t, g, unknown or other
  misc_feature (427)..(427): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggacaaacgcccccaaactcatgtatttatgatgtcactaatcggcctcgagggtttctaatcgcttctctggctaccaagtctggacacgacggcctccctgaccatctctgggcctcgaggctgaggacgaggctagattatcngcagctcatatacaagccacagctactctctatcgtctacggactgggaccaaggtcctaccgtctacggtacacgacccaacgcccaaccc

SEQ ID NO: 198248 - DNA, 500 bp, Homo sapiens
  misc_feature: GYAE6OF01BLLB2.18.59.F04.1.454.CMB.1.raw
  modified_base (489)..(489): a, c, t, g, unknown or other
  misc_feature (489)..(489): n is a, c, g, or t
  modified_base (495)..(500): a, c, t, g, unknown or other
  misc_feature (495)..(500): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtctaggtcagcccaaggcccaacccactgtccactctcgttccccaccctcctccatacctcgtactgagcgggctggcaggcncatagnnnnnn

SEQ ID NO: 198249 - DNA, 522 bp, Homo sapiens
  misc_feature: GYAE6OF01DRYA2.18.59.F04.1.454.CMB.1.raw
  modified_base (302)..(302): a, c, t, g, unknown or other
  misc_feature (302)..(302): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcaccagcaaagcccccaaatcatgatttangatgtacactaatcggccctcgtagggtttctaatcgcttctctgctcaagtctggcaacacggcctccctgaccatctcgtcgggcctccgaggctaggaggacgagctagattatactgcagctcatataacaagcacagcactctctatcgtcttacggaacgtcgggaacaaggtccaccgtctaggtcaacgacccaacggcccaaccccgtacg

SEQ ID NO: 198250 - DNA, 335 bp, Homo sapiens
  misc_feature: GYAE6OF01CQ3DQ.18.59.F04.1.454.CMB.1.raw
  modified_base (330)..(335): a, c, t, g, unknown or other
  misc_feature (330)..(335): n is a, c, g, or t
tcagtacgagtatgcacgaccggtgctcgatttagtacacacacttagggattggggagagaagacaggattcaggacaatctccagcatggccggcttccctctcctcctcaccctcctcactcactgtgcagggtcctgggcccagtctgtgctgactcagccaccctcagcgtctcggggacccccgggcaggagggtcaccatctcttgttctggaagcagcctaccaacatcggaagtcacgcccgaaggcctcgcccccctcggtcactctcgttccccaccctcctccatactcgtactgagccgggctggcaaggcgcatgnnnnnn

SEQ ID NO: 198251 - DNA, 550 bp, Homo sapiens
  misc_feature: GYAE6OF01DD9EN.18.59.F04.1.454.CMB.1.raw
  modified_base (227)..(227): a, c, t, g, unknown or other
  misc_feature (227)..(227): n is a, c, g, or t
  modified_base (241)..(241): a, c, t, g, unknown or other
  misc_feature (241)..(241): n is a, c, g, or t
  modified_base (302)..(302): a, c, t, g, unknown or other
  misc_feature (302)..(302): n is a, c, g, or t
  modified_base (436)..(436): a, c, t, g, unknown or other
  misc_feature (436)..(436): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccngcagtgacgttggnggttataactatgtctcctggtaccaacagcaccagcaaacgccccaaactcatgatttangatgtcagtaatcgccctgtagggttactaatcgcttctctcggctccgaagtctcggcaacgaccggtcctcccgtgtaccacttctcctcgggcctccgagctggaggacgaggcctgtattattacgtgcngtctacatatacaatcagctagactactacgaagttccgtaccggaacgtacgggaaccgtaaggtccaccgtaccgtaggtaccacgacccacggacccaacccgtcgtaccg

SEQ ID NO: 198252 - DNA, 323 bp, Homo sapiens
  misc_feature: GYAE6OF01AQGR9.18.59.F04.1.454.CMB.1.raw
  modified_base (229)..(229): a, c, t, g, unknown or other
  misc_feature (229)..(229): n is a, c, g, or t
  modified_base (315)..(323): a, c, t, g, unknown or other
  misc_feature (315)..(323): n is a, c, g, or t
tcagtacgagtatgcacgaccggtgctcgatttagtacacacacttagggattggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaanatcggaagtcagcccaaggctgcccctcggtcactctgttcccgcctcctccatactcgtactgagcggctggcaaggcgcatagnnnnnnnnn

SEQ ID NO: 198253 - DNA, 556 bp, Homo sapiens
  misc_feature: GYAE6OF01BV1FF.18.59.F04.1.454.CMB.1.raw
  modified_base (504)..(504): a, c, t, g, unknown or other
  misc_feature (504)..(504): n is a, c, g, or t
tcagtacgagtatgcacgaccggtgctcgatttagtacacacacttagggattgggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtccgggggaggcttggtccagcctggggggtccctgaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccgtctccagaatgatacaaagaacacggcgtatctgacaatgaacagacctagaaaccgaggacgacggccgtagtattactagtactagacaggtggtagttanagttggggtagttagtacggtacggaacggggggtactacgtacgcgtacgg

SEQ ID NO: 198254 - DNA, 766 bp, Homo sapiens
  misc_feature: GYAE6OF01EZLXL.18.59.F04.1.454.CMB.1.raw
  modified_base (216)..(216): a, c, t, g, unknown or other
  misc_feature (216)..(216): n is a, c, g, or t
tcagtacgagtatgcacgaccggtgctcgattttagtacacacacttagggattgggtgggggtctcgaggaggcagcgctcgtcgggacgtcctccaccagtcggccgtgggctctgcttacttccctccaccctcctcactcgaggcacgtacgggtccgtcgggcccagtctcgccctgactcacgcctcgccttcgtgtcgtcggtcctcgnggacagtcgactccacctattcctccgtgacctacgtacggaaccagacgtaggtacggttacgggttttgggtttacggtttaaacttaacgttagttcgttccttccgttacggtaaccaacgacgaccacccgacggaaccaaacccgaaccccctaaactcagtacgttaatttagagtacttcgtacctaacttaacgtcccggtacccgttacggttacgggtttacttaacgtccgttactttccgttcgtcggtcctacgtaacgttcgtacggaccaaccgaccggtccctaccgtacgacctacttcgtcggtcggtcctacggacgtcgtacgggaacggacggtacgtcgtagttaagttttaacttacgtcgactacgtctacgtaacttaactaaccgacgacctaccgacgtacctaccgttcttacgtttacgttcgttaccgttaacgggtaaccggttacggaacccggtacgttacccgtaccgttaccgttacggacctaacccggacccgaacccgtacccctaacccg

SEQ ID NO: 198255 - DNA, 588 bp, Homo sapiens
  misc_feature: GYAE6OF01DP5UQ.18.59.F04.1.454.CMB.1.raw
  modified_base (223)..(223): a, c, t, g, unknown or other
  misc_feature (223)..(223): n is a, c, g, or t
  modified_base (300)..(300): a, c, t, g, unknown or other
  misc_feature (300)..(300): n is a, c, g, or t
  modified_base (347)..(347): a, c, t, g, unknown or other
  misc_feature (347)..(347): n is a, c, g, or t
  modified_base (356)..(356): a, c, t, g, unknown or other
  misc_feature (356)..(356): n is a, c, g, or t
  modified_base (361)..(361): a, c, t, g, unknown or other
  misc_feature (361)..(361): n is a, c, g, or t
  modified_base (580)..(588): a, c, t, g, unknown or other
  misc_feature (580)..(588): n is a, c, g, or t
tcagtacgagtatgcacgaccggtgctcgatttagtacacacacttagggattgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaacgccccaaatcatgatttangatgtcagtaactcggcctcgtagggtttctaatcgcttctctggctcaagtctggcaacgcggccctcctgaaccntctcgtcggctccgaggctggacgacgaggctagtatttacttacgngacagctanaatanacaacgcacagctactcgtctagtgtcgtacggaacgtcggaccagtccaccgtactaacgtcgaacgacccgaaacggacccctaacccctcgtacgtacctaccgttccttacccgtttaccccacccccttaccttacccctaactttacccgtaccggtttaactcgggacgggtcccgggtacgtacgggccgaaacggtccgacgtagtacgnnnnnnnnn

SEQ ID NO: 198256 - DNA, 548 bp, Homo sapiens
  misc_feature: GYAE6OF01CVKFQ.18.59.F04.1.454.CMB.1.raw
  modified_base (228)..(228): a, c, t, g, unknown or other
  misc_feature (228)..(228): n is a, c, g, or t
  modified_base (248)..(248): a, c, t, g, unknown or other
  misc_feature (248)..(248): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttgatggttanaactatgtctcctggtaccaacagcacccaggacaaacgcccccaaactcactgatttatgatgtcagtaatcggccctgtagggtttctaatccgcttctctggctcaagtctggcaacgacggccctccctacgacctatcctcgtgggccttccgagggctggagggacgaggtctgtattattacgtgcagctgaatatacaagcaccagtcactctactatcgtcttacggaacgtagggaccctaaggtccaccgttccgtacggtacaccggacccaacggccctaaaccccg

SEQ ID NO: 198257 - DNA, 679 bp, Homo sapiens
  misc_feature: GYAE6OF01B40OU.18.59.F04.1.454.CMB.1.raw
  modified_base (210)..(210): a, c, t, g, unknown or other
  misc_feature (210)..(210): n is a, c, g, or t
  modified_base (216)..(216): a, c, t, g, unknown or other
  misc_feature (216)..(216): n is a, c, g, or t
  modified_base (227)..(227): a, c, t, g, unknown or other
  misc_feature (227)..(227): n is a, c, g, or t
  modified_base (252)..(252): a, c, t, g, unknown or other
  misc_feature (252)..(252): n is a, c, g, or t
  modified_base (309)..(309): a, c, t, g, unknown or other
  misc_feature (309)..(309): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacgagggtcctgggcccagtctgccctgactcagcctgcctcgtgtctgggtctcctggacagtcgatcaccntctccngcactggaacngcagtgacgttggagtttataactntgtctcgtaggtaccaacagccaccgaggacaaaccgaccccaaatcatagatttangtatcgtacactaacgtccgtcctgtagggtttacaacttcgtccttcgtctcggtacctacgtaagttccgacggaacctaaccgtacccgtcccttaccccgtagaccctacgttccgttaccggtcgggccttaccgacgggtcttacgggaacgggacggtaacggtcgttaagtactttaacgttaacgtcgactaacgtctaactaacgttaactaaccgaacgaccctaaccgaacgacccttaacttccttacttaacgttccgttaccgttaccggaaacgtttcggggaaactaaccggtccgtaacccgtaccgtaacggtaccgacccgaacccgacggtaacccccaacccgttacg

SEQ ID NO: 198258 - DNA, 516 bp, Homo sapiens
  misc_feature: GYAE6OF01DMKRT.18.59.F04.1.454.CMB.1.raw
  modified_base (252)..(252): a, c, t, g, unknown or other
  misc_feature (252)..(252): n is a, c, g, or t
  modified_base (440)..(440): a, c, t, g, unknown or other
  misc_feature (440)..(440): n is a, c, g, or t
  modified_base (511)..(516): a, c, t, g, unknown or other
  misc_feature (511)..(516): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgcccccaaactcatgatttatgatgtcactaatcggccctnaggggtttctaatcgcttctctggctccaagtctggccaacacggccctcctgaccatcctctgggcctccaggctgaggacgaggctgatttattactgcagctcataatacaagcaccagctactctctatgtcttcggaactggaccaaggtccacgtcctaggtcacgcccaacgcccaacccnctcgtcactctcgttcccccgcctccctccatacctcgtactgacgccgggtctgggcacggcgcatacgnnnnnn

SEQ ID NO: 198259 - DNA, 565 bp, Homo sapiens
  misc_feature: GYAE6OF01AJJV0.18.59.F04.1.454.CMB.1.raw
  modified_base (228)..(228): a, c, t, g, unknown or other
  misc_feature (228)..(228): n is a, c, g, or t
  modified_base (366)..(366): a, c, t, g, unknown or other
  misc_feature (366)..(366): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataactatgtctcctggtaccaacagcaccaggcaaacgcccccaaactcatgatttatgatgtcactaactcggccctgtacggggtttctaatcgcttctctggctcagtctggcaacncggcctcctgaccatctcgtggcctccgaggctaggacggacgaggtctagtatttagtactgctagctacattactaacaacgaccaccgagcctaacttctacttatcgttaccgttacggaacgttcgggaacctaacggtcccacccggttaccgtacggtaccacggaccccaaacgggccccaaaccccgtcg

SEQ ID NO: 198260 - DNA, 678 bp, Homo sapiens
  misc_feature: GYAE6OF01DJ8O9.18.59.F04.1.454.CMB.1.raw
  modified_base (209)..(209): a, c, t, g, unknown or other
  misc_feature (209)..(209): n is a, c, g, or t
  modified_base (245)..(245): a, c, t, g, unknown or other
  misc_feature (245)..(245): n is a, c, g, or t
tcagtacgagtatgcacgaccggtgctcgatttagtacacacacttagggattgggggctggggtctcaggaggcagcgctctcgggacgtctccaccatggcctgggctctgctattccctcaccctcctcactcgagggcacgacgggtccgtcgggcccagtctcgccctgactcacgcctgcctcgtgtcgtggtctccgtgacngtcgatccacatcctcctgacctacgtacggaaccngcaggttcgtacggtttggttagttaataacttagttcgtcctccgtacggtaaccaacgacgccaacccgaggaaccaaaccgacccccaaactccaatgtaatttagtagtattacgtactaaacttaacgtccggtccctacggttacgggtttactacgtcgtcttcttcgtcgtacctacgtaacgtcgtacgaccaacgcccggtccctcctacgtacctacgttcctcggtacggtcctaccgaggtcgtacggacggacggtaggtctagttactttacgtactcgacgatcctatagtaactacgaacgtaccaaccgacgtacctaacgtaccgtaacgtccgttacggacggtaaccggaccgtaacggttccacccggttactacggtacgacccgacccaaccggaccccaacccgtacg

SEQ ID NO: 198261 - DNA, 323 bp, Homo sapiens
  misc_feature: GYAE6OF01AZMQQ.18.59.F04.1.454.CMB.1.raw
  modified_base (192)..(192): a, c, t, g, unknown or other
  misc_feature (192)..(192): n is a, c, g, or t
  modified_base (221)..(221): a, c, t, g, unknown or other
  misc_feature (221)..(221): n is a, c, g, or t
  modified_base (313)..(313): a, c, t, g, unknown or other
  misc_feature (313)..(313): n is a, c, g, or t
  modified_base (319)..(323): a, c, t, g, unknown or other
  misc_feature (319)..(323): n is a, c, g, or t
tcagtacgagtatgcacgaccggtgctcgatttagtacacacacttagggattggggagagaagacaggattcaggacaatctccagcatggccggcttccctctcctcctcaccctcctcactcactgtgcagggtcctgggcccagtctgtgctgactcagccaccctcagcgtctcgggacccccgggnaggagggtcaccatctcttgttctggaancagctccaacatcggaagtcagcccaaggctcgccccctggtcactctcgttcccaccctcctccatactcgtactgagcggctggcaggcncatagnnnnn

SEQ ID NO: 198262 - DNA, 628 bp, Homo sapiens
  misc_feature: GYAE6OF01EIG9D.18.59.F04.1.454.CMB.1.raw
  modified_base (272)..(272): a, c, t, g, unknown or other
  misc_feature (272)..(272): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctctggtaccaacngcaccaggacaaacgacccccaaactcatgtatttatgatgtacactaatccggccctcgtagggtttctaatcgtcttctctcggcctccaagttcgtcggtaccaaccgaccggcccttccccgtacgtaccctattcccttccggtcgggtcctacccgaggtccgtagggacgggaccgagggtccttagtactttaacgttacgtgcctagtctactaataatacgaacgtccaaccacgacctacttcctacttacgttcgttaccgttaccgggaacgttaccgggaaccgtaacgggttcccaacccgttccgtaaggtacccaacggaccccgaaacggtacccccc

SEQ ID NO: 198263 - DNA, 523 bp, Homo sapiens
  misc_feature: GYAE6OF01EDHK7.18.59.F04.1.454.CMB.1.raw
  modified_base (325)..(325): a, c, t, g, unknown or other
  misc_feature (325)..(325): n is a, c, g, or t
  modified_base (376)..(376): a, c, t, g, unknown or other
  misc_feature (376)..(376): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctnaggggtttctaatcgcttctctggctccaagtctggcaacacggcctcccngaccatcctcgtgggcctccgaggctggaggacgaggctgtatttattactgcagtctacatactaacaagccaccagcactctctatgtccttacggaacgtcgggaccaggtccacgtctagtcacgcccaacgcccaaccctcg

SEQ ID NO: 198264 - DNA, 601 bp, Homo sapiens
  misc_feature: GYAE6OF01DZ55D.18.59.F04.1.454.CMB.1.raw
  modified_base (252)..(252): a, c, t, g, unknown or other
  misc_feature (252)..(252): n is a, c, g, or t
  modified_base (268)..(268): a, c, t, g, unknown or other
  misc_feature (268)..(268): n is a, c, g, or t
  modified_base (303)..(303): a, c, t, g, unknown or other
  misc_feature (303)..(303): n is a, c, g, or t
  modified_base (468)..(468): a, c, t, g, unknown or other
  misc_feature (468)..(468): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactntgtctctggtaccaanagcaccaggacaaacgccccaaatcatgtatttangatgtacactaactccgcctgtagggtttactaacgtcgtcttctcgtggcctccaagtctcggacaacgaccggtccctcctcgaccctagtcctcgtcgggccttcgacgtacgtggacggacgaggtcctaggtactttaacttacgtacgactagtcctanaattaactaacgaacgcccaaccgagacctaacgtctacgtattcggttccttacggaacgtcgggtaaccacgggtccacccgttaccgtacggtcccaacggtaccccgaacgtccccaaaccccgtaccg

SEQ ID NO: 198265 - DNA, 506 bp, Homo sapiens
  misc_feature: GYAE6OF01CL3JW.18.59.F04.1.454.CMB.1.raw
  modified_base (228)..(228): a, c, t, g, unknown or other
  misc_feature (228)..(228): n is a, c, g, or t
  modified_base (242)..(242): a, c, t, g, unknown or other
  misc_feature (242)..(242): n is a, c, g, or t
  modified_base (307)..(307): a, c, t, g, unknown or other
  misc_feature (307)..(307): n is a, c, g, or t
  modified_base (365)..(365): a, c, t, g, unknown or other
  misc_feature (365)..(365): n is a, c, g, or t
  modified_base (373)..(373): a, c, t, g, unknown or other
  misc_feature (373)..(373): n is a, c, g, or t
  modified_base (376)..(376): a, c, t, g, unknown or other
  misc_feature (376)..(376): n is a, c, g, or t
  modified_base (411)..(411): a, c, t, g, unknown or other
  misc_feature (411)..(411): n is a, c, g, or t
  modified_base (413)..(413): a, c, t, g, unknown or other
  misc_feature (413)..(413): n is a, c, g, or t
  modified_base (418)..(418): a, c, t, g, unknown or other
  misc_feature (418)..(418): n is a, c, g, or t
  modified_base (422)..(422): a, c, t, g, unknown or other
  misc_feature (422)..(422): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggnggttataactatgtctcctggtaccaacagccaccaggacaaacgcccccaaactcatgatttangatgtcactaatcggccctgtagggttctaatcgtcttctctgctcagtctggcaacncgcctccnacntctctggctcgagctggagacgagctgattatcgncngctanatanaacagccacagcactctctatgtcttcggaactcgggacacggtcctaccgtctacggaccacgacccgacgcccaacccgtac

SEQ ID NO: 198266 - DNA, 534 bp, Homo sapiens
  misc_feature: GYAE6OF01EIKW1.18.59.F04.1.454.CMB.1.raw
  modified_base (323)..(323): a, c, t, g, unknown or other
  misc_feature (323)..(323): n is a, c, g, or t
  modified_base (372)..(372): a, c, t, g, unknown or other
  misc_feature (372)..(372): n is a, c, g, or t
  modified_base (421)..(421): a, c, t, g, unknown or other
  misc_feature (421)..(421): n is a, c, g, or t
  modified_base (447)..(447): a, c, t, g, unknown or other
  misc_feature (447)..(447): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcaccaggcaaacgcccccaaatcatgatttatgatgtcactaatcggcctnaggggtttcaatcgcttctctggctccaagtctggcaacacggcctccngaccatctctggctccgagctggagacgaggctgattatactgcagctnatatacaagccacagcactctctatntccgttacggtaacgtcgggaacccaaggttccgaacccgttccgtaacgggtccaacggaccccaacgggccccaaacccgtaccg

SEQ ID NO: 198267 - DNA, 541 bp, Homo sapiens
  misc_feature: GYAE6OF01A6QVT.18.59.F04.1.454.CMB.1.raw
tcagtacgagtatgcacgaccggtgctcgatttagtacacacacttagggattggggggggtctcaggaggcagcgctctagggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcctggtaccaacagcacccaggcaaacgcccccaaactcatgatttatgatgtcactaatcggccctcgtaggggtttctaatcgcttctctggctccaagtctggcaacacggcctccctgaccatcctctgggctccaggctgaggacgaggctgatttactactgcagctcaatataacaagccaaccacgcacctctcattcgtacctttacggaacgtcgggaaccaagggtcccaacccggtctacggtccacgaccccgaacgccccaacccgtacg

SEQ ID NO: 198268 - DNA, 510 bp, Homo sapiens
  misc_feature: GYAE6OF01ERZB8.18.59.F04.1.454.CMB.1.raw
  modified_base (269)..(269): a, c, t, g, unknown or other
  misc_feature (269)..(269): n is a, c, g, or t
  modified_base (405)..(405): a, c, t, g, unknown or other
  misc_feature (405)..(405): n is a, c, g, or t
  modified_base (418)..(418): a, c, t, g, unknown or other
  misc_feature (418)..(418): n is a, c, g, or t
  modified_base (445)..(445): a, c, t, g, unknown or other
  misc_feature (445)..(445): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcctggtaccaanagcaccaggcaaacgcccccaaatcatgatttatgatgtcactaatcggccctcgagggttttcaatcgcttctctggctccaagtctggcaacacggcctcctgaccatctctgggcctccgaggctgaggacgnggctgattatacngcagctcaatatacaagcacagcactntctatcgtcttacggacgtggaccaaggtcaccgtctaggtccagacccaaggcccaacccgtcg

SEQ ID NO: 198269 - DNA, 759 bp, Homo sapiens
  misc_feature: GYAE6OF01DZBR5.18.59.F04.1.454.CMB.1.raw
  modified_base (259)..(259): a, c, t, g, unknown or other
  misc_feature (259)..(259): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtcgtgggtctccgtggacagtcgatcaccatcctctgcacgtcggaaccagcagtgtacggttggtagttataactnttcgttcttccgtacggtaaccaacgacgaccaacccgaggaccaaaccgacccccaaactcaactagtaatttatagtacttacgtactaactaacgtcccggtcccttacggttacggggtttactaacgttccgtaccttcctcgtcggtcctaccgtaacgttcgtacggaccaacgtacccggtcccttaccgtacgaccctacttccgtcgtcgggcctccggagggtctacgggaacgggaccggtacgggtacctaggttaacttttaacttaccgtcggtacctaacgtccttaactaagttaacctaaaccgaaccgacctaacccgaacgtacccttaccgttaccttacttaacgtttccggttacccggttaaccgggtaaccggtaccggggtaaacccgtaacgggttaccccgtaccccggttaccgtaaccgggttaccaacccggtacccccggaaacccggtccccctaaaccccgtaccg

SEQ ID NO: 198270 - DNA, 540 bp, Homo sapiens
  misc_feature: GYAE6OF01ES9MP.18.59.F04.1.454.CMB.1.raw
  modified_base (228)..(228): a, c, t, g, unknown or other
  misc_feature (228)..(228): n is a, c, g, or t
  modified_base (303)..(303): a, c, t, g, unknown or other
  misc_feature (303)..(303): n is a, c, g, or t
  modified_base (403)..(403): a, c, t, g, unknown or other
  misc_feature (403)..(403): n is a, c, g, or t
  modified_base (426)..(426): a, c, t, g, unknown or other
  misc_feature (426)..(426): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataactatgtctcctggtaccaacagcaccaggcaaagcccccaaactcatgatttangatgtcactaatcgccctcgtagggtttctaatcgcttctctggcctcaagtctgcaacacgcctcctgaccatctcgtggcctccaggctgacggacgnggctgatttactactgccagctnaatactaacagccacagcactctctattcgttcgttaccggaagttcgggaaccctaaggtcccaacccggttccgacggtaccacgaccccgtaacggccctaaccccgtacg

SEQ ID NO: 198271 - DNA, 593 bp, Homo sapiens
  misc_feature: GYAE6OF01D5AVF.18.59.F04.1.454.CMB.1.raw
  modified_base (229)..(229): a, c, t, g, unknown or other
  misc_feature (229)..(229): n is a, c, g, or t
  modified_base (248)..(248): a, c, t, g, unknown or other
  misc_feature (248)..(248): n is a, c, g, or t
  modified_base (253)..(253): a, c, t, g, unknown or other
  misc_feature (253)..(253): n is a, c, g, or t
  modified_base (368)..(368): a, c, t, g, unknown or other
  misc_feature (368)..(368): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttanaactntgtctcctggtaccaacagcaccaggcaaacgcccccaaactcatcgatttatgatgtacactaatccggccctcgtagggtttcaatcgtcttctcgtgctcaagtctgcaacncgcctcctgaccatctcgtcgggcctccgagctggacggacgaggctgtaatttacttactgcagtctactataataacgaagacgaagacacgccacgttacctaaacgttccgtttaccggaaacgttacggggtaaaccctaagggttaccctaacccgttaccgtaacgggtacctaacccggaccccgaaacgggacccccctaaaccccgcgttacccg

SEQ ID NO: 198272 - DNA, 509 bp, Homo sapiens
  misc_feature: GYAE6OF01A86J6.18.59.F04.1.454.CMB.1.raw
  modified_base (436)..(436): a, c, t, g, unknown or other
  misc_feature (436)..(436): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcctggtaccaacagcacccaggcaaacgcccccaaactcatgatttatgatgtcactaatcgcctcgagggtttctaatcgcttctctgctcagtctgcaacacgcctccctgacctatctctcgggctccgaggctgaggacgaggctgattatactgcagctcatatacaagcaacngacactctctatcgtctacggacgtcggacaaggtcaccgtctaggtcacgacccaacggcccaacccgtacg

SEQ ID NO: 198273 - DNA, 551 bp, Homo sapiens
  misc_feature: GYAE6OF01E44ZR.18.59.F04.1.454.CMB.1.raw
  modified_base (533)..(533): a, c, t, g, unknown or other
  misc_feature (533)..(533): n is a, c, g, or t
  modified_base (543)..(543): a, c, t, g, unknown or other
  misc_feature (543)..(543): n is a, c, g, or t
tcagtacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccggggggtccttagactcccctgtacagcctctggattcacttcagtaaggcctggatgaactgggtccgccaggctccgaggggaaggggctggagtggggttggaccgtataaaaccaaactgatggtgggacaacagactagctgcacccgtgaaacggcagattcaccatctcaagagatgattacaaaagcacgctgtatctgacaaatagaacagcctagagaaccgagacacagccgtagtattactcgtaccacactcccctagaacgtcgactaacctactactactacgtanacggcctcgngggacccg

SEQ ID NO: 198274 - DNA, 534 bp, Homo sapiens
  misc_feature: GYAE6OF01DNPPV.18.59.F04.1.454.CMB.1.raw
  modified_base (228)..(228): a, c, t, g, unknown or other
  misc_feature (228)..(228): n is a, c, g, or t
  modified_base (242)..(242): a, c, t, g, unknown or other
  misc_feature (242)..(242): n is a, c, g, or t
  modified_base (247)..(247): a, c, t, g, unknown or other
  misc_feature (247)..(247): n is a, c, g, or t
  modified_base (268)..(268): a, c, t, g, unknown or other
  misc_feature (268)..(268): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggngttanaactatgtctctggtaccaanagcaccaggcaaacgcccccaaatccatgatttatgatgtcactaatcggccctcgtagggtttactaactcgtccttctcgtggtctcctaaagtctggacaacgaccggccctacccgtgaccctatccgtctcgggctccgaggtctggacggacgaggctagtattaataatgcagctacatactacaagcaacagcactctctatcgtctacggactggacagtcaccgtctaggtcacgcccaacggtccaacccgtacg

SEQ ID NO: 198275 - DNA, 605 bp, Homo sapiens
  misc_feature: GYAE6OF01CPHRT.18.59.F04.1.454.CMB.1.raw
  modified_base (229)..(229): a, c, t, g, unknown or other
  misc_feature (229)..(229): n is a, c, g, or t
  modified_base (253)..(253): a, c, t, g, unknown or other
  misc_feature (253)..(253): n is a, c, g, or t
tcagtacgagtatgcacgaccggtgctcgatttagtacacacacttagggagttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggagttataactntgtctctggtaccaacagcaccaggacaaacgcccccaaactcatgtattatgtatgtacactaacgtccggtccctacgtagggttactaactcgtcttcgtctggtctccgaagttctcggacaacgaccggtcctcccgtacgacctactcgtacgtcgggcctccgaggtctaggacggacgacggtctagtatttaacgttactcgctacgtctacgtataactaacgacgacctacacgctaacgtctacttacgttcgtccgttacggaacgtacgggtacctaaggttcccgaccgttaccgtacggtccacggaccccaaccggtcccctaaccccgttaccg

SEQ ID NO: 198276 - DNA, 501 bp, Homo sapiens
  misc_feature: GYAE6OF01D7FXS.18.59.F04.1.454.CMB.1.raw
  modified_base (246)..(246): a, c, t, g, unknown or other
  misc_feature (246)..(246): n is a, c, g, or t
  modified_base (322)..(322): a, c, t, g, unknown or other
  misc_feature (322)..(322): n is a, c, g, or t
  modified_base (421)..(421): a, c, t, g, unknown or other
  misc_feature (421)..(421): n is a, c, g, or t
  modified_base (498)..(498): a, c, t, g, unknown or other
  misc_feature (498)..(498): n is a, c, g, or t
tcagtacgagtatgcacgaccggtgctcgatttagtacacacacttagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttanaactatgtctcctggtaccaacagcaccaggcaaagcccccaaactcatgatttatgatgtcactaatcggccctnaggggtttctaatcgcttctctggctccaagtctggcaacacggcctcctgaccatctctgggctcaggctgaggacgagctgattattactgcagctnataatacaagcagcagcactcaagtcttcggaactgggaccaaggtcaccgtctaggcagacccaaggcccacccgntcg

SEQ ID NO: 198277 - DNA, 618 bp, Homo sapiens
  misc_feature: GYAE6OF01BEFM6.18.59.F04.1.454.CMB.1.raw
  modified_base (228)..(228): a, c, t, g, unknown or other
  misc_feature (228)..(228): n is a, c, g, or t
  modified_base (247)..(247): a, c, t, g, unknown or other
  misc_feature (247)..(247): n is a, c, g, or t
  modified_base (252)..(252): a, c, t, g, unknown or other
  misc_feature (252)..(252): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttanaactntgtctcctggtaccaacagccaccaggacaaacgcccccaaactcatgtatttatgatgtacagtaactcggcctgtagggtttctaatcgtcttctctggctcaagtctggacaacgaccggtccctccctgaccctattcctcgtcgggtcctccgaggtctaggaggacgagggtcctaggtaactttacgttacgtcgactacgtcctacattaactaacaacgacctaaccgagtacctacttccgtacttagttcgttaccgttaccggtaacgtccgggtaacccgtaacggttccgaacccggttccgttaacgggtcccaacggtaccccgaaaccggtaccccaaaccccgtaccg

SEQ ID NO: 198278 - DNA, 743 bp, Homo sapiens
  misc_feature: GYAE6OF01BMXGQ.18.59.F04.1.454.CMB.1.raw
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctcctgcacgtggaaccagcagtgacgttggtagttatactatgtctctagtaccaacacgcaccgaggaccaaacgaccccaaactctaattagtatttatggaattcgtactaaggttaactccggtacccttacggttacgggtttactaacgttccgtactttcgttcgtcggccttacccgtaagtccgtacggaaccaaccggtaccggtccccttacccgtacggtaaccctacgttccgttacggtccgggtcctacccggtaggtccgtacggaacgggaccggtacggtccgttagttaacgttttacgttaacgttcggacgtaacgtacgttagtaaacttaacgttaaacgaaaccgcgaacgtaccgtaacggaccctaacgtaaccgtaacgttaccgggtaaccgtaaccgggtaacgggtaacccgttaaaccgggtccccgttaaaccggttacccgttaacgggtacccaaaccccggaccccgtaaaaccgtacccccccgtaaacccgg

SEQ ID NO: 198279 - DNA, 651 bp, Homo sapiens
  misc_feature: GYAE6OF01C02B4.18.59.F04.1.454.CMB.1.raw
  modified_base (300)..(300): a, c, t, g, unknown or other
  misc_feature (300)..(300): n is a, c, g, or t
  modified_base (315)..(315): a, c, t, g, unknown or other
  misc_feature (315)..(315): n is a, c, g, or t
  modified_base (649)..(649): a, c, t, g, unknown or other
  misc_feature (649)..(649): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggtttataactatgtctcctggtaccaacagcacccaggacaaacgccccaaaactcatgatttatgatgtcactaatccggccctcgtaggggttttctaatcgtcttctctggctccaagtctggcaacncggccctcctgaccntctcgtggctccgaggctgaggacgagctagtactttagttactgcagtctacaataactaacaacgaccaccagtacctacttctcttaagttcgttaccgttacgggaactcgggaacctaacggtcctaccggtccttacggtaccaaccggtaccccaacgggacccctaaaccccacgtttcgtaccctaaccgtttcccgttaccccgttacccccctaaccccgttcccttaccccaacgttttaaccccgtaccgttaccgacgggtaccgggtcccgggtaccgtcgggaaccgaaccggggtcccacgtacgtaggctagctcngc

SEQ ID NO: 198280 - DNA, 549 bp, Homo sapiens
  misc_feature: GYAE6OF01BFEY9.18.59.F04.1.454.CMB.1.raw
  modified_base (228)..(228): a, c, t, g, unknown or other
  misc_feature (228)..(228): n is a, c, g, or t
  modified_base (247)..(247): a, c, t, g, unknown or other
  misc_feature (247)..(247): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttanactatgtctcctggtaccaacagcaccaggcaaacgcccccaaactcatgatttatgatgtacactaatcggccctcgtagggtttctaatcgtcttctctggctaccaagtctggcaacgacggccctccgtcgaccatctctgggctccgagctggaggacgaggtctgtaattacttacgtgcgacgctcaattacacaacgacctacagtcactctactatcgttccgttacggtaacgtcgggacctaacggtccgacccgtcgtacggtcaccgacccaacggcccaacccgtacg

SEQ ID NO: 198281 - DNA, 522 bp, Homo sapiens
  misc_feature: GYAE6OF01BTBTE.18.59.F04.1.454.CMB.1.raw
  modified_base (306)..(306): a, c, t, g, unknown or other
  misc_feature (306)..(306): n is a, c, g, or t
  modified_base (326)..(326): a, c, t, g, unknown or other
  misc_feature (326)..(326): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaaactcatgatttangatgtcactaatcggccctnaggggtttctaatcgcttctctggctccaagtctggcaacacggcctccctgaccatctctgggctccgaggctggaggacgaggctgatttatactgcagctacatataacaagcaccagcactctctatcgtctacggaacgtcgggaccaaggtccaccgtctaggtcacgacccaacggcccaacccgtacg

SEQ ID NO: 198282 - DNA, 588 bp, Homo sapiens
  misc_feature: GYAE6OF01DOJVU.18.59.F04.1.454.CMB.1.raw
  modified_base (306)..(306): a, c, t, g, unknown or other
  misc_feature (306)..(306): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgtatactatgtctcctggtaccaacagcacccaggacaaacgccccaaactcatgatttangatgtcagtaactcggccctacgtagggtttctaatcgtcttctctcggctcaagtctggcaacgccgcctccctagacctatcctcgtcgggctccgaggctaggaggacgaggctgtattattacgtgcacgctacattaacactaagcagaccgagacctaactacgaacgttaccgttaccgggaaaccggtacgggaaacccgtaacgggtacccgtacccgttaccggtacgggttaccaaccgggacccccgaaacgggaccccctaaacccccg

SEQ ID NO: 198283 - DNA, 678 bp, Homo sapiens
  misc_feature: GYAE6OF01D1E64.18.59.F04.1.454.CMB.1.raw
  modified_base (301)..(301): a, c, t, g, unknown or other
  misc_feature (301)..(301): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaaccagcagtgacgttggtgttaatactatgtctcctggtaccaacagcaccagcaaacgcccccaaatcatgatttangatgtacactaactcgccctgtacgggtttactactcgtacttctcgtcggtcctacctaagttcgtacggaccaaccgtaccggtccccttacccgtacgaaccctacttcccgttccgtcggggtcccttaccgagggtccttacgggaacgggtacggtacgggtaccttagggttaaacttttacgttaaccgtgtaccgtaacgtcttaacgaattaacgtaaccgaaacggaccctaaccgacgtcctaaccgtccttacgttaacgttcggttacccgtaacgggtaaaccgtacgggtaaaccctaacgggtcccgtacccggttaccgtacggtaccaccgaaccccgaacggcccccaaacccgtcg

SEQ ID NO: 198284 - DNA, 540 bp, Homo sapiens
  misc_feature: GYAE6OF01BWZ02.18.59.F04.1.454.CMB.1.raw
  modified_base (447)..(447): a, c, t, g, unknown or other
  misc_feature (447)..(447): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttatactatgtctcctggtaccaacagcaccaggcaaacgcccccaaactcatgatttatgatgtcactaactcggccctgtagggtttctaatcgtcttctctgctccaagtctggaccaacgacggccctccctgacctatcctcgtcgggcctccgaggcgtggacggacggaggtctagtatttatctgcagctanatactacaacgcaccagcacttctacttatcgttcgtacggaacgtcgggaccacggtccaccgttcgacggtaccacgcccgaacgaccccg

SEQ ID NO: 198285 - DNA, 536 bp, Homo sapiens
  misc_feature: GYAE6OF01CSPGG.18.59.F04.1.454.CMB.1.raw
  modified_base (205)..(205): a, c, t, g, unknown or other
  misc_feature (205)..(205): n is a, c, g, or t
  modified_base (238)..(238): a, c, t, g, unknown or other
  misc_feature (238)..(238): n is a, c, g, or t
  modified_base (377)..(377): a, c, t, g, unknown or other
  misc_feature (377)..(377): n is a, c, g, or t
  modified_base (533)..(533): a, c, t, g, unknown or other
  misc_feature (533)..(533): n is a, c, g, or t
  modified_base (536)..(536): a, c, t, g, unknown or other
  misc_feature (536)..(536): n is a, c, g, or t
tcagtacgagtatgcacgaccggtgctcgatttagtacacacacttagggattggggagagagacccctcccctgggatcctgggcccagtctgccctgactcagcctgcctccgtgtctgggtctcctggacagtcgatcaccatctcctgcactggaaccagcagtgacgttggtggttataactatgtctcctggtaccaangcacccaggcaaagcccccaaatcatgatttangatgtcactaatcggcctcaggggtttctaatcgcttctctggctccaagtctggcaacaccggcctccctgaccatctctgggctccaggctgaggacgaggctgattattactgcagctacataatacaagcaccancactctctatgtcttcggaactcgggacaaggtcaccgtcctaggtcagcccaacggccaaccccactgtaccacttccttcgttccccgcccttccctccctattaccgtcgtacgtcgacggtcgggcctgggaccaagggtccgacagtacgncgn

SEQ ID NO: 198286 - DNA, 762 bp, Homo sapiens
  misc_feature: GYAE6OF01ENWIO.18.59.F04.1.454.CMB.1.raw
tcagtacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggtattttccttgctgcttattttaaaaggtgtccagtgtgaggtgcagctggtggagtcgtgggggaggcgttagggtaaacggcccgggggggttcccttagaccgtcccctgtacagtctcgtggattccgaccgtctcctacttttgccctatcggccgtcggggtcccgccggggtctccgaggggaacgggcccgtgggacggttcgggtcctccgtacttacgtcgagtcgacgtacgtaggtaaagtggacgaagtacgacgtaaggtcggtacgcgtacgggcgtccggtgggacgggtcgttcgaaccgtagttacgacaggacgaactaagttaccgaagtaaccgaccggtactactaccgtaaaccaaattaccgaaactacgtaccgtaggtaacgaacggtaccggaacggacccggtacccggtcccgttaggttaaccgttttcgtacggttggttacggtaacggtaacgggttaacgttaacccggtttaaaaaccgttttcccccggtttaaggtttaacgttttaccggttttaccgtttaaggtaaacgttttacggttacggggttacgggggtaaacccggg

SEQ ID NO: 198287 - DNA, 574 bp, Homo sapiens
  misc_feature: GYAE6OF01CCYUH.18.59.F04.1.454.CMB.1.raw
  modified_base (304)..(304): a, c, t, g, unknown or other
  misc_feature (304)..(304): n is a, c, g, or t
  modified_base (432)..(432): a, c, t, g, unknown or other
  misc_feature (432)..(432): n is a, c, g, or t
  modified_base (448)..(448): a, c, t, g, unknown or other
  misc_feature (448)..(448): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcctggtaccaacagcaccaggacaaacgcccccaaatcatgatttangatgtcactaatcgcctgtagggtttctaatcgtcttctctggctccaagtctggcaacgccgcctcctacgacctatctcgtcgggcctccgaggctaggacggacggaggtctagtatttaatacngacagcttacaattanaacctaagccaaccgagcctacgtctactattcgtacgtacggtaaccgtcgggaacctaacgggtcctaacccggttaccgtaacggtccaaccggtaccccaaccggtccccaaaccccgtacg

SEQ ID NO: 198288 - DNA, 516 bp, Homo sapiens
  misc_feature: GYAE6OF01CJMZF.18.59.F04.1.454.CMB.1.raw
  modified_base (274)..(274): a, c, t, g, unknown or other
  misc_feature (274)..(274): n is a, c, g, or t
  modified_base (307)..(307): a, c, t, g, unknown or other
  misc_feature (307)..(307): n is a, c, g, or t
  modified_base (433)..(433): a, c, t, g, unknown or other
  misc_feature (433)..(433): n is a, c, g, or t
tcagtacgagtatgcacgaccggtgctcgatttagtacacacacttagggagttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcctggtaccaacngcaccaggcaaacgccccaaactcatgatttangatgtcactaatcggccctcgtagggtttctaatcgtcttctcgtgctccaagtctggcaacgaccggccctccctgaccatctctcgggctccgagctaggaggacgagctgtattatactgacngctcatatacagcacagcactctctactgtccgttacgaacgtgggaccaagtccaccgtcgtagacacgcccgaaggacccc

SEQ ID NO: 198289 - DNA, 669 bp, Homo sapiens
  misc_feature: GYAE6OF01DQW66.18.59.F04.1.454.CMB.1.raw
  modified_base (554)..(554): a, c, t, g, unknown or other
  misc_feature (554)..(554): n is a, c, g, or t
  modified_base (653)..(669): a, c, t, g, unknown or other
  misc_feature (653)..(669): n is a, c, g, or t
tcagtacgagtatgcacgaccggtgctcgatttagtacacacacttagggattggggggcttttgtcgtgggtctccgtggacagtcgatccaccatcctcctgcactcggaaaccagcagtgacggttgggtggttaataactatgtctccgtggtaaccaacagccacccgaggacaaaccgaccccccaaaactcatgtatttatgatgtcaactaacgtcccggccctaggtagggtttactacgtcgtcttctcgtcggtcctacctagtcgtcggaccaaccgaccggtcccctcccgtacgaacctacttcctcggtcgggtccctaccgaggtccgtagggaacgggaaccggaggtcgtagttaattttaactttaacgtcggacgacgtcctaactaaatttaacaacgaaacgacccaaaccgacgaccctaaccttccttacttagttcgtttccgttaaccgggaacggtacggggaaacctaacgggtaccctacccgtcgttacggccgacccgacccgaaaccggcccccaaaccctntcgacctaccttccgttccccgttacccccacccttcccactacttacccgtccgtagcggaccgggtcggtctacggacgaacggccaactaagtgcnnnnnnnnnnnnnnnnn

SEQ ID NO: 198290 - DNA, 563 bp, Homo sapiens
  misc_feature: GYAE6OF01A6D9D.18.59.F04.1.454.CMB.1.raw
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcaccaggcaaacgcccccaaactcatgatttatgatgtacactaatccggccctcgaggggtttctaatcgcttctctggctcatcgtgcaacaccggcctccctgaccatctcgtgggcctccgaggctgacggacgaggtctgattattacgtgcagctcatactaacagcaaccgagtccactctactagttcgtccgttacggaaccgtcgggtaacccgtaaggtccctacccggttaccgtacgggtaccacggacccccgaacggtcccccaaaccccgtaccg

SEQ ID NO: 198291 - DNA, 616 bp, Homo sapiens
  misc_feature: GYAE6OF01C3T8T.18.59.F04.1.454.CMB.1.raw
  modified_base (242)..(242): a, c, t, g, unknown or other
  misc_feature (242)..(242): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggngttataactatgtctcctgtacaacagcaccaggcaaacgcccccaaactcatgtatttatgatgtcactaagtccgccctagtacgggtttactaatcgtctttcgtctggctacaagtctggaccaacgacgtccctaccctgacctacttcgtcgtcgggcctaccgaggtctaggacgggacgagggccttagtaatttaactacgtgacgtacgcttatactaacgtaaccaacgtccaaccgagtacctaacttcctacttagttacgttaccgttacgggaaccgtccggggaaccctaaacgggtccctacccggttacgttacggtaccaacggaccccgaaaccggacccctaaaccccgtacg

SEQ ID NO: 198292 - DNA, 471 bp, Homo sapiens
  misc_feature: GYAE6OF01BSPWN.18.59.F04.1.454.CMB.1.raw
  modified_base (404)..(404): a, c, t, g, unknown or other
  misc_feature (404)..(404): n is a, c, g, or t
  modified_base (436)..(436): a, c, t, g, unknown or other
  misc_feature (436)..(436): n is a, c, g, or t
  modified_base (458)..(471): a, c, t, g, unknown or other
  misc_feature (458)..(471): n is a, c, g, or t
tcagtacgagtatgcacgaccggtgctcgatttagtacacacacttagggattgggggctttgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggccctcctgaccatctcgtgggctccaggctgaggacgaggctgattattactgcagctcatatacaagcacagcactctctatgtcttcggaactgggaccaaggtcaccgtctaggtcacgcccaggcccaacccatcgtcactctcgtcccnccctccctcactacctcgtactcgaggccggngtcggcgaacggcgacagtagnnnnnnnnnnnnnn

SEQ ID NO: 198293 - DNA, 511 bp, Homo sapiens
  misc_feature: GYAE6OF01D92EY.18.59.F04.1.454.CMB.1.raw
  modified_base (367)..(367): a, c, t, g, unknown or other
  misc_feature (367)..(367): n is a, c, g, or t
  modified_base (375)..(375): a, c, t, g, unknown or other
  misc_feature (375)..(375): n is a, c, g, or t
  modified_base (429)..(429): a, c, t, g, unknown or other
  misc_feature (429)..(429): n is a, c, g, or t
  modified_base (508)..(508): a, c, t, g, unknown or other
  misc_feature (508)..(508): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttaataactatgtctcctggtaccaacagcaccaggcaaagcccccaaactcatgatttatgatgtcagtaatcggccctctaggggtttctaatcgtcttctctggctccaagtctgcaacncgcctccngacatctctggctccagctgaggacaggctgattatactgcagctacataatanagctagcagcactcgaagttcgtacgaactgggaccaaggtccaccgtctaggtccagaccccaaggacccaaccccgntcg

SEQ ID NO: 198294 - DNA, 611 bp, Homo sapiens
  misc_feature: GYAE6OF01DVQ9A.18.59.F04.1.454.CMB.1.raw
  modified_base (303)..(303): a, c, t, g, unknown or other
  misc_feature (303)..(303): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcaccaggcaaagcccccaaatcatgatttangatgtcactaatcggccctgtagggtttctaatcgtcttctctggctccaagtctggaccaacgacggccctcccgtgaaccctattcctacgtcgggtcctaccgaggctggacggacgaggcttagtaatttagttacgtgccagtccttagaataactaacaagtccaccgagcctaacttctacttacgttcgttaccgttacggaaccggtcgggtaaaccctaagggttccccaacccggtttcccgtaaacgggttccaaacccggacccccgtaaaaccggccccctaaaccccgtaccg

SEQ ID NO: 198295 - DNA, 654 bp, Homo sapiens
  misc_feature: GYAE6OF01BIP3V.18.59.F04.1.454.CMB.1.raw
  modified_base (216)..(216): a, c, t, g, unknown or other
  misc_feature (216)..(216): n is a, c, g, or t
  modified_base (229)..(229): a, c, t, g, unknown or other
  misc_feature (229)..(229): n is a, c, g, or t
  modified_base (250)..(250): a, c, t, g, unknown or other
  misc_feature (250)..(250): n is a, c, g, or t
  modified_base (292)..(292): a, c, t, g, unknown or other
  misc_feature (292)..(292): n is a, c, g, or t
  modified_base (329)..(329): a, c, t, g, unknown or other
  misc_feature (329)..(329): n is a, c, g, or t
  modified_base (529)..(529): a, c, t, g, unknown or other
  misc_feature (529)..(529): n is a, c, g, or t
  modified_base (574)..(574): a, c, t, g, unknown or other
  misc_feature (574)..(574): n is a, c, g, or t
  modified_base (610)..(610): a, c, t, g, unknown or other
  misc_feature (610)..(610): n is a, c, g, or t
  modified_base (626)..(626): a, c, t, g, unknown or other
  misc_feature (626)..(626): n is a, c, g, or t
tcagtacgagtatgcacgaccggtgctcgatttagtacacacacttagggagttgggggggggtctcagggaggcaggcgctcgtcgggactctccaccatggcctgggctctgctattcctcaccctcctcactccagggcacagggtcctgggcccaggtcctggccctgacctcacgcctgccctcgtcgtccgtgggtcctccgtggaaccnggtcgatcaaccntctccgtgacacgtggaaccngctagtcgagttggtagttatacgtatctctctgtaccaacngaccaccagaccaaaccgccctaaatcatgtatttancgtaatcggtactaacgtaacgtccggtaccctcgtagggtttactacgtcgtcttcgtactcggacctcgaacttcgacggccaaaccggtccggtacccctccgtacgtaccccgttgttccctcggtccggtccgtccggacggtccgttagggacggtaccgaggtaccgtagtagtttaactcgttagctacgtnttcctaagtcgtaacacggcctaacgctacgtacctcgtacggtntacggtccgtacggacgtccgggtacctacggtacncccgttagacccggtntacccggaccgtacgcccgtcccgtacg

SEQ ID NO: 198296 - DNA, 527 bp, Homo sapiens
  misc_feature: GYAE6OF01B17QN.18.59.F04.1.454.CMB.1.raw
  modified_base (305)..(305): a, c, t, g, unknown or other
  misc_feature (305)..(305): n is a, c, g, or t
  modified_base (433)..(433): a, c, t, g, unknown or other
  misc_feature (433)..(433): n is a, c, g, or t
  modified_base (437)..(437): a, c, t, g, unknown or other
  misc_feature (437)..(437): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcaccaggacaaacgcccccaaatcatgatttangatgtcactaatcgccctgtagggtttctaatcgtcttctctggtctccaagtctggacaacacggcctccctgacccatcctcgtcgggctccgggctggaggacgaggctgattatactgcagctnatanacaagcacagcactctactatcgtcttacggaacgtcgggaccaaggtccaccgtcctaggtccacgcccaaggcccaacccgcgtaccg

SEQ ID NO: 198297 - DNA, 765 bp, Homo sapiens
  misc_feature: GYAE6OF01CO4GL.18.59.F04.1.454.CMB.1.raw
  modified_base (317)..(317): a, c, t, g, unknown or other
  misc_feature (317)..(317): n is a, c, g, or t
tcagtacgagtatgcacgaccggtgctcgatttagtacacacacttagggattggggggggtctcaggaggcagcgctctcgggacgtctccaccatggcctggctctgctattcctcaccctcctcactcagggcacgagggtcctgggacccagtctgccctgactcagcctgcctccgtgtctgggtctcctggacagtcgatcaccatctcctgcactggaaccagcagtgtacgttggtagttaataactatgtctcctggtacaacacgacaccaggacaaaccgacccctaaatctaatacgtatttacngtaatcgtaactactaacgtccggtacccttcggtacggggttttactaacgttccgtcctttccgttccgtcgggtacccttacccgtaaaggttcccgtagggtaacccgtaaacccggtacccgggtacccccttaccccgtaccggtaacccctacgtttccccgttaccggtcgggttaccccgtacccgtaacggggtaccgttacggggaacggggtaacccgggtacgggtaccgtttaacgggttaaacttttaaccgttaccgtacggtaccgtaacggttccctaaaccttaagttaaaccgttaaaccgaaccgtaccgaaacccgtacgacctaaccttcgttactaacgttcgtaccgttaacggtacgtaccggaaccgtacggtcctacccgtacgtacggtaccacgacccgtacggacccacccgtaccg

SEQ ID NO: 198298 - DNA, 530 bp, Homo sapiens
  misc_feature: GYAE6OF01BTD98.18.59.F04.1.454.CMB.1.raw
  modified_base (431)..(431): a, c, t, g, unknown or other
  misc_feature (431)..(431): n is a, c, g, or t
  modified_base (521)..(521): a, c, t, g, unknown or other
  misc_feature (521)..(521): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcaccaggcaaacgcccccaaactcatgatttatgatgtcactaatcggccctcgaggggtttctaatcgcttctctggctccaagtctggcaacacggcctcctgaccatctcgtgggcctccgaggctgaggacgaggctgtattatactgcagctanatatacagcaccagcactacaacgtcgtacgaacgtacgggaaccagggtaccaccggttctacggtcacgtcccaacgaccccaacccnctcgtaccc

SEQ ID NO: 198299 - DNA, 669 bp, Homo sapiens
  misc_feature: GYAE6OF01D7ZDN.18.59.F04.1.454.CMB.1.raw
tcagtacgagtatgcacgaccggtgctcgatttagtacacacacttaggagttgggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatacaccatctcctgcactcggaaccagcagtgacgttggtgttataactatgtctccgtgtaccaacagcaccagcaaacgccccaaatcaatgactttatgatgtacactaaatccccggaccctctagggttttctaaacgtcggtcctttcttcctggccttacccaagttcttcgggaccaaacgacccgggtccccttccctacgtaaccctatcgggttccctcgggtccgtcccctaagggccgttacgaaggggaacccgtaggacgttcggtaatttaacgtttactcggctacgcttcctaataacgttaacaacggactaacccaaacggtcctaacctacgttcctaaatttcgttccctttaacgggtaaccgtacgggtaaccgaaaccggttccgtacccgtaccttaggttcccgaacgtaccccaaccggacccaaccccgtaacccg

SEQ ID NO: 198300 - DNA, 723 bp, Homo sapiens
  misc_feature: GYAE6OF01DL15J.18.59.F04.1.454.CMB.1.raw
  modified_base (227)..(227): a, c, t, g, unknown or other
  misc_feature (227)..(227): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctcgtgtctggtctcctggacagtcgatcaccatcctcctgcactggaaccngcagtcgacgttggtagttataactatgtctctggtaccaacagcaccaggacaaacgccccaaactcatcgatttatgatgtacactaactcgccctcgtacgggttctaacgtcgtcttctcgtcggtctacctaagtcgtcggacctaaaccgaccggtcccttacccgttacgaaccctacttcctccggtcgggtcctacccgtaaggtccgtaggaacgggtacggaacgggtacgttacggttaacttttaacgtttaacctcggtaacctacggtaccttaaccgtaagttaaacttaaaccgaaccggtacctaaaccccaacggtacccttaaaccgttccttacttaacgttaccggtttcccgttaaacccgggtaaaccggttaccgggtaaacccgtaaacggttccccgtaaacccggttcccgttaacgggtacccgaaccggtaaccccgaaacccggtaccccaaaccccccgtaccg

SEQ ID NO: 198301 - DNA, 536 bp, Homo sapiens
  misc_feature: GYAE6OF01AGKS3.18.59.F04.1.454.CMB.1.raw
  modified_base (304)..(304): a, c, t, g, unknown or other
  misc_feature (304)..(304): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaatcatgatttangatgtcactaatcggcctgagggtttctaatcgcttctcgtggctccaagtctggcaacaccggcctccctgaccatcctcgtgggcctccgaggctggaggacgaggtctagtattacttactgcagctcatatacaagccaaccagcactctactatcgtcgttacggaacgtcgggaacccaagggtccaccggtcctaggtccacgacccaacggcccaacccctacg

SEQ ID NO: 198302 - DNA, 672 bp, Homo sapiens
  misc_feature: GYAE6OF01CVYKA.18.59.F04.1.454.CMB.1.raw
tcagtacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcttagggtaaaggccggggggtcccttaggacctcccctgtacagcctctggattcactttcagtaaggcctggatgaactggtccgccaggctccgagggaagggctggagtggtgcgtaataaaaccaaactgagtggaggaacaacgagaactacgctgcaacccggtagaaaggcaagattaccaaccatctacaagagatagaattacaaaaagcaacgtactagtaactcgttagaactaaaatagaaaccacgcctaggaacggaaaccggaaggaccaaccgaggacccgttattaacttacgtacgtaaacccactaaccctaccccctaaagggaaaccgtaccgtaacctaaaaccttaacccgttaaacccgttaaccgttaaacccgggttagtaacccgggtaacccccttcggggttaccgggggaaacccccggg

SEQ ID NO: 198303 - DNA, 605 bp, Homo sapiens
  misc_feature: GYAE6OF01BFE1Y.18.59.F04.1.454.CMB.1.raw
  modified_base (228)..(228): a, c, t, g, unknown or other
  misc_feature (228)..(228): n is a, c, g, or t
  modified_base (304)..(304): a, c, t, g, unknown or other
  misc_feature (304)..(304): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataactatgtctcctggtaccaacagcaccaggcaaacgcccccaaactcatgatttangatgtcactaatcggccctgtacgggtttctaatcgtcttctcgtcggctccgaagtcgtggaccaacgacggccctccctcgacctattctcgtgggtcctccgaggtctaggaacggacggaggtctagtatttacttacgtgacacgtctactaatactaacacgaccaaccagtccacttcttactacgttcgttaccgttaccgggtaacgtacgggtaaccctaacgggtccctacccggttaccgtacgggtccgaaccggaccccgaaccgggacccctaaacccccggtacg

SEQ ID NO: 198304 - DNA, 658 bp, Homo sapiens
  misc_feature: GYAE6OF01DN4HN.18.59.F04.1.454.CMB.1.raw
  modified_base (279)..(279): a, c, t, g, unknown or other
  misc_feature (279)..(279): n is a, c, g, or t
tcagtacgagtatgcacgaccggtgctcgatttagtacacacacttagggtagttggggggggtctcaggaggcgagcgtctcctcgggacgtcctaccgacctactggtccgtgggctcctgcctattcctcaccctcctcacgtcagggcactaggggtcctggggcccaggtctcgtcccgttgactcagtccttggcctccgtgtctgggtctccgtggacagtcgagtcgaccatcgtctgcactggaacctggcagtgacgttggtgtatacntgtctcgtggtaccacacgtcacctaggtacaaacgccccaaacgtcgaactcgtagtttactgagtacggtacgactaagtccggtccgtaggtacgggttactaagtcgtacgttcgtcgtggactacgtaagtacgtaggactaacgccgggtcccttccgtgtaccgtaacgtcctacgttcgggacccttaccgaggtcctaggacggaacgaggtcctaagtactttactacgtgtactagacttacgaatactacaacgctacacgactacgtctacgtagtcgtaccgttaggtacgtacgggaaccgtaagggtcccaaccggttcgacggtcgaaccggtacccgaacgggtccccaaacccggtaccg

SEQ ID NO: 198305 - DNA, 321 bp, Homo sapiens
  misc_feature: GYAE6OF01BC3HS.18.59.F04.1.454.CMB.1.raw
  modified_base (190)..(190): a, c, t, g, unknown or other
  misc_feature (190)..(190): n is a, c, g, or t
  modified_base (314)..(321): a, c, t, g, unknown or other
  misc_feature (314)..(321): n is a, c, g, or t
tcagtacgagtatgcacgaccggtgctcgatttagtacacacacttagggattggggagagaagacaggattcaggacaatctccagcatggccggcttccctctcctcctcaccctcctcactcactgtgcagggtcctgggcccagtctgtgctgactcagccaccctcagcgtctgggacccccggnagagggtcaccatctcttgttctggaagcagctccaacatcggaagtcagcccaaggctgccccctggtcactctgttcccgcctcctccatactcgtactgagcggctggcaaggcgcatagnnnnnnnn

SEQ ID NO: 198306 - DNA, 574 bp, Homo sapiens
  misc_feature: GYAE6OF01BCIH1.18.59.F04.1.454.CMB.1.raw
tcagtacgagtatgcacgaccggtgctcgatttagtacacacacttagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcaccaggcaaacgcccccaaatcatgatttatgatgtcactaatcggcctcgaggggtttctaatcgcttctctggctcagtctggcaacacggcctcctgaccatctctgggcctccgaggctgaggacgaggctgattatactgcagctcaatactacaagcaagcaagctaacctcgtaagttccgttacggaaaccgttcggggaaaccctaacgggttcccgacccggttacccgttaacgggtacccaacgggtacccccaaacggggaccccctaaaaccccccgtgttaacccgg

SEQ ID NO: 198307 - DNA, 593 bp, Homo sapiens
  misc_feature: GYAE6OF01DK4XT.18.59.F04.1.454.CMB.1.raw
  modified_base (233)..(233): a, c, t, g, unknown or other
  misc_feature (233)..(233): n is a, c, g, or t
  modified_base (314)..(314): a, c, t, g, unknown or other
  misc_feature (314)..(314): n is a, c, g, or t
  modified_base (591)..(593): a, c, t, g, unknown or other
  misc_feature (591)..(593): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagccacccaggcaaacgcccccaaactcatgatttangatgtcactaatcggccctcaggggtttctaatcgtcttctctggctccaagtctggcaacaccggcctccctgaccatcnctgggctccgaggctgaggacgaggctgattatactgcagctcataatacaagcagcagacactacgtaagttccgttacggaacgtcgggaaccaaggtccgaaccgtccgtaggtccaaccgaccccgaaacggcccccaaacccccgtacgttaccgtaccaaccttcgttccccggttaccccgtccccttcccgtaccctacttaccgtccgtaaccgtggaaccggtcgggtaccgtacgggacctaacgggccacgtataacgcacagcnnn

SEQ ID NO: 198308 - DNA, 711 bp, Homo sapiens
  misc_feature: GYAE6OF01DWOIT.18.59.F04.1.454.CMB.1.raw
  modified_base (365)..(365): a, c, t, g, unknown or other
  misc_feature (365)..(365): n is a, c, g, or t
  modified_base (709)..(709): a, c, t, g, unknown or other
  misc_feature (709)..(709): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggacaaacgcccccaaaactcatgatttatgatgtcactaatcggccctcgtaggggtttctaatcgtcttctctggctccaagtctggcaacacggcctccctgaccatcctcgtcgggctccgaggcgtagacgggacgaggctagtaatttacttacncggtacacgtctactaataactaacgaaagccaaaccgagtacctaccttacctacttaacgttcgttaccgttacgggaaaccgttacgggaaacccgtaaacgggttcccaacccggttaccgtaacgggttacccaaccgggtacccccgaaacgggtaccccccaaaaccccgtacgtttaccgtaccctaacccgttcccgttccccggtttaaccccccgcccccttacccgttaaccctaacgtttaacccgttaccgttaccgtccgggaaccgggtcccgggggtctaacggggaccgaaacgggtcccgtaagtaacgttacggactagctagngc

SEQ ID NO: 198309 - DNA, 524 bp, Homo sapiens
  misc_feature: GYAE6OF01CPSYL.18.59.F04.1.454.CMB.1.raw
  modified_base (310)..(310): a, c, t, g, unknown or other
  misc_feature (310)..(310): n is a, c, g, or t
  modified_base (378)..(378): a, c, t, g, unknown or other
  misc_feature (378)..(378): n is a, c, g, or t
  modified_base (438)..(438): a, c, t, g, unknown or other
  misc_feature (438)..(438): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgcccccaaaactcatgatttangatgtcactaatcggccctcagggtttctaatcgcttctctgctcaagtctggcaacacggcctcccngaccatctctgggcctccgaggctggacggacgaggctgattagttactgcagctcatanacagccacagcactctctatgtacgttcggaactcgggacctaaggtccacccgttacgtacggtccacgcccgaacggtaccccc

SEQ ID NO: 198310 - DNA, 902 bp, Homo sapiens
  misc_feature: GYAE6OF01ES8EV.18.59.F04.1.454.CMB.1.raw
tcagtacgagtatgcacgaccggtgctcgatttagtacacacacttagggattggggtctgggagaggagccccagccttgggattcccaagtgttttcattcagtgatcaggactgaacacagaggactcaccatggagtttgggctgagctggtattttccttgctgtctaattttaaaaggtgtcagtgtgaggtgcagctggtggagtcggtgggggaggtcgttaggggtaaacgggtcccgggggggtaccctttaggaacccgttcccccgtaggtaccacggcccgttcgttacggtactttccgtaaccttttacgaacggttaaacgggtcccgttagggtaacgttacggtaaaccgtttccgggggttaccccggacccggaacgggcccggttacccgggaaagggggggaaacggggggtccgtttagggggacggggtttcgggggtttacgggtaacccggtttaaaacgtttaaaaaaaacccgtaaaaacgttaggtaaacggttaggggtaaacggggaaaccaaacgaacggtaaccgtaacggcgtacgacccgaacccggtaggaaaacgggcaacgtaacttaccgaacctaagttccgtaacgaaaggtagtaactagtaaagttaaaccgaaaaacgccgtaaaccgtacttaggtaactcgtaagtaaaccgtaaaataccggaaactacgggtaaccctaagggaaaccgaaaccggaacggaaccaacggtaacgtaccgttagttaaccttactaccgtaacccacgtaacccgtaccccgtaaaggtaaaccgtccgtaacctaaaaccttaaccctaaccgttaaacgtaccggttaactagggtacccttcgggacggggtaaaccccgg

SEQ ID NO: 198311 - DNA, 550 bp, Homo sapiens
  misc_feature: GYAE6OF01D1Y4F.18.59.F04.1.454.CMB.1.raw
  modified_base (229)..(229): a, c, t, g, unknown or other
  misc_feature (229)..(229): n is a, c, g, or t
tcagtacgagtatgcacgaccggtgctcgatttagtacacacacttagggattgggggggggtctcaggaggcagcgctctcgggacgtctccaccatggcctggactctgctattcctcaccctcctcactcagggcacagggtcctgggcccagtctgccctgactcagcctgcctccgtgtctgggtctcctggacagtcgatcaccatctcctgcactggaaccngcagtgacgttggtggttataactatgtctcctggtaccaacagcaccaggacaaacgccccaaactcatgatttatgatgtcactaatcgccctcgtagggtttctaatcgcttctctgctctaagtctggcaacacggcctcctgaccatctcgtgggctccgaggctggacggacgaggctagtattatactgcagtctacaattaactaacgaacgccaacacgctactcttactattcgtaccgttacggaacgtcgggaaccctaaggtccacccgttcgtacggtccacggacccaacggcccaaccccgtacg

SEQ ID NO: 198312 - DNA, 546 bp, Homo sapiens
  misc_feature: GYAE6OF01C0A02.18.59.F04.1.454.CMB.1.raw
  modified_base (199)..(199): a, c, t, g, unknown or other
  misc_feature (199)..(199): n is a, c, g, or t
  modified_base (228)..(228): a, c, t, g, unknown or other
  misc_feature (228)..(228): n is a, c, g, or t
  modified_base (439)..(439): a, c, t, g, unknown or other
  misc_feature (439)..(439): n is a, c, g, or t
  modified_base (447)..(447): a, c, t, g, unknown or other
  misc_feature (447)..(447): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacngtcgatcaccatctcctgcactggaaccngcagtgacgttggtaggttataactatgtctcctggtaccaacagcacccaggaccaaacgcccccaaactcatgatttatgatgtcactaatcggccctgaggggtttctaatcgtcttctctggctccaagtctggccaacgaccggccctccctgacccatcctcgtgggcctccgaggctggacggacgaggctagtattattacgngcagctanataatacaatcaccagcctactctcttatgtcctacggacgtcgggaaccaggtccaccgttccgtacggtccacgaccaaccggccctaaccccgtac

SEQ ID NO: 198313 - DNA, 523 bp, Homo sapiens
  misc_feature: GYAE6OF01AHCJ2.18.59.F04.1.454.CMB.1.raw
  modified_base (270)..(270): a, c, t, g, unknown or other
  misc_feature (270)..(270): n is a, c, g, or t
  modified_base (305)..(305): a, c, t, g, unknown or other
  misc_feature (305)..(305): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaanagcacccaggcaaagcccccaaactcatgatttangatgtcactaatcgccctcaggggtttctaatcgtcttctctggctccaagtctgcaacacggcctcctgaccatctcgtgggcctccgaggctggaggacgaggctgattattactgcagctcatatacagcaccagcactctctatgttacttcggaacgtgggaaccaaggtccaccgtcctacggtcacgacccaacggccccaacccgtaccg

SEQ ID NO: 198314 - DNA, 621 bp, Homo sapiens
  misc_feature: GYAE6OF01A7X2B.18.59.F04.1.454.CMB.1.raw
  modified_base (251)..(251): a, c, t, g, unknown or other
  misc_feature (251)..(251): n is a, c, g, or t
  modified_base (362)..(362): a, c, t, g, unknown or other
  misc_feature (362)..(362): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttatactntgtctctggtaccaacagcaccagcaaacgcccccaaactcatgatttatgatgtcactaatccgcctcgtagggtttctaatcgcttctctcggctccagtctagcaacnccggcctcccgtgaccatctcgtggcctccgacgtcgtaggacggacgacggtcgtagtaactttacgttacgtcgactacggtctacgtaactaactaacgaacgacctaaccgtacgaccgtactaccgtacttaacgtccggttaccgttacgggtaaccgttacggggaacccttaagggttcccctaaccggttacccgttaacggtaccgacccggaacccgaaccggtaacccccgtaaccccggttaaccg

SEQ ID NO: 198315 - DNA, 491 bp, Homo sapiens
  misc_feature: GYAE6OF01CKVML.18.59.F04.1.454.CMB.1.raw
  modified_base (247)..(247): a, c, t, g, unknown or other
  misc_feature (247)..(247): n is a, c, g, or t
  modified_base (389)..(389): a, c, t, g, unknown or other
  misc_feature (389)..(389): n is a, c, g, or t
  modified_base (411)..(411): a, c, t, g, unknown or other
  misc_feature (411)..(411): n is a, c, g, or t
  modified_base (469)..(469): a, c, t, g, unknown or other
  misc_feature (469)..(469): n is a, c, g, or t
  modified_base (472)..(473): a, c, t, g, unknown or other
  misc_feature (472)..(473): n is a, c, g, or t
  modified_base (475)..(491): a, c, t, g, unknown or other
  misc_feature (475)..(491): n is a, c, g, or t
tcagtacgagtatgcacgaccggtgctcgatttagtacacacacttagggattgggggctttgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacncggcctccctgaccatctctgggctccaggctgaggacgaggctgattattactgcagctcatatacagcaccagcactctctatgtctacggactgggaccaggtcctacgtcctaggtcacgcccaacggcccaaccccnctcgccacttctccgttccccnccctccctccactcctcgtacctggagccgggctcgggacgtaacggcgacagtagcntcnncnnnnnnnnnnnnnnnnn

SEQ ID NO: 198316 - DNA, 785 bp, Homo sapiens
  misc_feature: GYAE6OF01DVNTE.18.59.F04.1.454.CMB.1.raw
  modified_base (239)..(239): a, c, t, g, unknown or other
  misc_feature (239)..(239): n is a, c, g, or t
tcagtacgagtatgcacgaccggtgctcgatttagtacacacacttagggtagtttgggggggggtctcaggaggcagacgctctcgggacgtctccaccatggcctcgggctctgctattcctcaccctctcactcgagggcacaggggtctgggccctagtctgccctgactcagcctgccttccgtgtcctgggtctcctggacaggtcgatcaccatctctgcagtaggaaaccnggcgagtgacggtttggtggttataactatgtctcctggtacaacagcaccaggacaaagccccaatcatgtaatttagtgatcgtacactaagtccgccctcgtacgggtttacaagtcgtctttcgtcgtacggtactaccgtaaacgttcgttacgggacctaacgtaccgggtccccttaccccgtacgtaaccgtacttccgttaccggtcgggggtacccgttacccgggaagggtccgttacgggaacgggtaacccgggtaagggttcccgttaagggttaaacgttttaacgtttaaccgtcggtaccgtaacggtaccttaaccgtaacgtttaaaccgtaaccgaaaggtacccgtaaacggacggtacccgtaacccttacgttaactttaacgtttaccggttaaccggttaacccggggttaaacccgtttcggggggttaaaccccttaaacggggttccctaaccccggggttcggtaaacggggtcgtaaaccgccccggtaaaacgggtaccccctaaacccggtacg

SEQ ID NO: 198317 - DNA, 557 bp, Homo sapiens
  misc_feature: GYAE6OF01BDAFA.18.59.F04.1.454.CMB.1.raw
  modified_base (254)..(254): a, c, t, g, unknown or other
  misc_feature (254)..(254): n is a, c, g, or t
  modified_base (271)..(271): a, c, t, g, unknown or other
  misc_feature (271)..(271): n is a, c, g, or t
  modified_base (304)..(304): a, c, t, g, unknown or other
  misc_feature (304)..(304): n is a, c, g, or t
  modified_base (371)..(371): a, c, t, g, unknown or other
  misc_feature (371)..(371): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatctcctgcactggaaccagcagtgacgttggtagttataactntgtctcctggtaccaangcaccaggcaaacgccccaaactcatgatttangatgtcactaatcgcctgagggttctaatcgcttctctggctccaagtctggcaacacggccctccngaccatctcgtcggctccaggctaggaggacgaggcctagtatttacttaacgtgacagtctacaattactaacgaagtccaccgagcactcgtactattcggttaccttacggaacgtcgggaacctaaggtcccaacccgttccgaaggttccacggaccccaacggtccccaaccccgtaccg

SEQ ID NO: 198318 - DNA, 630 bp, Homo sapiens
  misc_feature: GYAE6OF01A0RS3.18.59.F04.1.454.CMB.1.raw
  modified_base (248)..(248): a, c, t, g, unknown or other
  misc_feature (248)..(248): n is a, c, g, or t
tcagtacgagtatgcacgaccggtgctcgatttagtacacacacttagggagttggggggggtctcaggaggcagcgctctcgggacgtctccaccatggcctggctctgctattcctcaccctcctcactcaggcacagggtcctgggcccagtctgccctgactcagcctgcctccgtgtctgggtctcctggaccagtcgatcaccatcctcctgcactggaaccagcagtgacgttggtgttanaactatgtctcctggtaccaacagcaccaggcaacgcccccaaactcatgatttatgatgtcactaatcggccctcgtacgggtttctaagtcgtcttctcgtgctccaagtctggacaacgacgtaccctccctacgaccatcctcgtcgggcctccgaggtctaggacggacgaggtcctagtaactttagtaactcgacctacgactaccgattaacgtaaccaacgtaccaacccgaacgccctaacctccttacttacgttccgttaccgttaccgggtaaaccggttcggggaaacccctacgggttaccctaccccggttacccgttaccggtaccaaccggaccccgaaacgggccccctaaacccccgtaccg

SEQ ID NO: 198319 - DNA, 519 bp, Homo sapiens
  misc_feature: GYAE6OF01BZSXS.18.59.F04.1.454.CMB.1.raw
  modified_base (371)..(371): a, c, t, g, unknown or other
  misc_feature (371)..(371): n is a, c, g, or t
  modified_base (425)..(425): a, c, t, g, unknown or other
  misc_feature (425)..(425): n is a, c, g, or t
  modified_base (428)..(428): a, c, t, g, unknown or other
  misc_feature (428)..(428): n is a, c, g, or t
  modified_base (436)..(436): a, c, t, g, unknown or other
  misc_feature (436)..(436): n is a, c, g, or t
  modified_base (512)..(512): a, c, t, g, unknown or other
  misc_feature (512)..(512): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagccacccaggacaaacgcccccaaactcatgatttatgatgtacactaactcggccctcgaggggtttctaatcgcttctctggctccagtctggcaacncggcctcctgaccatctctgggcctccgaggctgaggacgaggctgattatacngcngctcatanaacagcagcagcactcaagtcttacggacgtcggaccaaggtcaccgtctaggtccacgacccaacgcccaacccncgtaccg

SEQ ID NO: 198320 - DNA, 669 bp, Homo sapiens
  misc_feature: GYAE6OF01AEXF8.18.59.F04.1.454.CMB.1.raw
  modified_base (232)..(232): a, c, t, g, unknown or other
  misc_feature (232)..(232): n is a, c, g, or t
  modified_base (259)..(259): a, c, t, g, unknown or other
  misc_feature (259)..(259): n is a, c, g, or t
tcagtacgagtatgcacgaccggtgctcgatttagtacacacacttagggagttggggggggtctcaggaggcagcgctctcgggacgtctccaccatggcctggctctgctattcctcaccctcctcactcagggcacgagggtcctgggcccagtctgccctgactcagcctgcctccgtgtctgggtctccgtggacagtcgatcaccatcctcctgcacgtggaaccngcaggtgtacggttggtagttatactntgtcctcgtcggtaccaacagccaccaggacaaaccgcccccaaatcatgtattatgatcgtacaactacgtccggccctggtacggttctatcgtcttctcgtcgctccgagtcgtacggctaaccgaccggtccctccgtcgacctactcgtcgtcggctccgacggtcgtaggaacggacggtacgtacttagggttaactttacgtacgtcgtacctacggtactactaattactaaaccgaaccgacctaaccgtaccgtacctacgttccttaaccggtttcgttccgtttaccggtaaccgggtaaccggtaccggtaacccggttaccgtcccggtaacccggttacccgaacggtacccgaacccggaacccgaacccggtaccccctaacccgttacccg

SEQ ID NO: 198321 - DNA, 506 bp, Homo sapiens
  misc_feature: GYAE6OF01DL9ML.18.59.F04.1.454.CMB.1.raw
  modified_base (434)..(434): a, c, t, g, unknown or other
  misc_feature (434)..(434): n is a, c, g, or t
  modified_base (474)..(474): a, c, t, g, unknown or other
  misc_feature (474)..(474): n is a, c, g, or t
  modified_base (495)..(495): a, c, t, g, unknown or other
  misc_feature (495)..(495): n is a, c, g, or t
  modified_base (501)..(502): a, c, t, g, unknown or other
  misc_feature (501)..(502): n is a, c, g, or t
  modified_base (504)..(506): a, c, t, g, unknown or other
  misc_feature (504)..(506): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctcccctgaccatctctgggctccaggctgaggacgaggctgattattactgcagctcatatacagcaccagcactctctatgtcttcggaactgggaccaaggtcaccgtcctaggtcacgcccaaggcccaacccntgtccactctcgttccccaccctcctccatacctcgtacngagcggtctggacaaggccgnatacgnncnnn

SEQ ID NO: 198322 - DNA, 831 bp, Homo sapiens
  misc_feature: GYAE6OF01C3FHQ.18.59.F04.1.454.CMB.1.raw
tcagtacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggtattttccttgctgcttattttaaaggtgtccagtgtgaggtgcagcgtgggtggaggtcggtgggggaggtcgttagggtaaacgggtccggggggtacccttaggtacctccccgtgtaccacgtcctcgttggacttctactttcgaaggtaacggccgttaggactacggtaacgttcggggtacccgaccgacggtccgtaccggaagggggtaacggggcgtaggggagggttcggggttacgggtaaccggttaaaacgttaaaaaaccccgaaaacgttggaaggtagggtacgggtaaccaaacgaacggaaccgttacgacgtacggacccgaacccggtaaggaaacggactaacggtaacttacccgaaccgtacgttactaaccgaaaggtacgaatttaacggaaactttaaaccgaaaaaacgggtcctaaaccgggtcttaaggtaccttaccgtagaaaccaaagtaccggtaaacaccggtaccgtaacggaaccgggaaacccggaaacgaaccaccggtaacggtacccgttaggtaacttccgtaacgtaccccgaacctaccgttaacccccggtagaaaccggtcccgttaaaccaaaccttaccgttaaacctaacgttaacggtaccttaccggaccgttacccgggg

SEQ ID NO: 198323 - DNA, 696 bp, Homo sapiens
  misc_feature: GYAE6OF01DI8ER.18.59.F04.1.454.CMB.1.raw
  modified_base (255)..(255): a, c, t, g, unknown or other
  misc_feature (255)..(255): n is a, c, g, or t
  modified_base (306)..(306): a, c, t, g, unknown or other
  misc_feature (306)..(306): n is a, c, g, or t
tcagtacgagtatgcacgaccggtgctcgatttagtacacacacttagggagttggggggggtctcaggaggcagcgctctcgggacgtctccaccatggcctggctctgctattcctcaccctcctcactcagggcacaggtcctgggcccagtctgccctgactcagcctgcctccgtgtctgggtctcctggacagtcgatcaccatctcctgcactggaaccagcagtgtacgttggtaggttaataactntgtactcctggtaccaacagcaccaggcaaacgccccaatcatcgatttangatgtacaactaacgtcgaccctcgtacggggtttctaacgttcgtcctttctactcgggtacctaccgtaagtccgtacggacaaaccgtaccggtccccttacccgtcgtaaccctacttccgttccgtcgggacccttacccgaagggtcccgtagggtaacgggaacggacgggtcttacgggtaacttttaacgtacgtcgactaacgtccttactaacgttactaaaccgaacgtacccgaaacctaacgacctaccgttaccttacttaacgttccgttacgttaccgggaaccgttaccgggaaccgtaaacggtccctaaacccgggttccgtaacggtaccaacggaacccccgaaaccggtccccaaaccccgttaccg

SEQ ID NO: 198324 - DNA, 562 bp, Homo sapiens
  misc_feature: GYAE6OF01B1E6A.18.59.F04.1.454.CMB.1.raw
  modified_base (231)..(231): a, c, t, g, unknown or other
  misc_feature (231)..(231): n is a, c, g, or t
  modified_base (353)..(353): a, c, t, g, unknown or other
  misc_feature (353)..(353): n is a, c, g, or t
  modified_base (556)..(556): a, c, t, g, unknown or other
  misc_feature (556)..(556): n is a, c, g, or t
  modified_base (559)..(559): a, c, t, g, unknown or other
  misc_feature (559)..(559): n is a, c, g, or t
  modified_base (561)..(562): a, c, t, g, unknown or other
  misc_feature (561)..(562): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggaccgtcgatcaccatctcctgcactggaaccagcagtgacgttggtggttataactatgtctcctggtaccaacagcacccaggcaaagcccccaaaatcatgatttangatgtcactaatcggcctcgaggggtttctaatcgcttctctggctccaagtctggcaacaccggcctccctgaccatctctggctccaggctgaggacgaggctgattattactgcagctnatatacaagtccacagcactctactatgtctttcggaacgttcgggaacctaaggtccgaaccgtcgtacggttccacgtccccgaacggacccaacccctctcgtaccaccttaccttccgtccccgtcccttccctacctacttaccgccgttactcgacggccgggactcggtagaaccgggctacgaacgttagcctangcngnn

SEQ ID NO: 198325 - DNA, 512 bp, Homo sapiens
  misc_feature: GYAE6OF01DMU95.18.59.F04.1.454.CMB.1.raw
  modified_base (418)..(418): a, c, t, g, unknown or other
  misc_feature (418)..(418): n is a, c, g, or t
  modified_base (425)..(425): a, c, t, g, unknown or other
  misc_feature (425)..(425): n is a, c, g, or t
  modified_base (429)..(429): a, c, t, g, unknown or other
  misc_feature (429)..(429): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcaccaggcaaagcccccaaactcatgatttatgatgtcactaatcgccctgagggttctaatcgcttctctggctccagtctggcaacgaccggcctcctgaccatctctgggcctccgaggctggaggacgaggctgattatacngcagctnatanacagcacagcactctctatgtcttacggacgtcgggaaccaggtccaccgtctacggtcacgacccaacggccctaacccacg

SEQ ID NO: 198326 - DNA, 669 bp, Homo sapiens
  misc_feature: GYAE6OF01EVM55.18.59.F04.1.454.CMB.1.raw
  modified_base (412)..(412): a, c, t, g, unknown or other
  misc_feature (412)..(412): n is a, c, g, or t
tcagtacgagtatgcacgaccggtgctcgatttagtacacacacttagggattggggtctgggagaggagccccagccttgggattcccaagtgttttcattcagtgatcaggactgaacacagaggactcaccatggagtttggggctgagctggattttccttgctgctattttaaaaggtgtccagtgtgaggtgcagctggtggagtcgtgggggaggcgttggtaaaggccgggggggtccttagactcccctgtacagcctctggattcactttcagtaaggcctggatgaactgggtccgccaggctccgagggaaggggctggagtgggtggccgtattaaaaccaaactgagtggtgggacaacgagactacgctgcaccgtgaaaggcagatcaccatctanaagagatagaattacaaaaagcaacgctagtaatcgtagactaaatgaacacgtacctagaacggaaccggaacgggaaccaacgaacggaccgttaggttaactttaccgtacgttaaacccaccgtaaccttacccccgtaaggtaaaacggtacccgttaacccaaaccttaaccttaaacccgttaaacccgttaaaccgggttacgttaacccgggtaaccgtttcccgggtacggggggtaaacccccggg

SEQ ID NO: 198327 - DNA, 539 bp, Homo sapiens
  misc_feature: GYAE6OF01AYZ96.18.59.F04.1.454.CMB.1.raw
  modified_base (533)..(533): a, c, t, g, unknown or other
  misc_feature (533)..(533): n is a, c, g, or t
  modified_base (535)..(536): a, c, t, g, unknown or other
  misc_feature (535)..(536): n is a, c, g, or t
  modified_base (538)..(538): a, c, t, g, unknown or other
  misc_feature (538)..(538): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcgaggggtttctaatcgcttctctggctccaagtctggcaacacggccctccctgacccatctcgtgggcctccgaggctgaggacgaggctgattattactgcagctcatatacaagccacagcactctctatcgtcttcggaacgtcggaccaaggtccaccgtcctaggtccacgacccaacggacccaacccactcgtccactcctccgttccccacccctcctccactaccgtcgtacctcgacggccgggcgtcgggacaacggccgacacgtacgnanngnc

SEQ ID NO: 198328 - DNA, 572 bp, Homo sapiens
  misc_feature: GYAE6OF01AZ4X6.18.59.F04.1.454.CMB.1.raw
  modified_base (371)..(371): a, c, t, g, unknown or other
  misc_feature (371)..(371): n is a, c, g, or t
  modified_base (408)..(408): a, c, t, g, unknown or other
  misc_feature (408)..(408): n is a, c, g, or t
  modified_base (447)..(447): a, c, t, g, unknown or other
  misc_feature (447)..(447): n is a, c, g, or t
tcagtacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggatttccttgctgctatttaaaggtgtcagtgtgaggtgcagctggtggagtcgtgggggaggtcgttagggtaaagccggggggggtccctttagacctccccgtgtacagcctcgtggattcactttcagtaagcctggatgaactggtccgccaggctcgagggagggctggaggtgggtgcgtaataaaccaaactgagtggtaggacanagactacgctgacaccgtgaacgcagatcacatctanaagagatgattaacaaaagcacgactgtatcagtacaangaacagcctagaacgaaccggagaaccacgacgtaccgtagtaacttacgtacgtaacccactactccccgtagaacggtcctaacgtaactaacctactaccgttaagtactcggaccgtcggg

SEQ ID NO: 198329 - DNA, 527 bp, Homo sapiens
  misc_feature: GYAE6OF01AX2N7.18.59.F04.1.454.CMB.1.raw
  modified_base (365)..(365): a, c, t, g, unknown or other
  misc_feature (365)..(365): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcagggtttctaatcgcttctctggctccaagtctggcaacncggcctccctgaccatctcgtgggcctccaggctgaggacgagctgattatactgcagctcatataacacgcaccagcactctactatcgttccgttacggaacgtcgggaccaaggtcccaccgtcctaggtccacgacccaacggcccctaacccgtacg

SEQ ID NO: 198330 - DNA, 538 bp, Homo sapiens
  misc_feature: GYAE6OF01AVFFW.18.59.F04.1.454.CMB.1.raw
  modified_base (209)..(209): a, c, t, g, unknown or other
  misc_feature (209)..(209): n is a, c, g, or t
  modified_base (246)..(246): a, c, t, g, unknown or other
  misc_feature (246)..(246): n is a, c, g, or t
  modified_base (408)..(408): a, c, t, g, unknown or other
  misc_feature (408)..(408): n is a, c, g, or t
  modified_base (421)..(421): a, c, t, g, unknown or other
  misc_feature (421)..(421): n is a, c, g, or t
  modified_base (428)..(428): a, c, t, g, unknown or other
  misc_feature (428)..(428): n is a, c, g, or t
  modified_base (486)..(486): a, c, t, g, unknown or other
  misc_feature (486)..(486): n is a, c, g, or t
tcagtacgagtatgcacgaccggtgctcgatttagtacacacacttagggattggggagagaagacaggattcaggacaatctccagcatggccggcttccctctcctcctcaccctcctcactcactgtgcagggtcctgggcccagtctgccctgactcagcctgcctccgtgtctgggtctcctggacagtcgatcaccatctccngcactggaaccagcagtgacgttggtggttataactntgtctcctggtaccaacagcacccaggcaaagcccccaaactcactgatttatgatgtcactaatcggcctcgaggggtttctaagtcgcttctctggctcaagttctggccaacaccggccctcctcgaccatctcgtcggcctcgagctgacggacgagntagattattacgngcagctnatatacagcaccagccactctctatctcgttacggaacgttcgggaacctaggtaccncccggttaccgtagccgtacgacccgaaacggcccaaccccgtacgttaccg

SEQ ID NO: 198331 - DNA, 569 bp, Homo sapiens
  misc_feature: GYAE6OF01B9A18.18.59.F04.1.454.CMB.1.raw
  modified_base (357)..(357): a, c, t, g, unknown or other
  misc_feature (357)..(357): n is a, c, g, or t
  modified_base (364)..(364): a, c, t, g, unknown or other
  misc_feature (364)..(364): n is a, c, g, or t
  modified_base (372)..(372): a, c, t, g, unknown or other
  misc_feature (372)..(372): n is a, c, g, or t
  modified_base (417)..(417): a, c, t, g, unknown or other
  misc_feature (417)..(417): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccagcagtgacgttggtgttatactatgtctcctggtaccaacagcacccaggcaaacgcccccaaactcatgatttatgatgtacactaatcggccctcgtagggtttctaatcgcttctctggctcagtcnggcaacncgcctccngaccatctcgtggctccagctggaggacgagctgtattattacgngcagctcatatacaacgccacgagcacttctcttagttcgttcgttaccgggaacgttcggggaaccccttaacggggtccctaacccggtttaccgttaaacgtacccgaacggaccccccgtaaacgggaccccctaaacccccgttccg

SEQ ID NO: 198332 - DNA, 745 bp, Homo sapiens
  misc_feature: GYAE6OF01AVOK6.18.59.F04.1.454.CMB.1.raw
  modified_base (403)..(403): a, c, t, g, unknown or other
  misc_feature (403)..(403): n is a, c, g, or t
  modified_base (740)..(740): a, c, t, g, unknown or other
  misc_feature (740)..(740): n is a, c, g, or t
tcagtacgagtatgcacgaccggtgctcgatttagtacacacacttaagggattgggggcggtttgccgtgggtccgtagggcccaaggtctgcccgtgacgtcagcctagcctccggtgtctgggtctccctggactagtcgtatcacctatctcctgcactggaaccagccaggtgacgttggtggttataactactgtctcctggtaccaacagcaccaggcaaagccccgaaaatcaagtcgactttatgaatgtacaactaactcggccctacagggttttctaaatcgctttctactaggctacctaagttctaggctaaccacggccctcccgtagaacccagtcctcgtcgggcctccgaggcctgacggtacgtaggctagatttacttaccgngcgtacgctacattactacaaggcacgaggtccacgtctacgttattcgttacctttaccggaacttacgggaaccctaaacgggtccaacccggttacccgtacgggttacccgaaccggaccccggtaaacgggtaccccaaaacccccgtaagttcgggttaccctaaccgtttaccgttaccggttttacccccgacccctttaccctaacccttaaatttaacccgtttacgttaaccccgttagggtaaccgggttccgggggtaccttacgggggaaccctaaaacgggggtcccgtaaccggtaagttaaacggtcgatacgtacggtntacgg

SEQ ID NO: 198333 - DNA, 628 bp, Homo sapiens
  misc_feature: GYAE6OF01DCX3G.18.59.F04.1.454.CMB.1.raw
  modified_base (307)..(307): a, c, t, g, unknown or other
  misc_feature (307)..(307): n is a, c, g, or t
tcagtacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggagcgtggtcctgccgtgggacgtcgctgagactctcctgtgcagcctctggattcaccttcaatacctatgctttgctactgggtcccnccagacctccgaggcgaaggggccaaggagtggctgtcagtttattcatatgatggaactaatcaaatactacgcagtacctccgtaggaacgggtccgtattaccaaccctatacccgtaccgaacgggtaacctaaacgtttcccgaaaggaaccaccggtccttacggttacctactaaactaaacgttcgggaacctacggcccgttagaacgaacgtacggaaccgaccgaccggtctacggttacttaagtttagttcggtacggacggtaaggtacggtaacgttacggtttacggggtttactgggttaacgg

SEQ ID NO: 198334 - DNA, 705 bp, Homo sapiens
  misc_feature: GYAE6OF01EZJBA.18.59.F04.1.454.CMB.1.raw
  modified_base (213)..(213): a, c, t, g, unknown or other
  misc_feature (213)..(213): n is a, c, g, or t
  modified_base (244)..(244): a, c, t, g, unknown or other
  misc_feature (244)..(244): n is a, c, g, or t
tcagtacgagtatgcacgaccggtgctcgattttagtacacacacttagggagttggggggggtctcacggaggcagcgctcgtcgggacgttcctccaccgatggcctgggctctgactattcctcaccctcctcactcgagggtcacagggtcctgggccctagtcttgcccttgtactcgagcctgcctccgtgtctggtctcgtggacngtcggatcaccatcctcgtgcactggaaccngcaggttgacgttgggtgttataacgtattgtcttcctaggtaacccaacgacgtcaacccagggccaaaaccgccccccctaaaaacgtaccacgtacaggtactttagtagtagtacgttacgtaactaacgttccggtcccgtacgttacgggtttacgtaacgtacgtcttcttcgtcgtctacctacgtacgtcgacgaacgaccgaccgtccctaccgtacctacctcctccgtcggtaccgtaccgtacggtacgtacggaacggacggacggtacgtacgtacgttacttaacgtcgtaccgtacgtacctaagtacgtaacgtaagtacggacggtcgttacggttaggttacggtttacgttacgttacggttaccggttacggtacgttacggtacgggtaaccgtaacggtaccgtacccgttaccgttaacgtacgtaccggtacccg

SEQ ID NO: 198335 - DNA, 645 bp, Homo sapiens
  misc_feature: GYAE6OF01CQYKA.18.59.F04.1.454.CMB.1.raw
  modified_base (216)..(216): a, c, t, g, unknown or other
  misc_feature (216)..(216): n is a, c, g, or t
  modified_base (247)..(247): a, c, t, g, unknown or other
  misc_feature (247)..(247): n is a, c, g, or t
  modified_base (252)..(252): a, c, t, g, unknown or other
  misc_feature (252)..(252): n is a, c, g, or t
  modified_base (301)..(301): a, c, t, g, unknown or other
  misc_feature (301)..(301): n is a, c, g, or t
tcagtacgagtatgcacgaccggtgctcgatttagtacacacacttagggagttggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctccngcactggaaccagcagtgacgttggtgttanaactntgtctcctggtacaacagcaccaggcaaacgccccaaatcatgtattangatgtacactaatcgtcctgtacgggttctaactcgtcttcgtctcggctaccagtctcggacaaccacggcctcctagacctatccgtcgtcgggactccgagtccgtaggacggacgaggtctaggtactttagtacgtgacgtacgtctaacaatttaactaaaccggaactacccgaaccgaaatccctaaccttctaccgttaagttccggttaccgtttaccgggaaaaccgttcggggtaaaccctaaacgggttcccttaccccggtaccggttaaccgggaacccgtaacccggaacccctaaaccggggaaccccctaaacccccgttaaccgg

SEQ ID NO: 198336 - DNA, 509 bp, Homo sapiens
  misc_feature: GYAE6OF01B78KL.18.59.F04.1.454.CMB.1.raw
  modified_base (506)..(506): a, c, t, g, unknown or other
  misc_feature (506)..(506): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcaccaggcaaacgcccccaaactcatgatttatgatgtcagtaatcggccctcgagggtttctaatcgcttctctggctcaagtctggcaacacgcctcctgaccatctcgtggcctccgaggctggaggacgaggtctagatttattactgcagtctacatatacagcagcagcactcagtctacggaactcggaccaggtccacgtcctagtcacgaccaagcccaacccgntcg

SEQ ID NO: 198337 - DNA, 501 bp, Homo sapiens
  misc_feature: GYAE6OF01BYNGK.18.59.F04.1.454.CMB.1.raw
  modified_base (388)..(388): a, c, t, g, unknown or other
  misc_feature (388)..(388): n is a, c, g, or t
tcagtacgagtatgcacgaccggtgctcgatttagtacacacacttagggattggggggggtctcaggaggcagcgctctcgggacgtctccaccatggcctggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcctggtaccaacagcacccaggcaaagcccccaaactcatgatttatgatgtcactaatcggccctcaggggtttctaatcgcttctctgctcaagtctggcaacacggcctcctgaccatctctgggctcnggctgaggacgaggctgattatactgcagctacatatactaagcaccagcactctctatgtcttacggactgggaccaggtcaccgtctagtcacgacccacgccaccctacg

SEQ ID NO: 198338 - DNA, 521 bp, Homo sapiens
  misc_feature: GYAE6OF01AZG57.18.59.F04.1.454.CMB.1.raw
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgtcttctctggctccaagtctggcaacacggcctccctgaccatctctgggctccaggctgaggacgaggctgattatactgcagctcatatacaagcaccagcactctctatgtcttcggaacgtgggaccaaggtccaccgtcctagggtccacggaccccaagggcccaaccccgtacg

SEQ ID NO: 198339 - DNA, 554 bp, Homo sapiens
  misc_feature: GYAE6OF01CDTWS.18.59.F04.1.454.CMB.1.raw
  modified_base (527)..(527): a, c, t, g, unknown or other
  misc_feature (527)..(527): n is a, c, g, or t
  modified_base (538)..(554): a, c, t, g, unknown or other
  misc_feature (538)..(554): n is a, c, g, or t
tcagtacgagtatgcacgaccggtgctcgatttagtacacacacttagggattgggggctttgcctgggtgctgttggtaccaggagacatagttataaccaccatctcctgcactggaaccagcagtgacgttggtggttataactatgtctcctggtaccaacagcacccaggcaaagccccccaaactcatgatttatgatgtcactaatccggccctcgtaggggtttctaatcgcttctctggctccaagtctggcaacacgcctccctgaccatctcgtgggctccgaggctggaggacgaggctgtatttatactgcagctacatataacaagcaacagcactctctatgtcttacggaactgggacctaaggtcctaccgtcgtaggtccacgaccccgaacggaccccaacccctagtccgtccacttccgttccgttccctcgtccccccttccctaccctaacttacccttacggtacccttgggaccggtaccgggctcggggacaaggggcccncgtagtacgcnnnnnnnnnnnnnnnnn

SEQ ID NO: 198340 - DNA, 527 bp, Homo sapiens
  misc_feature: GYAE6OF01BSQL6.18.59.F04.1.454.CMB.1.raw
  modified_base (246)..(246): a, c, t, g, unknown or other
  misc_feature (246)..(246): n is a, c, g, or t
  modified_base (251)..(251): a, c, t, g, unknown or other
  misc_feature (251)..(251): n is a, c, g, or t
  modified_base (268)..(268): a, c, t, g, unknown or other
  misc_feature (268)..(268): n is a, c, g, or t
  modified_base (303)..(303): a, c, t, g, unknown or other
  misc_feature (303)..(303): n is a, c, g, or t
  modified_base (370)..(370): a, c, t, g, unknown or other
  misc_feature (370)..(370): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaaccagcagtgacgttggtgttanaactntgtctcctggtaccaanagcaccaggacaaacgcccccaaatcatgatttangatgtcactaatcgcctcgtagggtttctaatcgcttctctggctcaagtctggacacacgcctccngacctatctcgtgggcctccgaggtctggacggacgaggtctagtacttattactgcagtctagataatacaagccaaccctagactactctactactcgtcgttacggaacgtgggaacctaggtccacgtcaggtcacgccaacgcccaaccctg

SEQ ID NO: 198341 - DNA, 654 bp, Homo sapiens
  misc_feature: GYAE6OF01AQKGN.18.59.F04.1.454.CMB.1.raw
  modified_base (648)..(648): a, c, t, g, unknown or other
  misc_feature (648)..(648): n is a, c, g, or t
  modified_base (652)..(654): a, c, t, g, unknown or other
  misc_feature (652)..(654): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgcccccaaactcatgatttatgatgtcactaactccggccctcgtagggtttctaatcgtcttctctggctccagtctggcaacgcgccctcctcgaccatcctcgtggcctccgaggctaggacggacgaggtctagtatttacttacgtgcacgtacctataacttactaacaacgaccaaccgacgacctacttccttactacgttcggttaccgttaccgggtaacgtacgggtaaacctaccggtaccctacccggttcccgtaacgggtaccacccgaccccgtaaccggaccccctaaccccgtacgttacgtaccctaacccgttcccgtttacccggtccccccgtcccttacccgttaccctacgttaccgtccgtacgtcggaccggtccgggaccgttggaccgtacggccacgtagtaggctanccgnnn

SEQ ID NO: 198342 - DNA, 526 bp, Homo sapiens
  misc_feature: GYAE6OF01EPCF0.18.59.F04.1.454.CMB.1.raw
  modified_base (376)..(376): a, c, t, g, unknown or other
  misc_feature (376)..(376): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcaccaggcaaagcccccaaactcatgatttatgatgtcactaatcggccctcaggggttttctaagtcgcttctctggctccaagtctggcaacacggcctccngaccatctcgtggcctccaggctggaggtacgaggctgattatactgcagctcatatacaagcacagcactctctatcgtcttacggaacgtgggacctaaggtccaaccgttcctacggtcaacgacccgaacggcccaaacccctacg

SEQ ID NO: 198343 - DNA, 324 bp, Homo sapiens
  misc_feature: GYAE6OF01AMAQT.18.59.F04.1.454.CMB.1.raw
  modified_base (191)..(191): a, c, t, g, unknown or other
  misc_feature (191)..(191): n is a, c, g, or t
  modified_base (318)..(324): a, c, t, g, unknown or other
  misc_feature (318)..(324): n is a, c, g, or t
tcagtacgagtatgcacgaccggtgctcgatttagtacacacacttagggattggggagagaagacaggattcaggacaatctccagcatggccggcttccctctcctcctcaccctcctcactcactgtgcagggtcctgggcccagtctgtgctgactcagccaccctcagcgtctgggacccccgggnagagggtcaccatctcttgttctggaagcagctccaacatcggaagtcagcccaaggctcgccccctggtcactctgttcccgccctcctccatactcgtactgagcgggctggcaaggcgcatagnnnnnnn

SEQ ID NO: 198344 - DNA, 659 bp, Homo sapiens
  misc_feature: GYAE6OF01CUTZK.18.59.F04.1.454.CMB.1.raw
  modified_base (595)..(595): a, c, t, g, unknown or other
  misc_feature (595)..(595): n is a, c, g, or t
  modified_base (648)..(648): a, c, t, g, unknown or other
  misc_feature (648)..(648): n is a, c, g, or t
  modified_base (655)..(655): a, c, t, g, unknown or other
  misc_feature (655)..(655): n is a, c, g, or t
tcagtacgagtatgcacgaccggtgctcgatttagtacacacactttaggggtaggttgggggctttgacctgggtcctgggcccagggtctgccctagactcgagtcctgcctcccgtggtccttgggtcttccttggactagtcgatcgacctatctccgtgcctacgtggaaccagcagtgacgttcggtggtttactaactatcgtcgtcctggtaccaacagcgacccaggcgaacgccccaaatcaatgattaatgatcgcacttaattcggtccctccaacggggtttactaaatccgtactttctcttggactaccaagtctaggcaacacggccctccctagaccctatacttctggggcttccgacgggctaggacgggtaccaagggccttgaattacgttaactggacgagcgtacatactaactacgcaaccaagcaactctctactgtcttcggaactgggaaaccaaggttccacgtcctaaggtttacacgtccaacggcccaaacccacttacgtacctaacctttccttaccggttaccccaacccttcccgtaccgacgtaacccgtacgttacgnggtaacgtacccggggaacttcgggactaaagggcccgtacaacgttacgacntacgctntacc

SEQ ID NO: 198345 - DNA, 602 bp, Homo sapiens
  misc_feature: GYAE6OF01ATHMT.18.59.F04.1.454.CMB.1.raw
  modified_base (328)..(328): a, c, t, g, unknown or other
  misc_feature (328)..(328): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgtttggtggttataactatgtctcctggtaccaacagcaccaggcaaagcccccaaactcatgatttatgatgtcactaatcggccctnagggtttctaatcgcttctctgctcaagtctggcaacaccggcctccctgacctatcctcgtcgggtccttccgacggcgtgaacgggacggaggtccgtagtacgtttaattaaccgtgacacgtctactaattaactaaccgaaacgtccaaccctaacgacctaacccttcttaccttagttcggttccgttacggtaaccgtcggggaaccctaacgggtacctacccggttaccgtacggttaccaccgtcccgaaacggtaccccccg

SEQ ID NO: 198346 - DNA, 755 bp, Homo sapiens
  misc_feature: GYAE6OF01BUNDM.18.59.F04.1.454.CMB.1.raw
  modified_base (333)..(333): a, c, t, g, unknown or other
  misc_feature (333)..(333): n is a, c, g, or t
tcagtacgagtatgcacgaccggtgctcgatttagtacacacacttagggattggggggggtctcaggaggcagcgctctcgggacgtctccaccatggcctggctctgctattcctcaccctcctcactcagggcacagggtcctgggcccagtctgccctgactcagcctgcctccgtgtctgggtctccgtggacagtcgatcaccatctcctgcactggaaccagcaggtcgtacgttggtaggttaataactatgtccttccgtaggtaaccaacacgaccacccaaggaccaaaaccgacccccaaaactcaagttagtaattttanggtattcgtactaactaacgtccggtcccttaggttaacgggtttactaacgtccgtctttaccgtcgttacgggcccttaccgaacggtttcgtacggaccaaacccgtaccggtccccttacccgtacgaacccttactcccgttcggtcgggtccgttaccgacggtccgtagggaacgggtacggacggtcgttagtaactttaacttacgtacgacgtacgtcctacctaagtaaacgttaaccaacgaccgtaaccaaccgtacctaaccttccttaccgttaggttaccgttacccggttaacgggtaaccggtaaccgggtaacccgtaaacgggttacccgttaccccggttaccgtacgggttaaccgacccggttaacccgaacccggaacccccgtaaaccccgtacccg

SEQ ID NO: 198347 - DNA, 543 bp, Homo sapiens
  misc_feature: GYAE6OF01AHF7M.18.59.F04.1.454.CMB.1.raw
  modified_base (471)..(471): a, c, t, g, unknown or other
  misc_feature (471)..(471): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcaggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgcccccaaatcatgatttatgatgtcactaatcggccctcgaggggttttctaatccgcttcctctggtctaccaagtctcggcaaccacggccctccctgaccctatctccgtgggcctccgaggctaggacggacgaggctgatttacttactgcagtctacatataacagtccacagcacctcncttatcgtcttcggaacgtcgggacctaaggtccaccgtcctaggtccacgacccaacgcccaacccgtacg

SEQ ID NO: 198348 - DNA, 558 bp, Homo sapiens
  misc_feature: GYAE6OF01B2R9U.18.59.F04.1.454.CMB.1.raw
  modified_base (242)..(242): a, c, t, g, unknown or other
  misc_feature (242)..(242): n is a, c, g, or t
  modified_base (247)..(247): a, c, t, g, unknown or other
  misc_feature (247)..(247): n is a, c, g, or t
  modified_base (304)..(304): a, c, t, g, unknown or other
  misc_feature (304)..(304): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggngttanaactatgtctcctggtaccaacagcaccaggcaaacgcccccaaactcatgatttangatgtcagtaatcggccctgtagggtttctaagtcgcttctctggctccaagtctggcaacacggcctccgtcgaccatctcgtcgggcctccgaggctggagggacgaggtctaggtactttacgttactcggcctagtctacaataactaacaagcaagcagaccactacaacgttcttacggaacgtagggacctaaggtccaccggtacctaggtccacgacccgaaacggccccaaaccccgcgtaccg

SEQ ID NO: 198349 - DNA, 598 bp, Homo sapiens
  misc_feature: GYAE6OF01AGUHL.18.59.F04.1.454.CMB.1.raw
  modified_base (228)..(228): a, c, t, g, unknown or other
  misc_feature (228)..(228): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtggttataactatgtctcctggtaccaacagcacccaggcaaacgtccccaaactcatgatttatgatgtcactaatcggccctcgtaggggtttctaatcgtcttctcgtcggctccaagtctcggcaacacgcctccctcgacctatctcgtcgggctccgacggctaggacggacggaggtctagtatttaacttacgtgcagtctacgatacgtaacaacgtacaccagcacctcctacgttactcgttccgttaccgggtaacgtcgggtaacccgtaacggtcccgtacccggttacccgttacggtacccgtaacggaaccccgaacggaccccctaaccccgtaacccg

SEQ ID NO: 198350 - DNA, 523 bp, Homo sapiens
  misc_feature: GYAE6OF01DFVD5.18.59.F04.1.454.CMB.1.raw
  modified_base (228)..(228): a, c, t, g, unknown or other
  misc_feature (228)..(228): n is a, c, g, or t
  modified_base (242)..(242): a, c, t, g, unknown or other
  misc_feature (242)..(242): n is a, c, g, or t
  modified_base (254)..(254): a, c, t, g, unknown or other
  misc_feature (254)..(254): n is a, c, g, or t
  modified_base (261)..(261): a, c, t, g, unknown or other
  misc_feature (261)..(261): n is a, c, g, or t
  modified_base (307)..(307): a, c, t, g, unknown or other
  misc_feature (307)..(307): n is a, c, g, or t
  modified_base (325)..(325): a, c, t, g, unknown or other
  misc_feature (325)..(325): n is a, c, g, or t
  modified_base (368)..(368): a, c, t, g, unknown or other
  misc_feature (368)..(368): n is a, c, g, or t
  modified_base (427)..(427): a, c, t, g, unknown or other
  misc_feature (427)..(427): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggnggttataactangttttcncctggtaccaacagcaccaggcaaacgcccccaaatcatgatttangatgtcactaatcgcctnaggggtttctaatcgcttctctggctccaagtctggactaacncggacctccctgacccatctctgggccttccaggctggaggacgaggctgatttatacngcagctcataatacaagcacagcactctctatcgtcttacggaacgtgggaccaaggtcaccgtctaggtcacgcccaaacggcccaaaccctacg

SEQ ID NO: 198351 - DNA, 525 bp, Homo sapiens
  misc_feature: GYAE6OF01CYZG3.18.59.F04.1.454.CMB.1.raw
  modified_base (229)..(229): a, c, t, g, unknown or other
  misc_feature (229)..(229): n is a, c, g, or t
  modified_base (436)..(436): a, c, t, g, unknown or other
  misc_feature (436)..(436): n is a, c, g, or t
  modified_base (446)..(446): a, c, t, g, unknown or other
  misc_feature (446)..(446): n is a, c, g, or t
  modified_base (463)..(463): a, c, t, g, unknown or other
  misc_feature (463)..(463): n is a, c, g, or t
  modified_base (493)..(493): a, c, t, g, unknown or other
  misc_feature (493)..(493): n is a, c, g, or t
  modified_base (520)..(520): a, c, t, g, unknown or other
  misc_feature (520)..(520): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaaccngcagtgacgttggtagttataactatgtctcctggtaccaacagcaccaggcaaacgcccccaaatcatagtattatgtatgtacactaatccggccctcagggttctaatcgcttctctggctccagtctcggcaacgacgcctccctgacccattcctcgtacgggctaccgaggtcgtgacggacgaggtctagtattattacngtcagtctanataatacagtacagcancactcaagtctacggaactggacaggtacncgtactagtcacgaccacgaccacccngtacg

SEQ ID NO: 198352 - DNA, 642 bp, Homo sapiens
  misc_feature: GYAE6OF01DOCAZ.18.59.F04.1.454.CMB.1.raw
  modified_base (303)..(303): a, c, t, g, unknown or other
  misc_feature (303)..(303): n is a, c, g, or t
tcagtacgagtatgcacgaccggtgctcgatttagtacacacacttagggagttggggggggtctcaggaggcagcgctctcgggacgtctccaccatggcctggctctgctattcctcaccctcctcactcagggcacagggtcctgggcccagtctgccctgactcagcctgcctccgtgtctgggtctcctggacagtcgatcaccatcctcctgcactggaaccagcagtgacgttggtgttataacgtatgtctctggtaccaacagcaccaggcaaacgccccaaatcatgatttangatgtcactaactcggcccttacgtacgggtttctaagtcgtcttctcgtcggtctaccgtaagtcgtcgggacaacgaccggtccctcccgtcgaccctactccgtcgtcgggccttccgacggtcgtaggacgggaacggaggtccgtaggtaactttacttaccgtcgacgtacgtcttacctaagttaactaaccgaagtacccaacgtaagccctaacgtccttacttagttcgtacgtttaccgggaacgttcggggaacccttaacgggtccgtaacccggttaccgtacggtaccaacggtaccccgaacggtaccccaccccgtaacccg

SEQ ID NO: 198353 - DNA, 579 bp, Homo sapiens
  misc_feature: GYAE6OF01DM63C.18.59.F04.1.454.CMB.1.raw
  modified_base (227)..(227): a, c, t, g, unknown or other
  misc_feature (227)..(227): n is a, c, g, or t
  modified_base (252)..(252): a, c, t, g, unknown or other
  misc_feature (252)..(252): n is a, c, g, or t
  modified_base (300)..(300): a, c, t, g, unknown or other
  misc_feature (300)..(300): n is a, c, g, or t
tcagtacgagtatgcacgaccggtgctcgatttagtacacacacttagggattggggggggtatcaggaggcagcgctctcgggacgtctccaccatggcctgggctctgctattcctcaacctcctcactcagggcacagggtcctgggcccagtctgccctgactcagcctgcctcgtgtctgggtctcctggacagtcgatcaccatctcctgcactggaaccngcagtgtacgttggtgttataactntgtctctggtaccaacagcaccagacaacgccccaaatcatgatttangatgtacactaactcgcctgtagggtttctaatcgtacttctctcggtctaccaagtctcggacaacgacgtccctccctggacctactctcgtcgggacctccgaaggtctggacggacggaggctagtaatttactacgtgactagtcctactaatataacagcctaaccagcctacgttctacttacgttgtacccgtttaggaaccgtacgggacctaacggtcccaccggttaccgtacggtccacgaccccgaacgtccccgaacccgtaccg

SEQ ID NO: 198354 - DNA, 530 bp, Homo sapiens
  misc_feature: GYAE6OF01D6AP8.18.59.F04.1.454.CMB.1.raw
  modified_base (228)..(228): a, c, t, g, unknown or other
  misc_feature (228)..(228): n is a, c, g, or t
  modified_base (458)..(458): a, c, t, g, unknown or other
  misc_feature (458)..(458): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtggttataactatgtctcctggtaccaacagcaccaggacaaacgcccccaaactcatgatttatgatgtcagtaatcggccctgagggtttctaagtcgcttctcgtggctccaagtctggcaacgcggcctcctagaccatctcgtcgggcctcgaggcgtgaggacgaggctagtattatactgcagtctacatatacaagccacagcactctntatcgtcgtacgaacgtggaccaaggtccaccggttctaacggtcaacggacccaacggccccaaccctacg

SEQ ID NO: 198355 - DNA, 653 bp, Homo sapiens
  misc_feature: GYAE6OF01CRUAJ.18.59.F04.1.454.CMB.1.raw
  modified_base (220)..(220): a, c, t, g, unknown or other
  misc_feature (220)..(220): n is a, c, g, or t
  modified_base (232)..(232): a, c, t, g, unknown or other
  misc_feature (232)..(232): n is a, c, g, or t
  modified_base (256)..(256): a, c, t, g, unknown or other
  misc_feature (256)..(256): n is a, c, g, or t
tcagtacgagtatgcacgaccggtgctcgatttagtacacacacttagggagttggggggggtctcaggaggcagcgctctcgggacgtctccaccatggcctgggctctgctattcctcaccctcctcactcagggcacgagggtcctgggcccagtctgccctgactcagcctgcctcgtgtcctgggtctccgtggacagtccgatcaccatctccngcactggaaccngcagtgacgttggtgttataactntgtctcctggtaccaacagccaccaggacaaacgccccaaactcatcgtatttatgactgtacactaacgtccggccctgtacggggtttctaagtcgtccttctcgtcgggctcgaacgtcttacgggaccaaccgtaccgtcccttacccgtacggtaaccctacgttcctccggtcgggtaccttccggaacggtcgtacgggaacggaccggaggtctagtacgtttacgttacgcgtacgtacgtctactaagttaacgtaacaacggccaaccgtacgccctaacttcctacgttagttacgtaccgtttacggaaccgttacggggaaccctaacggtccgtacccgtcgttacggtacaccgacccgaacgtaccccaacccgttaccg

SEQ ID NO: 198356 - DNA, 576 bp, Homo sapiens
  misc_feature: GYAE6OF01BKJC8.18.59.F04.1.454.CMB.1.raw
  modified_base (255)..(255): a, c, t, g, unknown or other
  misc_feature (255)..(255): n is a, c, g, or t
  modified_base (440)..(440): a, c, t, g, unknown or other
  misc_feature (440)..(440): n is a, c, g, or t
  modified_base (449)..(449): a, c, t, g, unknown or other
  misc_feature (449)..(449): n is a, c, g, or t
  modified_base (569)..(569): a, c, t, g, unknown or other
  misc_feature (569)..(569): n is a, c, g, or t
tcagtacgagtatgcacgaccggtgctcgatttagtacacacacttagggattggggggggtctcaggaggcagcgctctcgggacttctccaccatggcctgggctctgctattcctcaccctcctcactcagggcacagggtcctgggcccagtctgccctgactcaacctgcctccgtgtctgggtctcctggacagtcgatccaccatcctcctgcactggaaccagcagtgacgttggtggttataactntgtctcctggtaccaacagcacccaggccaaagccccccaaactcatgatttatgatgtcactaatcggccctctaggggtttctaatcgtcttctctcggctccaagtctggcacgacggccctcctcgaccactctcgtcgggcttccgaggtctaggaggaccgaggtctgtatttattacngtcagctanatatacaagtccaaccgtacgcctaactctacgtattcgttacttccgggaacttacgggacccgtaaggtccgtacccgtccgttaaggtccacggacccgaaacgccccaaaccccgngtacccg

SEQ ID NO: 198357 - DNA, 611 bp, Homo sapiens
  misc_feature: GYAE6OF01AUMC8.18.59.F04.1.454.CMB.1.raw
  modified_base (367)..(367): a, c, t, g, unknown or other
  misc_feature (367)..(367): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaaccagcagtgacgttggtgttatactatgtctcctgtaccaacagcaccaggcaaacgcccccaaactcaatgatttatgatgtcataatcgccctcgtagggttctaatcgcttctcgtggctccgaagtctaggcaacnccggccctccctcgacccatccttccgtgggcctccgaggtcctagggacgaccggacggcttaggactttacttaactgacacgtctactaatacgtaacaacgccaacccgacgcctacctcttaccgttagtccggttacgtttaccgggaacgttaccgggaacccgttaaacgggttcccgtaaccccgttacccggttaacggtacccgaaccggccccgtaaacgggaacccccccg

SEQ ID NO: 198358 - DNA, 515 bp, Homo sapiens
  misc_feature: GYAE6OF01BSA9I.18.59.F04.1.454.CMB.1.raw
  modified_base (509)..(509): a, c, t, g, unknown or other
  misc_feature (509)..(509): n is a, c, g, or t
  modified_base (511)..(513): a, c, t, g, unknown or other
  misc_feature (511)..(513): n is a, c, g, or t
  modified_base (515)..(515): a, c, t, g, unknown or other
  misc_feature (515)..(515): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggcctcagggtttctaatcgcttctctggctccaagtctggcaacacggcctcctgaccatctctggctccaggctgaggacgaggctgattatactgcagctcatatacaagcaccagcactctctatgtctcggaactggaccaaggtcaccgtctaggtcacgcccaacgcccaaccccgactgtccacttcctaccgttccccgcccttcctacctactaccttcgtacgtcgacggccggctggacgaaggcacatacgnannngn

SEQ ID NO: 198359 - DNA, 752 bp, Homo sapiens
  misc_feature: GYAE6OF01EVAC3.18.59.F04.1.454.CMB.1.raw
  modified_base (231)..(231): a, c, t, g, unknown or other
  misc_feature (231)..(231): n is a, c, g, or t
  modified_base (246)..(246): a, c, t, g, unknown or other
  misc_feature (246)..(246): n is a, c, g, or t
  modified_base (256)..(256): a, c, t, g, unknown or other
  misc_feature (256)..(256): n is a, c, g, or t
  modified_base (272)..(272): a, c, t, g, unknown or other
  misc_feature (272)..(272): n is a, c, g, or t
tcagtacgagtatgcacgaccggtgctcgatttagtacacacacttagggagttgggggggggtctcaggaggcagcgctctcgggacgtctccaccatggcctgggctctgctattcctcaccctcctcactcagggcacagggtcctgggcccagtctgccctgactcaacctgcctccgtgtctgggtcctcctggacagtcatcaccatcctcctgcactggaaccngcaggtgacgttggngttataactntgtctctggtaccacngcaccaggacaaacgaccccaaatcatgtatttatgtatgtacagtacgtccggcctcgtagggtttctaagtcgtacttcgtcgtcgtctacgtaagtcgtaggaccaaccgcggtccctacccgtaggaccctagttccgtcgtcgggtcccttaccggaggtcgttagggacggtaacggacgggtacttacggtaacttttacgttaccgacggtcctaacggtcctttaacgtaagttaacttaaaccgaaggtaccaacgggtaccaaacggtaccttaaccgttaaccgtaaaccggtttacccggttaacccgggtaaaccggtaaccggggaaccccgttaaacggggttaacccccggtaaccccgggtttaaccggttaacccggggtaacccgtaaaccccgggtaacccccggtaaaacccgggtaacccccctaaacccccggtaccggttccggttaaacccccg

SEQ ID NO: 198360 - DNA, 680 bp, Homo sapiens
  misc_feature: GYAE6OF01CC1EO.18.59.F04.1.454.CMB.1.raw
  modified_base (231)..(231): a, c, t, g, unknown or other
  misc_feature (231)..(231): n is a, c, g, or t
  modified_base (302)..(302): a, c, t, g, unknown or other
  misc_feature (302)..(302): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgtataactatgtctctgtaccaacagcaccaggcaaacgccccaaatcatgatttangatgtacactaactcgccctacgtacgggtttctaacgtcgtcttctcgtcggtctaccgtaagtcgtaggacaaacgtacggccctccctacgacctacttccgtcgtacgggtctacccgaggtcgtacggaacggaccggagggtccgttagtaactttacgtttaacgtcgtacgtaacgtcttactaacttaaacgtaaccgtaacgaccaacccgtaacggtacctaaccttcttaccgttagtttaccggtttaccgtttaacgggtaaacccggttaccggggtaaacccgtaaacgggttaccccgtaacccgttaccggttaaccggttacccgaacccggtacccccggaaacgggtaaaccccccc

SEQ ID NO: 198361 - DNA, 508 bp, Homo sapiens
  misc_feature: GYAE6OF01DLA0J.18.59.F04.1.454.CMB.1.raw
  modified_base (379)..(379): a, c, t, g, unknown or other
  misc_feature (379)..(379): n is a, c, g, or t
  modified_base (385)..(385): a, c, t, g, unknown or other
  misc_feature (385)..(385): n is a, c, g, or t
  modified_base (403)..(403): a, c, t, g, unknown or other
  misc_feature (403)..(403): n is a, c, g, or t
  modified_base (406)..(406): a, c, t, g, unknown or other
  misc_feature (406)..(406): n is a, c, g, or t
  modified_base (421)..(421): a, c, t, g, unknown or other
  misc_feature (421)..(421): n is a, c, g, or t
  modified_base (428)..(428): a, c, t, g, unknown or other
  misc_feature (428)..(428): n is a, c, g, or t
  modified_base (438)..(438): a, c, t, g, unknown or other
  misc_feature (438)..(438): n is a, c, g, or t
  modified_base (445)..(445): a, c, t, g, unknown or other
  misc_feature (445)..(445): n is a, c, g, or t
tcagtacgagtatgcacgaccggtgctcgatttagtacacacacttagggagttgggggctggggtctcaggaggcagcgctctcgggacgtctccaccatggcctgggctctgctattccctcaccctcctcactcagggcacagggtcctgggcccagtctgccctgactcaacctgcctccgtgtctgggtctcctggacagtcgatcaccatcctcctgcactggaaccagcagtgacgttggtgttataactatgtctcctgtaccaacagcaccaggcaaacgcccccaaactcactagatttatgatgtacactaatcgccctcagggtttctaatcgcttctctgctcagtctgcacacgcctcctcgacntctcgnggactcagctgacgacgngcngattatctgcagctnatataanacgcacatcnctctctntgtcgtacggaacgtggaccgagtccgaccgtacgtaggaccagacccagcccctaaaccccg

SEQ ID NO: 198362 - DNA, 636 bp, Homo sapiens
  misc_feature: GYAE6OF01CO0PH.18.59.F04.1.454.CMB.1.raw
  modified_base (228)..(228): a, c, t, g, unknown or other
  misc_feature (228)..(228): n is a, c, g, or t
  modified_base (252)..(252): a, c, t, g, unknown or other
  misc_feature (252)..(252): n is a, c, g, or t
  modified_base (478)..(478): a, c, t, g, unknown or other
  misc_feature (478)..(478): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataactntgtctcctggtaccaacagccacccaggccaaaacgcccccaaaactcaatgtaatttatgatgtacactaactccggtccctacgtaggggtttctaatcgtcttctctggctcaagtctggcaacgcgcctccctgaccatctcgtcgggcctccgaggctggacgggacgaggtctagtatttatactgctagtcctacgaattactaacgacgtaaaacccnccgtacgtacctaccttcttacgttacgttcgttacccgttaaccgggtaaccggttaccggggtaacccgtaaccgggttccccgttaccccggttacccggttaccggtacccgaacccggacccccgaaacccggtaccccctaaaccccgtacg

SEQ ID NO: 198363 - DNA, 621 bp, Homo sapiens
  misc_feature: GYAE6OF01DJE6R.18.59.F04.1.454.CMB.1.raw
  modified_base (231)..(231): a, c, t, g, unknown or other
  misc_feature (231)..(231): n is a, c, g, or t
  modified_base (305)..(305): a, c, t, g, unknown or other
  misc_feature (305)..(305): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctcgtgtctgggtctccgtggacagtcgatcaccatctcctgcactggaaccngcagtgacgttggtgttatactatgtctctggtaccaacagcaccaggcaaacgccccaaatcatgtactttangatgtactactaatccggcctagtacgggtttactaactcgtcttctcgtgcctacaagtcgtgacaacgacggcccttcccgtagaccattccgtcgttcgggaccttccgaacggtcttacgggaacggtaacggacggtcttaggtaactttaacttcgtaggtactacggtacctactaacgttactaaccgaaacgaccaaccgacgtaacctcgttaccttacgtacttcggtttacttaccggacgttacggaacccgtaacggtacctacccgtacgtacgtaccacccgtacccgacggtaaccccc

SEQ ID NO: 198364 - DNA, 617 bp, Homo sapiens
  misc_feature: GYAE6OF01CKP9O.18.59.F04.1.454.CMB.1.raw
  modified_base (252)..(252): a, c, t, g, unknown or other
  misc_feature (252)..(252): n is a, c, g, or t
  modified_base (268)..(268): a, c, t, g, unknown or other
  misc_feature (268)..(268): n is a, c, g, or t
  modified_base (301)..(301): a, c, t, g, unknown or other
  misc_feature (301)..(301): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactntgtctctggtacaacngcaccagacaacgaccccaaatcatgtatttangatgtacactaactccggccctcgtacggggtttactaacgtcgtcttctcgtcggtcctacgtaacgtctcggacaacgtaccgccctcctacgacctactcctcgtcggtcctaccgaggtcgtaggaacggtacggacggtactaggtaacttagttacgcgtacacgtctacgtaataactaacgaacgacctaaccgacgtacctacgtctacgttactcgtaccgtacggtaacgtacgggtaaccgtaacggtccgaaccgttccgtacggtaccgtaaccgaacccgaaccgaccccaacccgtaccg

SEQ ID NO: 198365 - DNA, 802 bp, Homo sapiens
  misc_feature: GYAE6OF01DI2CG.18.59.F04.1.454.CMB.1.raw
  modified_base (313)..(313): a, c, t, g, unknown or other
  misc_feature (313)..(313): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcactggaaccagcagtgtacgttgggtagttaataactatgtcctcctggtaccaacagccaccgaggacaaacgcccccaaatcatgtatttanagtatcgtactaactaacgtccggccctcggtacgggtttactaacgtcgtcctttcgtcgtcggtacctaccgtaagtccgttacgggacctaaaccggacccggtccccctttaccccgtacgtaacccctacgtttcccgttacccggtcggggtaccccttacccggaacgggtccgttaacgggacggggtaaccggtaagggtaccgttagggttaaattttaaccgttaaccgttcgaccgtacggtaccttacctaaagttacgtaaacccgaagtacccaaaccgtacgtacccttaacctttccgttaacctttagtttacccggtttaccggttaacccggggtaaacccgttaaccgggggtaaaccctaacccggggttccccttaaaccccgggttacccgttaaccgggttaacccgaaccccgggtaacccccggtaaccccgggtaaacccccaaccccccggttaaacccg

SEQ ID NO: 198366 - DNA, 732 bp, Homo sapiens
  misc_feature: GYAE6OF01B511D.18.59.F04.1.454.CMB.1.raw
  modified_base (250)..(250): a, c, t, g, unknown or other
  misc_feature (250)..(250): n is a, c, g, or t
  modified_base (268)..(268): a, c, t, g, unknown or other
  misc_feature (268)..(268): n is a, c, g, or t
  modified_base (302)..(302): a, c, t, g, unknown or other
  misc_feature (302)..(302): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgtatactntgtctcctggtaccaacngcacccaggcaaacgcccccaaatcatgatttangatgtacactaatccggccctcgtacggggttttctaagtccgtctttctcgtggccttaccgaagttcgtacgggaccaaaccgacccgggtcccttccccgtacggaccctaagttcccttccggttcggggtccctcccgaagggtccttagggaaacgggaaccggtaggggtaccttaggtaactttttaacgttaaccgtggacctacggtccttacaagttaactaaccgtaaaggccctaaaccgacgtacctaaccgttcttaccttagttcgtttacccgtttaccggggtaaaccgttcgggggtaaaccccgtaaacggggttcccctaaccccgggtttacccggttaacggggtacccgtaacccggtaacccccgaaaaccgggggtccccccctaaaaccccccgttaaccggg

SEQ ID NO: 198367 - DNA, 815 bp, Homo sapiens
  misc_feature: GYAE6OF01CEBOD.18.59.F04.1.454.CMB.1.raw
  modified_base (215)..(215): a, c, t, g, unknown or other
  misc_feature (215)..(215): n is a, c, g, or t
  modified_base (268)..(268): a, c, t, g, unknown or other
  misc_feature (268)..(268): n is a, c, g, or t
  modified_base (301)..(301): a, c, t, g, unknown or other
  misc_feature (301)..(301): n is a, c, g, or t
tcagtacgagtatgcacgaccggtgctcgatttagtacacacacttagggattggggggggtctcaggaggcagcgctctcgggacgtctccaccatggcctggctctgctattcctcaccctcctcactcagggcacagggtcctgggcccagtctgccctgactcagcctgcctccgtgtctgggtctcctggacagtcgatcaccatctccngcactggaaccagcagtgacgttggtaggttataactatgtctctggtacaanagcaccaggacaacgaccccaatcatgatttangatgtactactaacgtccggtaccctcgtacggggttttactaaacgttcgtccttcgtcttcggccttaccgtaacgtcgttacgggacaacccgtacccggtcccttaccccgttacggaaccctacgttcccgttccggttcggggaccctttacccgaacgggtcccgttagggaaccggggaacccggtaaaggggtacccttaggttaaacgtttttaacgtttaacccgtcgggtaccctaacgggtacccttaacgtaaacttttaaacttaaacccgaaacgggtaaaccccctaacccggaacgtaccccttaaacccgtttccctttaccgtttaaaacgttccgttaaacccgggttttaacccgggaaaaccgggtttaccgggggaaaccccgttaaaccggggttaccccgttaaccccggtacccggtttaaaccgggttacccgaaaccggaaccccccggtaaaaccggaacccccgtaaacccccttaacccggg

SEQ ID NO: 198368 - DNA, 556 bp, Homo sapiens
  misc_feature: GYAE6OF01EAB4U.18.59.F04.1.454.CMB.1.raw
  modified_base (492)..(492): a, c, t, g, unknown or other
  misc_feature (492)..(492): n is a, c, g, or t
  modified_base (539)..(556): a, c, t, g, unknown or other
  misc_feature (539)..(556): n is a, c, g, or t
tcagtacgagtatgcacgaccggtgctcgatttagtacacacacttagggattgggggctttgcctgggtgctgttggtaccaggagacatagttataaccaccatctcctgcactggaaccagcagtgacgttggtggttataactatgtctcctggtaccaacagcacccaggcaaagccccccaaaactcatgatttatgatgtcactaatcggccctcaggggttttctaatcgctttctctggctccaagtctggcaacacggccctccctgacccatcctcgtcgggcctcccgaggctggaggacgaggctgtatttattactgcagctcatatacaagccaccagcactctactatgtcttcggactcggaccaaggtccaccggttcctaaggtccacgaccccgaacggccccaaccccacttcgtaccaccttctcccgtttcccccaccccttccctaccctacttcccttcgttaaccncgggtacggccgggtctacgggacctaacgggccgacagtaggcagnnnnnnnnnnnnnnnnnn

SEQ ID NO: 198369 - DNA, 661 bp, Homo sapiens
  misc_feature: GYAE6OF01EVSQM.18.59.F04.1.454.CMB.1.raw
  modified_base (247)..(247): a, c, t, g, unknown or other
  misc_feature (247)..(247): n is a, c, g, or t
  modified_base (252)..(252): a, c, t, g, unknown or other
  misc_feature (252)..(252): n is a, c, g, or t
  modified_base (266)..(267): a, c, t, g, unknown or other
  misc_feature (266)..(267): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcacgtgaaccagcagtgacgttggtagttanaactntgtctctgtaccanncaccagacaacgccccaaactcatgtatttactgatcgtacaacgttaactccggtcctcgtacgggtttactaacgtcgtcttctcgtggcctcgaagtctcgggacaacgtaccggcccttccctagacctacgttcctcggcggtctccgagtcgtggaacggtacgaggtacctaggtaatttacgtacgtcgctacgcttacgaatacgttaacaacggtaccaaccgacggtactactaccgttaccgttacgtttacggttacccgttaaccgggtaaccggttaccgggtaaaccgttaaaccgggtcccgttaaacccggtcgttaaaccgggttacccacccggaaaccccgacccgggttaacccccaaacccgtttaacccg

SEQ ID NO: 198370 - DNA, 573 bp, Homo sapiens
  misc_feature: GYAE6OF01D4I43.18.59.F04.1.454.CMB.1.raw
tcagtacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgctattttaaaggtgtccagtgtgaggtgcagctggtggagtcgtgggggaggcttgggtaaaggccgggggggtcccttagactcccctgtacagcctctggattcactttcagtaaggcctggatgaactgggtccgcaggctccgagggagggctggagtgggtggccgtataaaaccaaactgatggtggacaacagactacgctgccaccgtagaaaggcagattcaccatctacaagagatgaattacaaaagcacgctagtatctagacaaatgaacagcctagaacgaaccgaggaacacgacgaccgttagtacttactacgtaccactacctaccccgtagaaacgtcgtacaactactactaacgtacgtactacggaccctcgtcgggaacccg

SEQ ID NO: 198371 - DNA, 841 bp, Homo sapiens
  misc_feature: GYAE6OF01BR0N4.18.59.F04.1.454.CMB.1.raw
  modified_base (202)..(202): a, c, t, g, unknown or other
  misc_feature (202)..(202): n is a, c, g, or t
  modified_base (233)..(233): a, c, t, g, unknown or other
  misc_feature (233)..(233): n is a, c, g, or t
  modified_base (837)..(837): a, c, t, g, unknown or other
  misc_feature (837)..(837): n is a, c, g, or t
tcagtacgagtatgcacgaccggtgctcgatttagtacacacacttagggattggggagagagacccctccctgggatcctgggcccagtctgccctgactcagcctgcctccgtgtctgggtctcctggacagtcgatcaccatctcctgcactggaaccagcagtgacgttggtgttataactatgtctctggtaccaangcaccagcaaacgccccaaatcatgatttangatgtcaactaatccggcctgtagggttttcaatcgtcttctcgtcggcctaccaacggttctacggaccaaaaccgtaccggtccccttcccgttacggaacccactttccgtccggtttcgggggcccttacccggaacgggtcgttacgggaaacgggtaaccggacgggtacgttaggttaaacttttaacgtttaacccggttggtacccaaacggttccttaacccgtaaatttaaacttaaacccgaaaacggtacccaacccgttaaacggaccctaaccgtttacttaacctttacgttacggtttacccgtttaaaccggggtaaacttaccggggaaaccgtaaccgggttaaccccgtaacccggttaccggtttaaccggtacccgaaccgggtaacccccaaacccggggtaacccccctaaaacccccggttacgtacccgttaacccgtaccccttttacccgtttacccccgttacccccctaacccttccccccgtaacttaaccgttacccgtaacccgttacggttacgggaccgggaccgggttccggacgggtaaccgaaccggggtccacgtaattacggncgag

SEQ ID NO: 198372 - DNA, 658 bp, Homo sapiens
  misc_feature: GYAE6OF01DYX26.18.59.F04.1.454.CMB.1.raw
  modified_base (217)..(217): a, c, t, g, unknown or other
  misc_feature (217)..(217): n is a, c, g, or t
  modified_base (237)..(237): a, c, t, g, unknown or other
  misc_feature (237)..(237): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacgagggtcctgggcccagtctgccctgactcagcctgcctccgtgtcgtgggtctccgtggacagtcgatcaaccntcctcctgcacgtggaaccngctaggtgtacggttggtagttaataactatcgtctccgtacgtaaccaacacgaccaccgacggaccaaaccgaccccctaaactcaacttagtaatttagtagtattcgtactaactacgtccggtacccttacggtacgggtttactaacgttccggtctttacgtcgtcggtaccttaccgtaacgttcgacgaccctaaccgtaccggtccctccgtacgtacctacgttccgtcgtacgggtcctacggagtcgtaggacggacgtagtctagtactttatacgtgactgtctactaatactaacgaacaccacacgctacttcgtatcgttaccgttacgttacggacgtaccggtaccgtaacggttccctaccggtacgttacgacctacccgaaccgtacccggtaacccc

SEQ ID NO: 198373 - DNA, 505 bp, Homo sapiens
  misc_feature: GYAE6OF01DS7Y1.18.59.F04.1.454.CMB.1.raw
  modified_base (437)..(437): a, c, t, g, unknown or other
  misc_feature (437)..(437): n is a, c, g, or t
  modified_base (490)..(505): a, c, t, g, unknown or other
  misc_feature (490)..(505): n is a, c, g, or t
tcagtacgagtatgcacgaccggtgctcgatttagtacacacacttagggattgggggctttgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggccctccctgaccatctctgggctcccaggcctggaggacgaggctgtatttattactgcagctcatatacaagcaaccagcactctctatcgtcttacggaactgggaccaaggtcctaccgtcctaggtcacgcccaacggcccaacccactcgtaccaccttacctccgttcccccaccttcccnccacttactccgttacctggacgccgggtctcggacgaacggcgacagtagcnnnnnnnnnnnnnnnn

SEQ ID NO: 198374 - DNA, 627 bp, Homo sapiens
  misc_feature: GYAE6OF01DII3K.18.59.F04.1.454.CMB.1.raw
  modified_base (228)..(228): a, c, t, g, unknown or other
  misc_feature (228)..(228): n is a, c, g, or t
  modified_base (252)..(252): a, c, t, g, unknown or other
  misc_feature (252)..(252): n is a, c, g, or t
  modified_base (307)..(307): a, c, t, g, unknown or other
  misc_feature (307)..(307): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataactntgtctctggtaccaacagcaccaggacaaacgcccccaaaactcactgactttangatgtacactaatcggccctcgtagggttctaatcgtcttctctggctcgaagtctggacaacgccgtcctcctagaccatcctcgtggctccgagctggacggacgaggctagtattacgttactgccagtctactaagttactaaccgaagaccctaaccgacgtcctaaccgtcttaccttacgttaccgttccgttaaccgggtaacgtacccggggtaaaccgtaaccgggttacccgtacccgggtttacccgttaacgggttacctacccgggtaaccccgaaaccgggtaccccaaaccccccgttaaccgg

SEQ ID NO: 198375 - DNA, 525 bp, Homo sapiens
  misc_feature: GYAE6OF01EVM7Y.18.59.F04.1.454.CMB.1.raw
  modified_base (380)..(380): a, c, t, g, unknown or other
  misc_feature (380)..(380): n is a, c, g, or t
  modified_base (447)..(447): a, c, t, g, unknown or other
  misc_feature (447)..(447): n is a, c, g, or t
  modified_base (489)..(489): a, c, t, g, unknown or other
  misc_feature (489)..(489): n is a, c, g, or t
  modified_base (520)..(520): a, c, t, g, unknown or other
  misc_feature (520)..(520): n is a, c, g, or t
  modified_base (522)..(525): a, c, t, g, unknown or other
  misc_feature (522)..(525): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgcccccaaactcatgatttatgatgtcactaatcggcctcaggggtttctaatcgcttctctggctccaagtctggcaacacggcctccctgaccatcctcgtcgggcctccgaggctggaggacgaggctgatttatactgcagctcatatacaagcacagcactctntatcgtcgttacggaacgtggaacctaaggtcacccgtctacggtcacgacccaaggcccaaccccntcgtccactcctcgttccccgccctcctccactcctcgtacnggacgcgggtctgggcacggccgacagtacnannnn

SEQ ID NO: 198376 - DNA, 566 bp, Homo sapiens
  misc_feature: GYAE6OF01E2H0T.18.59.F04.1.454.CMB.1.raw
  modified_base (520)..(520): a, c, t, g, unknown or other
  misc_feature (520)..(520): n is a, c, g, or t
  modified_base (525)..(525): a, c, t, g, unknown or other
  misc_feature (525)..(525): n is a, c, g, or t
  modified_base (529)..(530): a, c, t, g, unknown or other
  misc_feature (529)..(530): n is a, c, g, or t
  modified_base (536)..(536): a, c, t, g, unknown or other
  misc_feature (536)..(536): n is a, c, g, or t
  modified_base (543)..(543): a, c, t, g, unknown or other
  misc_feature (543)..(543): n is a, c, g, or t
  modified_base (546)..(546): a, c, t, g, unknown or other
  misc_feature (546)..(546): n is a, c, g, or t
  modified_base (556)..(556): a, c, t, g, unknown or other
  misc_feature (556)..(556): n is a, c, g, or t
  modified_base (565)..(565): a, c, t, g, unknown or other
  misc_feature (565)..(565): n is a, c, g, or t
tcagtacgagtatgcacgaccggtgctcgatttagtacacacacttagggtagtttggggggctttgtctgggtctcctggacagtcgatcaccatctcctgcactggaaccagcagtgacgttggtggttataactatgtctcctggtaccaacagcacccgaggcaaagcccccaaatcattgatttactgactgtcactaatccggccctcgtaggggtttctaatccgtcttctctggcttcctaagttctgggccaacgaccgggcctcccctgaccagtcgtctgggcctccgaggtctggacggacgaggctagtatttagttacgtcgctagcttcatactaacaagcagccagcactcaacgttccgttacggaacgtcgggaaccaaggtccaaccgttcctaaggtccaaggcccaaacgggtcccaaccccgtctcgtccacctctccgttccccaccctcctcctactactcgtactgacgcggctcggactaggcgactagtagtntagtnctanntgacgnacgtcgncgngtcatgacgncgactctcnc

SEQ ID NO: 198377 - DNA, 517 bp, Homo sapiens
  misc_feature: GYAE6OF01E14W0.18.59.F04.1.454.CMB.1.raw
  modified_base (441)..(441): a, c, t, g, unknown or other
  misc_feature (441)..(441): n is a, c, g, or t
  modified_base (510)..(510): a, c, t, g, unknown or other
  misc_feature (510)..(510): n is a, c, g, or t
  modified_base (512)..(512): a, c, t, g, unknown or other
  misc_feature (512)..(512): n is a, c, g, or t
  modified_base (514)..(517): a, c, t, g, unknown or other
  misc_feature (514)..(517): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggccaacacggccctccctgaccatctcgtgggcctccgaggctgaggacgaggctgtattattacgtgcagctacatactaacaagcagcagcactcaagtcttacgacgtcggacgaggtcaccgtctaggtcacgcccgaacggccaaccccnctcgcactctcgttcccaccctcctcactactcgactcgagccggcgtcggaccagggccgacagtagntnannnn

SEQ ID NO: 198378 - DNA, 558 bp, Homo sapiens
  misc_feature: GYAE6OF01CTRFW.18.59.F04.1.454.CMB.1.raw
  modified_base (314)..(314): a, c, t, g, unknown or other
  misc_feature (314)..(314): n is a, c, g, or t
tcagtacgagtatgcacgaccggtgctcgatttagtacacacacttagggattggggggctggggtctcaggaggcagcgctctcgggacgtctccaccatggcctgggctctgctattcctcaccctcctcactcagggcacagggtcctgggcccagtctgccctgactcagcctgcctccgtgtcctgggtctcctggacagtcgatcaccatctcctgcactggaaccagcagtgacgttggtgttaataactatgtctcctggtaccaacacgcacccagaccaaacgcccccaaactcatgtatttangatgtcactaatccggccctcgtagggtttactaactcgtcttctctgtcctacaagtcgtggacaacgaccggccctccgacgaccatcctcgtcgggcctccgaggtcgtaggacggacggaggcttagtactttattactcgacacgtctactataactaacacaccaccgaacgctactctctatcgtacgtcggaacgtggacctacgtcaccgtcgtacgcaccgcccgaggtacccc

SEQ ID NO: 198379 - DNA, 672 bp, Homo sapiens
  misc_feature: GYAE6OF01DBO7D.18.59.F04.1.454.CMB.1.raw
  modified_base (226)..(226): a, c, t, g, unknown or other
  misc_feature (226)..(226): n is a, c, g, or t
  modified_base (240)..(240): a, c, t, g, unknown or other
  misc_feature (240)..(240): n is a, c, g, or t
  modified_base (301)..(301): a, c, t, g, unknown or other
  misc_feature (301)..(301): n is a, c, g, or t
  modified_base (307)..(307): a, c, t, g, unknown or other
  misc_feature (307)..(307): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggcagtcgatcaccatctcctgcactgaaccngcagtgacgttggngttataactatgtctctggtaccaacagcaccaggacaaacgccccaaatcatgtatttangatgtnagtaatccggcctcgtagggtttactaactgtccttctcgtgtctaccgaagtcgtggacaaacgtccgccctccctgtaccctacttccgtcgtcgggtcctccgacggtgtacggacggacggtaacggtcgtagttaactttacgttaaccgtacgtccgacgtcttaacctaattaaaccgttaaacaacggtaccaagtaccgaacgtaccctacgttacgtaaaccgttccggtttaaccgggaaaccgttacggggaaacccgttaagggtaccccgtacccgggttaacccgaccgggttacaaccgggttacccccgaaaccggaccccccttaaaccccggtacgttaaccccgg

SEQ ID NO: 198380 - DNA, 810 bp, Homo sapiens
  misc_feature: GYAE6OF01EYPCU.18.59.F04.1.454.CMB.1.raw
  modified_base (192)..(192): a, c, t, g, unknown or other
  misc_feature (192)..(192): n is a, c, g, or t
tcagtacgagtatgcacgaccggtgctcgatttagtacacacacttagggattgggggagagaagacaggattcaggacaatctccagcatggccggcttccctctcctcctcaccctcctcactcactgtgcagggtcctgggcccagtctgtgctgactcagccaccctcagcgtctcgggacccccggnagaggtcaccatcctcctgcacgtgggacgccacctaccaacgagtccgggggtcgggttatgatcgtacacgtcggtaccagcagtccttccgagggaccacgaccccctaaactcctactacgttcgtttacggacgacctaaaccgacgttcccggccccgtcggtaaccggggttcccctacgggtaacccgtactttcccgtccggttcggtcccttaaccgtaacggttcccgtaggggtacccctaaccgttccgaaccgtccccgttaccccgtcgggacccctacgttccgaccgggttcgggtaccctccggtacgggtaccgtaggggaacggtacgtcgggaacggtcgttacggtaacctttaactttccggtacgtacccgtaaccgttccttaagtaccgacgttaagtcgggtaacgggtccgtttaggggttacgggtttgggttttaccgttaacgttcggggttttaccgttaccggggtaccgtttacccggggttacggtaaaccccgggttaaccggtacccgttaacccggttacgttaacgcccgtaaccccggtacccggaaccgaccccctaccccgttcgttcgttacccg

SEQ ID NO: 198381 - DNA, 536 bp, Homo sapiens
  misc_feature: GYAE6OF01B48Y4.18.59.F04.1.454.CMB.1.raw
  modified_base (254)..(254): a, c, t, g, unknown or other
  misc_feature (254)..(254): n is a, c, g, or t
  modified_base (328)..(328): a, c, t, g, unknown or other
  misc_feature (328)..(328): n is a, c, g, or t
  modified_base (405)..(405): a, c, t, g, unknown or other
  misc_feature (405)..(405): n is a, c, g, or t
  modified_base (423)..(423): a, c, t, g, unknown or other
  misc_feature (423)..(423): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgtttggtggttataactntgtactcctggtacccaacagcaccaggcaaagccccccaaactcatgatttatgatgtcagtaatcggccctnaggggtttctaatcgcttctctggctccaagtctggacacacggcctcctgaccatctctgggctcgagctgagcgnggctgtattattctgacngctcatacacaagcaccagcacttctctacttcgtcgttacggaaccgtgggaacccaagggttcccaaccgttcctacggtcacggtacccaacggtccccaacccgtaccg

SEQ ID NO: 198382 - DNA, 712 bp, Homo sapiens
  misc_feature: GYAE6OF01CBCHK.18.59.F04.1.454.CMB.1.raw
  modified_base (306)..(306): a, c, t, g, unknown or other
  misc_feature (306)..(306): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcaccaggacaaacgccccaaactcatgtatttangatcgtactaactaactccggcccttacgtacggggtttctaacgtcgtcctttcttctcggtcctaccgtaacgtcgtacggacaaccgacccggtcccttaccccgtcgaaccctactccgtcgtcgggtaccctccgtacggtcgtaggacgggaacggacggtctacgtaatttaacgttacgtcgaccgtacgcttaccaattaactaaccgaacgaccctaaacccgacgtaccctaaccgttaccttaccgttaacgttcggtttacccgtttaccgggaaaccggtttaccggggaacccggtaaacggttcccggtaaccccggttaacccgttacgggttaccccgaacccggtaacccccggaaacccggtaacccccgaaacccccgttacccg

SEQ ID NO: 198383 - DNA, 688 bp, Homo sapiens
  misc_feature: GYAE6OF01ESHZ4.18.59.F04.1.454.CMB.1.raw
  modified_base (232)..(232): a, c, t, g, unknown or other
  misc_feature (232)..(232): n is a, c, g, or t
  modified_base (310)..(310): a, c, t, g, unknown or other
  misc_feature (310)..(310): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgccctccgtgtcgtgggtctccgtggacagtcgatcaccatcctcctgcactggaaccngcagtgacgttggtgttaatactatgtctcctggtaccaacagcaccaggacaaacgacccccaaatcatgtatttangtatcgtctaactaactccggcccttgtacgggtttactaatccgtcttctctcggtctaccgtaagtctggacaacgtaccggccctcccgtagaccctacgtaccgttcgtcgggtaccttccgaacggtccgtacggaacgggtacggacgggtacttagtaatttaacgttacgtcgacccgtaggtcctacgtaactaactaaccgtaacggacccaaccgagtaccctaaccgttccttaccttagttccgttaccggtttaccggaaaccggttaccgggaacccgtaaacggttccccgtaacccgttccggtaaccggttacccgaaaccgtaccccggaaacccgtcccccgtaaacccccgttaccg

SEQ ID NO: 198384 - DNA, 329 bp, Homo sapiens
  misc_feature: GYAE6OF01C1FSA.18.59.F04.1.454.CMB.1.raw
  modified_base (192)..(192): a, c, t, g, unknown or other
  misc_feature (192)..(192): n is a, c, g, or t
  modified_base (325)..(329): a, c, t, g, unknown or other
  misc_feature (325)..(329): n is a, c, g, or t
tcagtacgagtatgcacgaccggtgctcgatttagtacacacacttagggattggggagagaagacaggattcaggacaatctccagcatggccggcttccctctcctcctcaccctcctcactcactgtgcagggtcctgggcccagtctgtgctgactcgagccaccctcagcgtctcgggacccccggnagagggtcaccatctcttgttctggaagcagctaccaacatcggaagtcagcccaaggcctcgaccccctcggtccactctcgttcccaccctcctccatactcgtactgaggcggctggcaaggcgcatagnnnnn

SEQ ID NO: 198385 - DNA, 553 bp, Homo sapiens
  misc_feature: GYAE6OF01AZJN6.18.59.F04.1.454.CMB.1.raw
  modified_base (243)..(243): a, c, t, g, unknown or other
  misc_feature (243)..(243): n is a, c, g, or t
  modified_base (430)..(430): a, c, t, g, unknown or other
  misc_feature (430)..(430): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaacagtgacgtttggnggttaataactatgtctcctggtaccaacagcacccaggcaaagcccccaaatcatgatttatgatgtcactaatccgcctcgtagggtttctaatcgcttctctgctcaagtctggcaacacggtcctccctgaccatctcgtgggtcctcgacggctggaggacgaggtctagtacttaattacngcagctacaatataacaagcaaccgagcctaacttctactgttcgtcgttacggaactcgggaactaacggtcctaccggtacctaggtaccacgaccccaaaggccccaaacccgtctaccg

SEQ ID NO: 198386 - DNA, 652 bp, Homo sapiens
  misc_feature: GYAE6OF01AI05Z.18.59.F04.1.454.CMB.1.raw
  modified_base (644)..(644): a, c, t, g, unknown or other
  misc_feature (644)..(644): n is a, c, g, or t
  modified_base (649)..(651): a, c, t, g, unknown or other
  misc_feature (649)..(651): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgcccccaaaactcatgatttatgatgtcactaatccggccctcgtaggggtttctaatcgcttctctggctccagtctggacacgaccgcctccctgaccatcctcgtcgggtcctccgaggctggacggacgaggctagtatttacttacgtgacacgtctactaataataacaacgaccaaccacgccaccgttcttactacgtcggttaccgttacgggaaccgttacgggaacctaacggtacccgacccgtccgtaacggtccaccggtaaccccgaaccggacccccaacccgtaccgttcgtaccctaccttcccgttacccgttaccccctaccccttcccgttaccctacttacccgttaccgttaccgtaccggtacgggtccgggtacgtccgggacgtaccgggtaccgacgtacgtacgnacgannnc

SEQ ID NO: 198387 - DNA, 554 bp, Homo sapiens
  misc_feature: GYAE6OF01BR8VB.18.59.F04.1.454.CMB.1.raw
  modified_base (252)..(252): a, c, t, g, unknown or other
  misc_feature (252)..(252): n is a, c, g, or t
  modified_base (269)..(269): a, c, t, g, unknown or other
  misc_feature (269)..(269): n is a, c, g, or t
  modified_base (304)..(304): a, c, t, g, unknown or other
  misc_feature (304)..(304): n is a, c, g, or t
  modified_base (357)..(357): a, c, t, g, unknown or other
  misc_feature (357)..(357): n is a, c, g, or t
  modified_base (364)..(364): a, c, t, g, unknown or other
  misc_feature (364)..(364): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactntgtctcctggtaccaanagcaccaggcaaacgcccccaaactcatgatttangatgtcactaatcgccctcgtagggtttctaatcgcttctctggctcaagtcngacaacncggcctcctgaccatctcgtcggctccgaggctggacggacgaggctgtactttatactgcagtctacgatactaacgaacgccaacacgcctactcctactacttgttcctaccggtaacgtcgggtaaccaaggtccctaaccgtccgtaacggtccgaacgaccccaacggccccaaaccccgtacg

SEQ ID NO: 198388 - DNA, 588 bp, Homo sapiens
  misc_feature: GYAE6OF01C36NF.18.59.F04.1.454.CMB.1.raw
  modified_base (242)..(242): a, c, t, g, unknown or other
  misc_feature (242)..(242): n is a, c, g, or t
  modified_base (445)..(445): a, c, t, g, unknown or other
  misc_feature (445)..(445): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaaccagcagtgacgtttggnggttatactatgtctctggtaccaacagcaccaggacaaacgcccccaaactcatcgtattatgatgtcactaatccggccctcgtaggggtttctaagtcgtacttctctggctaccaagtctggaccaacaccggtcctccctgacctatctcgtcgggcctaccgacggcgtagacgggacgaggctgtattacttacgngcagtctactaatactaacgaacgccaccacgctactctacgttatcgttaccgttacggtaacgtcgggaaccgtacggtaccgaccccggtaccgttacggtcctaaccggacccgtaaacggcccctaaaccccgtaccg

SEQ ID NO: 198389 - DNA, 612 bp, Homo sapiens
  misc_feature: GYAE6OF01CLYBO.18.59.F04.1.454.CMB.1.raw
  modified_base (229)..(229): a, c, t, g, unknown or other
  misc_feature (229)..(229): n is a, c, g, or t
  modified_base (255)..(255): a, c, t, g, unknown or other
  misc_feature (255)..(255): n is a, c, g, or t
  modified_base (507)..(507): a, c, t, g, unknown or other
  misc_feature (507)..(507): n is a, c, g, or t
tcagtacgagtatgcacgaccggtgctcgatttagtacacacacttagggagttggggggggtctcaggaggcagcgctctcgggacgtctccaccatggcctgggctctgctattcctcaccctcctcactcagggcacgagggtcctgggcccagtctgccctgactcagcctgcctcgtgtctgggtctcctggacagtcgatcaccatctcctgcactggaaccngcagtgacgttggtagttaataactntgtctcctggtaccaacagccaccaggacaaaccgacccccaaactcatagtatttatagatcgtactaactaacgtccggtccctcgtacggggtttactaacgtcgtcttcgtcgtcggcctaccgtaagtcgtcggacaaccgaccggtcccttaccctcgaccctactccgtcgtcgggtcctccgtacgcgtaggaggacggaggtcgtagtatttaattacgtcgacacgtacacttttttttaanaacgtaacaacgaccaccacgacactctactatcgtcgtacgacggtacggaccgaacgtccgaccgtacgtacggtacacgacccaccgacccaacccgtaccg

SEQ ID NO: 198390 - DNA, 953 bp, Homo sapiens
  misc_feature: GYAE6OF01C17JZ.18.59.F04.1.454.CMB.1.raw
tcagtacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggtattttccttgctgtcttattttaaaaggtgtccagtgtgaggtgcagcgtggtggagtcgtgggggaggtcgttagggtaaacggtccgggggggttcccttaacggaccgttccccgttaggtaccacgtcctcgtggtacttccgtaacgtttcaacggttaaaggtccgtaggtagtacggtaacgttcggggtccgaccgtacgggccgtaccggaagggggaacggggtcgtaggggtagggttacggggtttacggtacccggttaaaagtttaaaaaaccccgaaaacgttaggtaacgttaggggtaacggggaaaccaaaacggaacgtaaacgttaaccgggaccgttaccggaacccgtaaaccccgggtaaggaaaaaccgggaccgtaaacgtaaacggtttacccaaacctaacgttaccgtaaaccgaaaacggtaaggtaaacgttaggtaaaactttaaaaccgaaaaaaacggccgtaaaaccggtacgttaacggtttaaaccgtacgtttaaccgggaaacttaaaacggtaaacggaaaccgaccggtaaaccgtaacgggaaaccggaaaacccggaaccgggtaaaccgaaccgtaacgggtaccccggtttaggttaaacgttacccgttaaccggtaaacccctaaccctaacccggttaacccccgtaaaggaaacccggtaccctaaaccgtaaaaccctttaacccggttaaaccttaacccggtttaaccggttaaacgtccgggttaaccccgttaaccggggg

SEQ ID NO: 198391 - DNA, 513 bp, Homo sapiens
  misc_feature: GYAE6OF01BTMPC.18.59.F04.1.454.CMB.1.raw
  modified_base (307)..(307): a, c, t, g, unknown or other
  misc_feature (307)..(307): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaatcatgatttangatgtcagtaatcggccctcagggtttcaatcgcttctctggctccaagtctggcaaacacggcctcctgaccatctctgggctccaggctgagacgaggctgattatactgcagctacaatataacaagcagcagcactcaaatcttacggaaactgggaaccaaggtccaccgtcttaggacagcccaaagggcccaaaccccg

SEQ ID NO: 198392 - DNA, 770 bp, Homo sapiens
  misc_feature: GYAE6OF01DFS0O.18.59.F04.1.454.CMB.1.raw
tcagtacgagtatgcacgaccggtgctcgatttagtacacacacttaggggattggggggcgtggggtctcgaggaggcagcggctctcgggactctccaccagtcggccctgggcttctcgcttacttcctcaccctctcacgtcgagggcacgaggggtcctacggggccctaggtcctcggccctagacctcacgtcctggcctcggtgcgtcgggactcgtggacagtcgatccactatcttccgagacgtacgtcggaaacctggcaacggttagtacggtttggtacgtttaactaacgtacgtcgtactcgtacggaaccacgacgaccgtaccgacggacgtaaaccgacccctaaagtctaagtacgtaactttgacgagttacgtaacgtaacgtaacgttcccggaccgtacggttacgggttacttaacgtccgtccgttcgtcgtacgtaccgtaacgtacggtccgtagggtaaccaaccgccggttaccctaccgtacgtaacctcggttccgtacggtccgggtaccgtccggaagggtaccgtacgggacgggtacgtacggttactagggtttaaactttcgtaacgtcgtaacgtacgtaacgtcaaattacgaaaccgtactaccggtactaccggtacacttcgtaccgtacgttaggtaaccgtaccggtaacggaccggaacccgaccggggttaaccttaccggtacccgtacggtaacccgaacccgcggtaaccctacccccgg

SEQ ID NO: 198393 - DNA, 784 bp, Homo sapiens
  misc_feature: GYAE6OF01E35U7.18.59.F04.1.454.CMB.1.raw
tcagtacgagtatgcacgaccggtgctcgatttagtacacacacttagggagttggggggtagaggagccccagccttggggattcccaagtgttttcattcagtagatacaggaccttgaacgtactacgacggactcaccgagtcgggagttttcggggcttggaggccttgggacttttccttgctgctattttaaaggtgtccagtggtcgaggtgcgagctggtggagtccgtgggggacgcttggtaagccggggggtcccttagacctcccctggtacacgcctctggattcactttcagtaacggtcctggagtggaacgtgggtcccgccacggcccgtaccggagggggaacggggcgtggggagtggggttggaccgttaatttaaaacccgaaacgtggagtgggtcgggaacaacacgacctacgactagccacccggtgaaacggcagtacttacaccataccacaaagtagactcgaattacaaaagcacgtctagtactctacggacaaagtcggaaccacggtaccctaggaaccgtaacccggtagggaccctaacggaccgggtacccggttacggttaactttacccggtacgtaaccccgttacgtaccgtttacccccgttaagggaaaaccgttcccggttaacctaaaaccgtttaccggttaaacccggtttaccgggtaaacccgggttaacggttaccgggaacccctttaccggggttacccgggggtaccccgtaaaacggggggttaccccccg

SEQ ID NO: 198394 - DNA, 597 bp, Homo sapiens
  misc_feature: GYAE6OF01C370A.18.59.F04.1.454.CMB.1.raw
  modified_base (232)..(232): a, c, t, g, unknown or other
  misc_feature (232)..(232): n is a, c, g, or t
  modified_base (573)..(573): a, c, t, g, unknown or other
  misc_feature (573)..(573): n is a, c, g, or t
  modified_base (593)..(597): a, c, t, g, unknown or other
  misc_feature (593)..(597): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggacaaacgccccaaactcatgatttangatgtcactaatccggccctcgaggggtttctaatcgtcttctctggctaccgaagtctggacaacacggccctccctgaccatcctcgtcgggctccgaggctaggacggacgaggtctagtatttatactgacacgctcaatactacaagcagcagctactacgtaagtccgtacggaacgtgggaaccctaacggtcctaacccggttcgtacgggtaccaacggtaccccgaaaccggaccccaaacccccgtatccgtacctaccttaccgtcccgtttccccgccccttaccgtacctacgttaccgtccgtacgtgaccggtcggacgtcgganaacgggcacgtagtacgcannnnn

SEQ ID NO: 198395 - DNA, 582 bp, Homo sapiens
  misc_feature: GYAE6OF01DA3LY.18.59.F04.1.454.CMB.1.raw
  modified_base (479)..(479): a, c, t, g, unknown or other
  misc_feature (479)..(479): n is a, c, g, or t
  modified_base (577)..(578): a, c, t, g, unknown or other
  misc_feature (577)..(578): n is a, c, g, or t
  modified_base (580)..(582): a, c, t, g, unknown or other
  misc_feature (580)..(582): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgccccaaaactcatgatttatgatgtcactaatcggccctcgaggggtttctaatcgcttctctggctccaagtctggcaacacggccctccctgaccatctcgtgggcctccgaggctggaggacgaggctagtatttacttaactcgacagtcctataactaataacaacgaccaaccagccacttctctatcgttacgttacggaactcgggaaccaacggtcctacccggtctaacggtccacgacccgaacggccccaacccnctacgtcctaccttcccttccgttcccccgcccttcctacctacttaccgtccgtaacgcggtacggcgggtctacgggacgaacggcaccagtacgnncnnn

SEQ ID NO: 198396 - DNA, 617 bp, Homo sapiens
  misc_feature: GYAE6OF01B67Q5.18.59.F04.1.454.CMB.1.raw
  modified_base (232)..(232): a, c, t, g, unknown or other
  misc_feature (232)..(232): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatctcctgcactggaaccngcagtgacgttggtgttatactatgtctctggtacacacgcaccacgacaacgaccccaatcatcgatttatgatcgtacactaacgtccgtcctagtacggggtttactaagtcgtacttctcgtcggtcctactaacgtctcggacaacgcgtcccgtcctacgaccctacttccgtcgtcgggtactccgacggtcgtcgggaacggtacggacggtcgtacgtaactttagtacgtcgtcgtactcgttactaacttaactacgaaacgtacctaacgaccgactaccttccgtaccttagtaccgttacgttaccggtaacgtacgggaaccgtacgtccgtaaccgtccggtacggtaccacgtcccgaacgtaccccg

SEQ ID NO: 198397 - DNA, 716 bp, Homo sapiens
  misc_feature: GYAE6OF01AK739.18.59.F04.1.454.CMB.1.raw
  modified_base (228)..(228): a, c, t, g, unknown or other
  misc_feature (228)..(228): n is a, c, g, or t
  modified_base (303)..(303): a, c, t, g, unknown or other
  misc_feature (303)..(303): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataactatgtctctaggtaccaacagcaccaggcaaacgcccccaaatcatgtattangatgtacactaagtcgcctcgtacgggtttactaatcgtcttctcgtcggtcctacctaagttccgtaggaccaaaccgaccgggtcccttccccgtagaccctaacttcctccggtcgggtcccttaccggaacgggtccgttaggaacggggtaacgtacgggtaccgttaggttaactttacgttaacgtcgaaccgtacgtacttacctaagtttaaccgtaaaccgaacgaccctaaaccgtaacgtacctaacccttacttaccgttacgttcggttacccgttaaccgggtaaaccggtaccggggtaaccctaaacgggttcccaacccgggttacccgttaaccggggtaccctaacccggaacccccgtaaaccgggtaacccctaaacccccgttaacccgg

SEQ ID NO: 198398 - DNA, 608 bp, Homo sapiens
  misc_feature: GYAE6OF01CXZEW.18.59.F04.1.454.CMB.1.raw
  modified_base (256)..(256): a, c, t, g, unknown or other
  misc_feature (256)..(256): n is a, c, g, or t
  modified_base (489)..(489): a, c, t, g, unknown or other
  misc_feature (489)..(489): n is a, c, g, or t
  modified_base (507)..(507): a, c, t, g, unknown or other
  misc_feature (507)..(507): n is a, c, g, or t
tcagtacgagtatgcacgaccggtgctcgatttagtacacacacttagggagttggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatctcctgacactggaaccagcagtgacgttggtgttaataactntgtctcctaggtacaacagcaccaggacaaacgccccaaactcaatgtattaatgaatcgttacaactaactccggtaccttacgtacggggtttactaagtccgtctttctctggtccttaccgaagtctacgggactaaaccgaccggcccttacccgtacgaaccacttctccgtgggcctccgagggtccaggaaggacgaggtctaggtatttatacgtgacagtcanattagaacacgacacganactactcgacttagtgtaccgtcggtaaaccgtcgggaaacacggtccaacccgtacgttaacggcaaccggacccaaacgggtccccaaacccggttacc

SEQ ID NO: 198399 - DNA, 496 bp, Homo sapiens
  misc_feature: GYAE6OF01BTD6G.18.59.F04.1.454.CMB.1.raw
  modified_base (228)..(228): a, c, t, g, unknown or other
  misc_feature (228)..(228): n is a, c, g, or t
  modified_base (415)..(415): a, c, t, g, unknown or other
  misc_feature (415)..(415): n is a, c, g, or t
  modified_base (419)..(419): a, c, t, g, unknown or other
  misc_feature (419)..(419): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataactatgtctcctggtaccaacagcaccaggcaaagcccccaaactcatgatttatgatgtcactaatcgcctcagggtttctaatcgcttctctgctccaagtctgcaacacggcctcctgaccatctctgggctccgaggctgaggacgaggctgattatactgcngctnatataacagcaccagcactctctatgtctcggactgggaccaaggtcaccgtctagtcacgaccacgccaaccgtac

SEQ ID NO: 198400 - DNA, 713 bp, Homo sapiens
  misc_feature: GYAE6OF01D677B.18.59.F04.1.454.CMB.1.raw
  modified_base (662)..(662): a, c, t, g, unknown or other
  misc_feature (662)..(662): n is a, c, g, or t
tcagtacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggtattttccttgctgcttattttaaaaggtgtccagtgtgaggtgcagctggtggagtcggtgggggaggtcgttagggtaaacgggtcccggggggggttcccttacggtacccttcccccgtggtaccgacgtcctcgttcggtacttctacttttcgaggtaacggcctggatacgtaacgtcgggtcccgccgaggtccgtaccggagggggaacggggccgtaggggagggttggggttcggaccgttaaagttaaaaacccgaaaacgttggaagttagggtaggaacaacgacgtaactacgctacgaccaacccggtagaaacggcgaagtacttaccaacctactacctagaacgtagatagtaacttaacgaaaaacgctaacgtactagttactacgtagaacaagtacgaactacgccgtaagaaccggaaccgtaggaaccacgaacgtccgtagttactacgtacctacccactacctacccgtaagaacnccgtaacctaaccgtaacctacgttacctaacggtactccgaccgtacggg

SEQ ID NO: 198401 - DNA, 1087 bp, Homo sapiens
  misc_feature: GYAE6OF01B4VAL.18.59.F04.1.454.CMB.1.raw
tcagtacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggtattttccttgctgctatttaaaggtgtccagtgtgaggtgcagctggtggagtcgtgggggaggtcgttagggtaaacggccgggggggtcccttacggaccgtccccgtgtaccgacgcctcgtggtacttcctaacttttccaaggttaacggccctgggaatgaaaccgttcggggtccccgccgacgggccgtaccggaagggggaacgggggccgtagggggacgggttcggggggtttcggggtaccccggtttaaaggtttaacgggaaaacgggtaccgaaaaaacggtaccgttaaaaaccgtaacgggtttaaaccggacccggaaacgtaacgggacctaaacgtttaacgtacggtacccgttgggtacccgggtttaccggggttaacgggaaaaacggggtcccggttaaacggggtttacccgtaaccccggttaccgttaaccccgtaaaggtaaaacgttacggtaaacgtttaaaccgaaaaacggtaaaacccggtaaccggggtaaccgttaaacgttacccggttaagtaaaccgtaaaacgtaacggtaaaacccgtaaccggtaacccggttaaaaccgggaaaaaacccgggtaaaccggggtaaacccggtaacccggggtaaaccccggtttaacggtttaaaccgttttaaaccggtttaaccgggttaaaacccggtttaaaacgggtaaacccgggttaaaacggggttaacggggtttaaaccggttttaaacggggtttaaacgggggttttttaacgggggggggttaaaccggtttttaaacgggtacccggggggtttaaaacccgggggggttaaaaacccgggggggggggttttaaacccgtttaaacccggggttaaaccggggttaacccgggttttaaaaccgggggg

SEQ ID NO: 198402 - DNA, 738 bp, Homo sapiens
  misc_feature: GYAE6OF01DC9XV.18.59.F04.1.454.CMB.1.raw
  modified_base (263)..(263): a, c, t, g, unknown or other
  misc_feature (263)..(263): n is a, c, g, or t
tcagtacgagtatgcacgaccggtgctcgatttagtacacacacttagggattgggggggggtctcaggaggcagcgctctcgggacgtccccaccatggcctgggctctgcctattcctcaccctcctcactcagggcacagggtcctgggcccagtctgccctgactcagcctgcctccgtgtcgtgggtctccgtggacagtcgatccaccatctcctgcacgtcggaaccagcagtgacggtttggtagtaactaactntgtctccgtgtaccacacgcaccgaggacaaaccgaccccaactcatgtaatttatagtatcgtactaactaacgtccggtaccctacgtacggggttttactaacgttccgtcttccgttcgtcggtaccttaccgtaacggttcgtacggaccgtaaaccgtcccggtaccctcccgtaacgtaccctacttccgttacgtcggtccctaccggacggtcgtacgggacggaaccggaggtacttaggtaactttacgttacgtacgacgtacgtactactaacgttaacgtaaccgaacggacccaaccgtaccgtaccttaaccttccgttaccgttaacgttcgttaccgttaccgggtaaccgtaccggggtaacccgtaaccggttacccggtacccgttacccggtaccggtaaccgtacccggtaaccccgaaaccggtacccccctaaaccccgtccgttacccg

SEQ ID NO: 198403 - DNA, 573 bp, Homo sapiens
  misc_feature: GYAE6OF01DYK61.18.59.F04.1.454.CMB.1.raw
  modified_base (306)..(306): a, c, t, g, unknown or other
  misc_feature (306)..(306): n is a, c, g, or t
  modified_base (404)..(404): a, c, t, g, unknown or other
  misc_feature (404)..(404): n is a, c, g, or t
  modified_base (474)..(474): a, c, t, g, unknown or other
  misc_feature (474)..(474): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcaccaggacaaacgcccccaaactcatgatttangatgtacactaactcggccctgtagggtttctaatcgtcttctctggctcaagtcaggcaacaccggcctccctagaccattctcgtgggcctaccgnggtcgtaggacggacggaggtctaggtactttagttactgacagtctacataactaacacgacctaaccngcctaacttcctacgttattcggtaccgttaccggaacgttcgggaacctaaggtccaccgttccgtaggtaccacgacccaacggccccaacccgtcg

SEQ ID NO: 198404 - DNA, 607 bp, Homo sapiens
  misc_feature: GYAE6OF01D8BBM.18.59.F04.1.454.CMB.1.raw
  modified_base (303)..(303): a, c, t, g, unknown or other
  misc_feature (303)..(303): n is a, c, g, or t
  modified_base (406)..(406): a, c, t, g, unknown or other
  misc_feature (406)..(406): n is a, c, g, or t
  modified_base (410)..(410): a, c, t, g, unknown or other
  misc_feature (410)..(410): n is a, c, g, or t
  modified_base (415)..(415): a, c, t, g, unknown or other
  misc_feature (415)..(415): n is a, c, g, or t
tcagtacgagtatgcacgaccggtgctcgatttagtacacacacttagggattggggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggagcttggtaaaggccgggggggtcccttagactcccctgtacagcctctggattcactttcagtaaggcctggatgaactgggtccnccaggctccgaggggaagggctgggagtggggttcgaccgtaataaaaccaaagtgagtggtgggacaacagactacgctgcacccgtgaaggcagatcaccntcanaaganatgatacaaaagcacgctgtatctacgactaaatcgaacacgacgtagaacggaaccgagaaccaacgacgaccgtagtacttacgtacgtaccacacgtaccctagaacgtaccgtacctaaactaccgttacctaccgttacggtaacgtacggaccttaccggtcggggaccgtaaccgggtaacccgg

SEQ ID NO: 198405 - DNA, 785 bp, Homo sapiens
  misc_feature: GYAE6OF01C7EIL.18.59.F04.1.454.CMB.1.raw
  modified_base (212)..(212): a, c, t, g, unknown or other
  misc_feature (212)..(212): n is a, c, g, or t
  modified_base (227)..(227): a, c, t, g, unknown or other
  misc_feature (227)..(227): n is a, c, g, or t
  modified_base (241)..(241): a, c, t, g, unknown or other
  misc_feature (241)..(241): n is a, c, g, or t
  modified_base (250)..(250): a, c, t, g, unknown or other
  misc_feature (250)..(250): n is a, c, g, or t
  modified_base (303)..(303): a, c, t, g, unknown or other
  misc_feature (303)..(303): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcacatccncctgcactggaaccngcagtgacgttggngttatactntgtctctggtaccaactagcaccaggcaaacgcccccaaatcatgtatttagnatgtcagtaactcggtccctgtacggggtttctaacgtcgtcctttctacttcgggacctcctaacgtccttacgggccaaaccgtaccgggccccttaccccgtacgtaccctaacgttccgtccggttaccggggtcccttaacccgtacgggtccgtaagggtaccggggtaacggtaacgggtacccgttagggttaaactttaaaccggtttaccgtacggtacccgtacgtaccgttactaacggtttaaactaaccgtaaaccggacttaacggacccgtaacgtaacccgtacgttaaccgtaaccgggtttaccgttaaccggggtaaacccgtaccgggggtaaaaccccgtaaggggtacccccgttaaaacccggttccccgggtttaaaacgggtacccgtaaaccggggttaaccccccgaaaacccggggtaccccccaaaacccccggttcccgtttaacccccgg

SEQ ID NO: 198406 - DNA, 723 bp, Homo sapiens
  misc_feature: GYAE6OF01CW0HD.18.59.F04.1.454.CMB.1.raw
  modified_base (220)..(220): a, c, t, g, unknown or other
  misc_feature (220)..(220): n is a, c, g, or t
  modified_base (234)..(234): a, c, t, g, unknown or other
  misc_feature (234)..(234): n is a, c, g, or t
  modified_base (313)..(313): a, c, t, g, unknown or other
  misc_feature (313)..(313): n is a, c, g, or t
  modified_base (325)..(325): a, c, t, g, unknown or other
  misc_feature (325)..(325): n is a, c, g, or t
tcagtacgagtatgcacgaccggtgctcgatttagtacacacacttagggattggggggctggggtctcaggaggcagcgctctcgggacgtctccaccatggcctgggctctgctattcctcaccctcctcactcagggcacgagggtcctgggcccagtctgccctgactcagcctgcctccgtgtctgggtcctccgtggacagtcgatcaccatcnctgcactggaaccngcagtgacggttggtaggttaataacgtatcgtcctccgtacgaacaacgacgaccacgacgaacaaccgaaccccaancagtatatttanagagtctactaactacgtccgtcgtaggtacggttactacgtctctctcgcgtacctacgacgtcgacgaaccgaacccggccgtcctaccgacgaacctcgttccggtggtcccggttctaccgggacggtacggtaacggggaacggacgggtacgttacggtaagtttaaccgttttattacccgggtacacgtaacccgtacttaaacctaaagttaacgaaacccgtaaccggaacccaccggtaacaacctaaaccgttaagtaacccggtttaccgggttaaaccggaacgggttaaacccgggaaacgttacccggtaccctaaccgggtttaccggaacgtaccccgaaacgaccccccgggtaaacctaaccccccgaaaccgttccg

SEQ ID NO: 198407 - DNA, 571 bp, Homo sapiens
  misc_feature: GYAE6OF01DRAVI.18.59.F04.1.454.CMB.1.raw
  modified_base (548)..(551): a, c, t, g, unknown or other
  misc_feature (548)..(551): n is a, c, g, or t
  modified_base (553)..(571): a, c, t, g, unknown or other
  misc_feature (553)..(571): n is a, c, g, or t
tcagtacgagtatgcacgaccggtgctcgatttagtacacacacttagggattgggggctttgtctgggtctcctggacagtcgatcaccatctcctgcactggaaccagcagtgacgttggtggttataactatgtctcctggtaccaacagcacccaggcaaacgcccccaaatcatgatttatgatgtcactaatcggccctcgaggggtttctaatcgcttctctggctaccaagtctggacaacacggcctcctgaccatctcgtgggcctccgaggctggacggacgaggctgtattatactgctagctacaatactaacaagcaacacgcactctctatgtacttacggaacgtcgggaaccaaggtcctacccgtaccgtagggtaccaacggtacccgaaacggaccccaaccccgtacgttctaccctaaccttccgttaccggtttaccccccaaccctttcccctacctaacttacccgtaccggttacgacggaccggtcgggacgttcgggacgaacgggccacgaacgtagcnnnncnnnnnnnnnnnnnnnnnnn

SEQ ID NO: 198408 - DNA, 759 bp, Homo sapiens
  misc_feature: GYAE6OF01AQPIY.18.59.F04.1.454.CMB.1.raw
  modified_base (153)..(153): a, c, t, g, unknown or other
  misc_feature (153)..(153): n is a, c, g, or t
  modified_base (204)..(204): a, c, t, g, unknown or other
  misc_feature (204)..(204): n is a, c, g, or t
  modified_base (731)..(731): a, c, t, g, unknown or other
  misc_feature (731)..(731): n is a, c, g, or t
  modified_base (736)..(736): a, c, t, g, unknown or other
  misc_feature (736)..(736): n is a, c, g, or t
  modified_base (740)..(740): a, c, t, g, unknown or other
  misc_feature (740)..(740): n is a, c, g, or t
  modified_base (744)..(744): a, c, t, g, unknown or other
  misc_feature (744)..(744): n is a, c, g, or t
  modified_base (746)..(746): a, c, t, g, unknown or other
  misc_feature (746)..(746): n is a, c, g, or t
  modified_base (748)..(749): a, c, t, g, unknown or other
  misc_feature (748)..(749): n is a, c, g, or t
  modified_base (751)..(752): a, c, t, g, unknown or other
  misc_feature (751)..(752): n is a, c, g, or t
  modified_base (754)..(756): a, c, t, g, unknown or other
  misc_feature (754)..(756): n is a, c, g, or t
  modified_base (758)..(759): a, c, t, g, unknown or other
  misc_feature (758)..(759): n is a, c, g, or t
tcagtacgagtatgcacgaccggtgctcgatttagtacacacacttagggattgggggcgtttgcctgggtgctgttggtaccaggagacatagttataaccacatctcctgcactcggaaccagcagtgacgttgggtgtataactatgtcnctcggtaccacagccacccaggacaaacgcccccaaatcactagatttagngtatcgtaccaactaatccgggacccttgtaggggtttctaagccgtctttctcgcggtcctaccgatcgtcggaacaaccgccggccctcccgtacaccttacgttacctcgtccgggacctccggacggtcgtaggacggtaccggaggcttagtaacgttactttacgcgataccggtctagtactaaacgtacgaacgcaccgtaacgcttacccttatacccgtatttacccgggtcttttaaacccgggggactaaccgggggtacccgtaaaggttttcccccggaaacccgtttgtaacccgggggttaccaaccccgggtaacccgaaccccgggtaaccccgtaaacccccgtaccggttaccctacccgttacccggttacctttacccccgtaacccccttaccccgttacccccttaaccctaccgtttaacccgtccggttaaccctacgggtaacccgggtcggtaaacccgtccggaaccggtaccggtaccgtaccgaacgttgccgacngacgnacgnactncncnncnncnnngnn

SEQ ID NO: 198409 - DNA, 692 bp, Homo sapiens
  misc_feature: GYAE6OF01DFDUY.18.59.F04.1.454.CMB.1.raw
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtcgtggtctcctggacagtcgatcaccatcctcctgcactggaaccagcagtgacgttggtagttatactatgtctctgtaccaacagccaccaggaccaaacgcccccaaactcactagtatttagtagacttgtacctaacttaacgtcccggtaccccgttaggttacgggtttacctaacttccggtcctttcttcgtcggtcctaccgtaacgtcgtacggaccaaccgtaccgtccccttccgtacgaacctacgttccgtaccgtcgggaccttaccgaaggtcctaagggacggtacgaggtctaggtaactttacgtacgtgactacgtacctacgtaacttaacgtaaccgaacgtcccaaaccgtacgaccttaaccttacttaccgttacgttaccgtaccggtttaacggaaccgtacgggtaaacctaacgggtccctaaccgttccggtaacgtaccgtaaccgaccccgtaaacggaccccaaacccgtacccg

SEQ ID NO: 198410 - DNA, 694 bp, Homo sapiens
  misc_feature: GYAE6OF01A5HSQ.18.59.F04.1.454.CMB.1.raw
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcctggtaccaacagcacccaggaccaaacgccccccaaaactcatagtacttagtagatcgtactagtaacgtccgacctacggtaggtttactaacgtccgtcttacgtcgtcggtacctaccgtagttcgtggaaccaaccggcccgtacccgtcccacggtaacctcgttcgtccggtacgggtcctaccggtacggtcgtacgggaacgggacggtacgtcgtttagtaaccgttttactaacgttcggactacgtacttactaacttaacgtacgtaacgtcaagaccacgtacctaaccgttacggtaaaccgttaccgggttaacgggtaactaccggggtaacccgtaaccggttacccggtaccccgttaccggtaacggtacccgaaccccggtaacccggaaccgtaaccccccgtaaacccg

SEQ ID NO: 198411 - DNA, 672 bp, Homo sapiens
  misc_feature: GYAE6OF01DSPRL.18.59.F04.1.454.CMB.1.raw
  modified_base (216)..(216): a, c, t, g, unknown or other
  misc_feature (216)..(216): n is a, c, g, or t
  modified_base (219)..(219): a, c, t, g, unknown or other
  misc_feature (219)..(219): n is a, c, g, or t
  modified_base (266)..(266): a, c, t, g, unknown or other
  misc_feature (266)..(266): n is a, c, g, or t
  modified_base (319)..(319): a, c, t, g, unknown or other
  misc_feature (319)..(319): n is a, c, g, or t
  modified_base (336)..(336): a, c, t, g, unknown or other
  misc_feature (336)..(336): n is a, c, g, or t
tcagtacgagtatgcacgaccggtgctcgatttagtacacacacttagggagttggggggggtctcaggaggcagcgctctcgggacgtctccaccatggcctgggctctgctattcctcaccctcctcactcagggcacgacgggtcctgggcccagtctcgccctgactcagcctgcctcgtgtcgtggtctccgtggacagtcgatccacctntcnccgtgacacgtggaaccagcaggtgtacggttggtagttataacgtnttcgtcctccgtaggtaccagacgcccaaccgaggaccaaaccgacccctaanacctagtatactttagntacgtcgtacctaacgtaaccgtccgtaccgttaggtacggtttactacgtcgtctttccgcgtagtcctacgtacgtcgtacgactacgacccgtctaccgtcactcgtcgtaccgtggacctcgagcgtacggacggacgtagtacttgttaacttcgtacgtacacgtacgtacttacaactaccgtaacgccgactaccgatacctacgttactacgttacgtcgttaccggtaaggtacccggtacggtaacccgttacggtaccccgtaaccgggttacctaacgggaccctacccggaaaccccgtcccggaacccttaaccccggtcg

SEQ ID NO: 198412 - DNA, 616 bp, Homo sapiens
  misc_feature: GYAE6OF01CBIXW.18.59.F04.1.454.CMB.1.raw
  modified_base (252)..(252): a, c, t, g, unknown or other
  misc_feature (252)..(252): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactntgtctcctggtaccaacagcaccaggacaaacgcccccaaatcaatgtattatgatgtacagtaactccgcctagtagggttctaatcgtcttctctggctaccagtcgtcgacaacgccgacctcccgtagaccatcctcgtcgggcttccgaggctaggaaggacgagtctagtactttaacgttctcgactacgtactactaataactaacgaacgcgaagccgaacgctaacctacgtaacgttaccgttaccggtaaacggtacggggtaaaccctaaacgggttcccgtaacccggttaccgtaacggtccgaacggtaacccccgaaaccgggcccctaaaccccgtcgtaacccgg

SEQ ID NO: 198413 - DNA, 563 bp, Homo sapiens
  misc_feature: GYAE6OF01EQ4FM.18.59.F04.1.454.CMB.1.raw
  modified_base (426)..(426): a, c, t, g, unknown or other
  misc_feature (426)..(426): n is a, c, g, or t
  modified_base (439)..(439): a, c, t, g, unknown or other
  misc_feature (439)..(439): n is a, c, g, or t
  modified_base (445)..(445): a, c, t, g, unknown or other
  misc_feature (445)..(445): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagctagtgacgttggtggttaataactatgtctcctgtaccaacagcaccaggacaaacgccccaaactcactgtatttactgatatacactaagtccgcctacgtacgggtttactaatcgtcttctcgtgtctacgtaagtctggactaacgacgtcctacctcgacctactctctcggtcctcgagctgaggacgngcgtgattatatncagctnaatctaacacgactaccagcactctacctagtcgttccgttagtacgtcggtaaccgaaggtcccgtaaccgtaccgtacgtcgaaccgtacccgaaccggaccccgtacccgtaccg

SEQ ID NO: 198414 - DNA, 716 bp, Homo sapiens
  misc_feature: GYAE6OF01D45TP.18.59.F04.1.454.CMB.1.raw
  modified_base (253)..(253): a, c, t, g, unknown or other
  misc_feature (253)..(253): n is a, c, g, or t
tcagtacgagtatgcacgaccggtgctcgatttagtacacacacttagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcacgtggaaccagcagtgacgttggtgttataactntgtctcctgtaccaacagcaccaggacaaacgcccccaaactcatgtatttatgattgtacactaacgtccggtacccctgtacgggttttactaagttccgtacttcttcgtcggtcttccaagttcctaggaccaacgccggccttcccgtagaccctatccttcgtacgggtcctaccgaggtccgtaggaacgggtaaccggacgggtccttaggtaacttttaagttacgtacgaccgtacgtcctagtaactaacttaaccaaacggtacccaaccgacggtaccctaccgttaccttacgttaacgttaccgtttaccgttaaccgggtaaccggttaccggggaaacccgttaaccggggttacccctaacccccgggttacccgttaaccgggttacccaaacccgggaccccccgtaaacccgggtacccccctaaaccccccggttaacccg

SEQ ID NO: 198415 - DNA, 535 bp, Homo sapiens
  misc_feature: GYAE6OF01D205W.18.59.F04.1.454.CMB.1.raw
  modified_base (529)..(529): a, c, t, g, unknown or other
  misc_feature (529)..(529): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcctggtaccaacagcaccaggcaaagcccccaaatcatcgatttatgatgtcactaatcgcctcgagggtttcaatcgcttctctggctccaagtctggcaacgacggcctcctgaccatctctgggcctccgaggctggaggacgaggcctagtatttatactgcagtctcgaatactaacgaagaccagacacgactacgtcaagttcttacggaacgtcgggaaccaggtccacgtaccgtaggtaccacgacccaacggcccaacccngtaccg

SEQ ID NO: 198416 - DNA, 596 bp, Homo sapiens
  misc_feature: GYAE6OF01A7SGS.18.59.F04.1.454.CMB.1.raw
  modified_base (182)..(182): a, c, t, g, unknown or other
  misc_feature (182)..(182): n is a, c, g, or t
  modified_base (235)..(235): a, c, t, g, unknown or other
  misc_feature (235)..(235): n is a, c, g, or t
  modified_base (301)..(301): a, c, t, g, unknown or other
  misc_feature (301)..(301): n is a, c, g, or t
  modified_base (312)..(312): a, c, t, g, unknown or other
  misc_feature (312)..(312): n is a, c, g, or t
  modified_base (477)..(477): a, c, t, g, unknown or other
  misc_feature (477)..(477): n is a, c, g, or t
tcagtacgagtatgcacgaccggtgctcgatttagtacacacacttagggattggggggggtctcaggaggcagcgcgtctcgggacgtctccaccatggcctgggctctgactattcctcaccctcctcactcagggcacagggtcctgggcccagtctgccctgactcagcctgcctcgngtcgtgggtctcctggacaggtcgatcgaccagtcctcctgccactggaaccngccagtggacgttggtggttataactctgtctcctggtaccaacagcaccagcaaagccccaaacncatgatttagngatgtacaactaacgtaccggtccctacgtacggggttttactaacgttccgtctttcgtcgtgggcctccgtaagtccgtgaccaaacgccggcctcctgaccactctcgtgggctccaggctggaggacgaggtctggtatttactacgtgaccgtagtcctntaactaatacgaacgtcaaaccgcgactacgtctattacgtcttgttaccggaagtcgggtaacaacggtcgaccgtaccgtaggtcccacggacccctaacggccctaccccggtaac

SEQ ID NO: 198417 - DNA, 817 bp, Homo sapiens
  misc_feature: GYAE6OF01EASZU.18.59.F04.1.454.CMB.1.raw
  modified_base (230)..(230): a, c, t, g, unknown or other
  misc_feature (230)..(230): n is a, c, g, or t
  modified_base (244)..(244): a, c, t, g, unknown or other
  misc_feature (244)..(244): n is a, c, g, or t
  modified_base (249)..(249): a, c, t, g, unknown or other
  misc_feature (249)..(249): n is a, c, g, or t
  modified_base (254)..(254): a, c, t, g, unknown or other
  misc_feature (254)..(254): n is a, c, g, or t
  modified_base (270)..(270): a, c, t, g, unknown or other
  misc_feature (270)..(270): n is a, c, g, or t
  modified_base (309)..(309): a, c, t, g, unknown or other
  misc_feature (309)..(309): n is a, c, g, or t
tcagtacgagtatgcacgaccggtgctcgatttagtacacacacttagggagttggggggggtctcaggaggcagcgctctcgggacgtctccaccatggccctggctctgctattcctcaccctcctcactcagggcacgagggtcctgggcccagtctgccctgactcagcctgcctccgtgtctgggtctcctggacagtcgatcaccatctcctgcactggaaccngcagtgacgttggngttanaactntgtctctgtaccaacngcaccaggacaaacgcccccaaactcgatagtatttacngattcgactactaacgtccggtccctacgtacgggtttactaagtccggtctttccgtacgtggcctaccgtaagtccgtacgggacctaaacgcccggtaccctacccgtacgtaccctacgttccgtccgttacgggtcccttaccggacgggtaccgttacgggaacggggtaaccggtcggtaccggtttaagttaaccgttttaacgttaccgttacggaccgttaaccggtaacctttaccaaagtttaaaccttaaaccggaaacggtacctaaaccgggaccgttaaacccgggtaacccttaacccggttaaccgttaaaaaccggtttccgggtttaaacccggggaaaccgggttaaacgggtaaaccggttaaaacccggggttaccccgttaaaccccgggtttacccggttaaacgggtaaccccgtaacccggggaaacccccgtaaaacccggggtaccccccctaaaaccccggttccggtttaaacccgg

SEQ ID NO: 198418 - DNA, 588 bp, Homo sapiens
  misc_feature: GYAE6OF01CH8QZ.18.59.F04.1.454.CMB.1.raw
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcctggtaccaacagcaccaggcaaacgcccccaaactcatgtatttatgatgtcactaatccggccctcgtagggttctaatcgtcttctcgtgtctccaagtctggacaacgacggccctccctcgacctatctcgtcgggtcctccgacggtctggaacggacgacggcttagtaactttacgttactgacagtctactaactataacaacgtaccaaccgagcctaactcctactatcgttccgttacggaaccgttcgggaaccctaacggtaccgtacccgtaccgtacggtccgaaccgtaccccgaaccggtaaacccccc

SEQ ID NO: 198419 - DNA, 578 bp, Homo sapiens
  misc_feature: GYAE6OF01DLQQ8.18.59.F04.1.454.CMB.1.raw
  modified_base (228)..(228): a, c, t, g, unknown or other
  misc_feature (228)..(228): n is a, c, g, or t
  modified_base (310)..(310): a, c, t, g, unknown or other
  misc_feature (310)..(310): n is a, c, g, or t
  modified_base (379)..(379): a, c, t, g, unknown or other
  misc_feature (379)..(379): n is a, c, g, or t
  modified_base (391)..(391): a, c, t, g, unknown or other
  misc_feature (391)..(391): n is a, c, g, or t
  modified_base (440)..(441): a, c, t, g, unknown or other
  misc_feature (440)..(441): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgtttggtgttataactatgtctcctggtaccaacagcacccaggaccaaacgcccccaaactcatgtaatttangatgtacactaactccggccctcgtacgggtttctaatcgtcttctctcggtctctaagtcgtgcaacnccggcctccctnaccattctcgtcggcctccgaggctaggaggacgagctgatttattacnncacgtctatataactacaacgccaccagacctactctaccttattcgtccgttacggaacgtcgggaaccgttaacggttcccacccggttctaccgggtaccaccgaccccgaaccggacccctaacccctaaccg

SEQ ID NO: 198420 - DNA, 561 bp, Homo sapiens
  misc_feature: GYAE6OF01EG8WR.18.59.F04.1.454.CMB.1.raw
  modified_base (252)..(252): a, c, t, g, unknown or other
  misc_feature (252)..(252): n is a, c, g, or t
  modified_base (373)..(373): a, c, t, g, unknown or other
  misc_feature (373)..(373): n is a, c, g, or t
  modified_base (378)..(378): a, c, t, g, unknown or other
  misc_feature (378)..(378): n is a, c, g, or t
  modified_base (402)..(402): a, c, t, g, unknown or other
  misc_feature (402)..(402): n is a, c, g, or t
tcagtacgagtatgcacgaccggtgctcgatttagtacacacacttagggagttggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaaccagcagtgacgttggtgttataactntgtctcctggtaccaacagcaccaggcaaacgcccccaaactcatgatttatgatgtacactaagtccgccctgagggtttcaatccgcttctctgctcaagtctggcaacacggcctccngaacntctctggcctcgagctgaggacgnggctgtatttataccgtgctagctacaatactaaccgaagtaccaaccgaagctaacctctactacgttcgttaccgttaccggtaacggtcgggaacccaacggttcccacccggttactacgggtccacgtaccccgaaggcccccaaacccctacg

SEQ ID NO: 198421 - DNA, 640 bp, Homo sapiens
  misc_feature: GYAE6OF01C34HG.18.59.F04.1.454.CMB.1.raw
  modified_base (325)..(325): a, c, t, g, unknown or other
  misc_feature (325)..(325): n is a, c, g, or t
  modified_base (636)..(640): a, c, t, g, unknown or other
  misc_feature (636)..(640): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttaataactatgtctcctggtaaccaacagccacccaggacaaacgacccccaaatcatagatttatgatgtcaactaatcggcctacgtaggggtttctaatcgctttctctacggcctaccaagtcgtaggaccaaacgccggcccttaccgnaccctatctcgtcggctccgaggctggagacgaggtctagtattatacagctagctacataacaacaacgtccaacgactacaccttctactacttcggttacgtttaccgggaacgtaccgggtaaaccgtaacgggtacccgtacccggtaccgttaacggtacaaccggacccgaaccggaccccaaacccgtactaccgtacctaaccctttccttaccccgtaccccttaccccttaccctaccttaacctacgttaccgtactacggcggaccggccggtaggcgtaaacggcgaacttagagcnnnnn

SEQ ID NO: 198422 - DNA, 599 bp, Homo sapiens
  misc_feature: GYAE6OF01EVJFK.18.59.F04.1.454.CMB.1.raw
  modified_base (187)..(187): a, c, t, g, unknown or other
  misc_feature (187)..(187): n is a, c, g, or t
  modified_base (263)..(263): a, c, t, g, unknown or other
  misc_feature (263)..(263): n is a, c, g, or t
  modified_base (470)..(470): a, c, t, g, unknown or other
  misc_feature (470)..(470): n is a, c, g, or t
  modified_base (577)..(580): a, c, t, g, unknown or other
  misc_feature (577)..(580): n is a, c, g, or t
  modified_base (582)..(599): a, c, t, g, unknown or other
  misc_feature (582)..(599): n is a, c, g, or t
tcagtacgagtatgcacgaccggtgctcgatttagtacacacacttagggattgggggctttgtctgggtctcctggacagtcgatcaccatctcctgcactggaaccagcagtgacgttggtggttataactatgtctcctggtaccaacagcacccaggcaaacgcccccaaactcatgatttangatgtcactatcggccctcgagggtttctaatcgtcttctctggctcaagtctggacaacgcggccctcctgaccntctcgtgggcctccgaggctggacggacggacggcttaggactttagttactggcacgtcctactaagtaactaacaaacgccaaccgtacgcctaccttccttacgttacgttcggttaccttaccggggaaacgttcggggaaccaacgggttcccaaccgttaccgtaacggtccacgacccccgaacggccccctaacccgtnttcgacccttacttccgtccccgttccccctacccttaccctacctaacgttcccttaccggtacttagggacggtcgggcctcgggaacgacggtcacgtatgacnnnncnnnnnnnnnnnnnnnnnn

SEQ ID NO: 198423 - DNA, 588 bp, Homo sapiens
  misc_feature: GYAE6OF01BN83Y.18.59.F04.1.454.CMB.1.raw
  modified_base (256)..(256): a, c, t, g, unknown or other
  misc_feature (256)..(256): n is a, c, g, or t
  modified_base (272)..(272): a, c, t, g, unknown or other
  misc_feature (272)..(272): n is a, c, g, or t
  modified_base (294)..(294): a, c, t, g, unknown or other
  misc_feature (294)..(294): n is a, c, g, or t
  modified_base (305)..(305): a, c, t, g, unknown or other
  misc_feature (305)..(305): n is a, c, g, or t
  modified_base (362)..(362): a, c, t, g, unknown or other
  misc_feature (362)..(362): n is a, c, g, or t
  modified_base (377)..(377): a, c, t, g, unknown or other
  misc_feature (377)..(377): n is a, c, g, or t
  modified_base (423)..(423): a, c, t, g, unknown or other
  misc_feature (423)..(423): n is a, c, g, or t
tcagtacgagtatgcacgaccggtgctcgatttagtacacacacttagggagttggggggggtctcaggaggcgagcgctctcgggacgtctccaccatggcctgggctctgctattcctcaccctcctcactcagggcacgagggtcctgggcccagtctgccctgactcagcctgcctccgtgtcgtgggtctcctggacagtcgatcaccatctcctgcactggaaccagcagtgacgttggtagtataactntgtctctggtaccacngcaccaggacaacgcccctaancatcgatttangtatgtacagtaactccgcctcgtacggtttctatcgtcttctgtcgctacgatcgngacactccgcctccngacctattccgtcgtcggcttccgacggtctggacggtacgacggnttagtatttaacttcgcgtcgacgtctactaagtaactacgaagtcgaactcgaacgacctacgtactaacggttaccttaccgggaacgtcgggaaccgtaacggtcccgtaccgtaccgtacggtaccgaccgtacccgaacgacccccaaaccgtcgtaccg

SEQ ID NO: 198424 - DNA, 616 bp, Homo sapiens
  misc_feature: GYAE6OF01B74VD.18.59.F04.1.454.CMB.1.raw
  modified_base (253)..(253): a, c, t, g, unknown or other
  misc_feature (253)..(253): n is a, c, g, or t
  modified_base (461)..(461): a, c, t, g, unknown or other
  misc_feature (461)..(461): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatccaccatctcctgcactggaaccagcagtgacgttggtgttatactntgtctctgtaccaacagcaccagacaacgccccaaactcatcgtatttatgtatgtactactaagtccggtccctcgtagggtttactaactcgtcttctcgtcgctcctaagtctcggcaacgaccggtccctccgtacgacctacttccgtcgtccgggccctcgcgtacggacggacggacggacgtgtaattacgttacgtacncgacgtcgtactataactaacgtaacgaccacgaccactacttctctacgttacgttacggttaccgtacggtacggtaccggaacggttaccgtaccggtcccgtaacggtaccgtaccgacccgaacccggtacccaaccccgtcgttacccg

SEQ ID NO: 198425 - DNA, 647 bp, Homo sapiens
  misc_feature: GYAE6OF01DWB7E.18.59.F04.1.454.CMB.1.raw
tcagtacgagtatgcacgaccggtgctcgatttagtacacacacttagggattgggggagctctgggagaggagccccagccttgggattcccaagtgttttcattcagtgatcaggactgaacacagaggactcaccatggagtttgggctgagctggattttcctgctgcttattttaaaggtgtccagtgtgaggtgcagcgtggtggagtcggtgggggaggtcgttagggtaaacgggccgggggggttacccttaggacctcccccgtgtaccacgcctcgtggacttctactttcaggtaacgcctggatgaacgtcgggccgcgaggcctaccgagggacggggcgtggaggtgggtggaccgtaataaaaccaaacgtgagtggtaggacaacgagactacgctcgacctaccggagaagcagtactacacatactagaagagatagtaacttaacgaaaagccacgtactagtactactacgaactaatacgaaaccacggtacccgtaaggaaaccggaacccggaacgaaccgacgtaacgtccgttagtaacttaccgtacgaaccctactaaccgtcccgtaagaacgtcctaactaactacctactacgtacggtacgtccgtcgtaccggg

SEQ ID NO: 198426 - DNA, 732 bp, Homo sapiens
  misc_feature: GYAE6OF01CM9V3.18.59.F04.1.454.CMB.1.raw
  modified_base (598)..(598): a, c, t, g, unknown or other
  misc_feature (598)..(598): n is a, c, g, or t
tcagtacgagtatgcacgaccggtgctcgatttagtacacacacttagggattggggagctctgggagaggagccccagccttgggattcccaagtgttttcattcagtgatcaggactagaacacagaggactcaccatggagtttgggctgagctggtacttttccttgctgtacttaagttttaaaggtgtacctaggtgtaggaggtgcgagtcgtgggtggtaggtggtggggggaggtaccggttaggggtaaacggggtcccgggggggttacccttacggtacccgttcccccgttaggtaaccacgtccgttcgtaggtactttaccgtacctttcgaaggttaacggaccgtaggtagtacggaacggtcgggtacccgaccgacgggccgtaccgggaggggtaacgggcgtgggtagggtcggggttacggaaccgttaaacgtaaaaacctaaacgtgaaggtaggtacggaacaacgacgacgtacgcgtacgacgacgtagaacgcagtactacacactactacaagagagtagaactaacaaaacgcgaacgtagtacgtactactagtaacaagtacgaanactacgtaagaacggacgaacgacacgacgtacgtactaacgtactaccgaccgtactaccgtacccgtaagaaccgacgtaaccaacttaaccgtaacctaacgttaaccggtactcgggtacccgtaccggg

SEQ ID NO: 198427 - DNA, 891 bp, Homo sapiens
  misc_feature: GYAE6OF01ERXSN.18.59.F04.1.454.CMB.1.raw
  modified_base (325)..(325): a, c, t, g, unknown or other
  misc_feature (325)..(325): n is a, c, g, or t
tcagtacgagtatgcacgaccggtgctcgatttagtacacacacttagggattgggggagagaagacaggattcaggacaatctccagcatggccggcttccctctcctcctcaccctcctcactcactgtgcagtcggtcgtcggccagtctgtcgctgactcacgcccaccctcgacgtccgttcggcccgggggacccccggagacgggtacgggtccaacctacttcctccgtcggacctacgggtaggggacacctaccctaccgaacgtacgggtcggggggtacggttatggacttacgtaccacggtacggtaaccncgacgacgtccttacggacggacacccgtaacccctaactcctagtaatttagttaggtacacaaactacggtcccggcctacgggtaccgggtccctacgaccgtacttccgtcgtacggtaccctaaccgtacgttccggtacggtccctaaccccgtcgtccgtaccccgttacccgtacggtaccctaacgttaccggtcgggtttcccggggcccttaacccgggtacggttccgggtaacggtacgggttacggtacgggtacgggtacttaaccggttaaccttttaacgtttccgaccgttaaccgttaccgtttaaccgtaggttaaccgaacgttagggtacgggtacgggttacgttaaggggttacgggttttccgggttaactttcgggtttccggttaccggtttacgggttaaccgggttccgggaaccggggttaaacccgtaaccgggtttaccctaccccgggtttaaacccggtaaccgtaccccgggtaacccgggaaacccccggttaaacccggaccccctttaaaccccggtgtttaaccccg

SEQ ID NO: 198428 - DNA, 585 bp, Homo sapiens
  misc_feature: GYAE6OF01DFE35.18.59.F04.1.454.CMB.1.raw
  modified_base (228)..(228): a, c, t, g, unknown or other
  misc_feature (228)..(228): n is a, c, g, or t
  modified_base (305)..(305): a, c, t, g, unknown or other
  misc_feature (305)..(305): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtggttatactatgtctcctggtaccaacagcaccaggccaaacgcccccaaactcatgatttangatgtcaactaatccggccctagagggtttactaatcgtcttctctggcctcgaagttctggcaacgccggtacctcccgtgaccatctcgtcgggcctccgaggctaggagacgaggctagtagttacttacgtgactagcctagtataatacaagtcaccagacctacttctactaattcgtaccgttacggaaccgtacgggaaccgtaacggtccctaacccggtcctaagggttaccaacccggacccgtaaacccggcccaaacccccgtacgg

SEQ ID NO: 198429 - DNA, 532 bp, Homo sapiens
  misc_feature: GYAE6OF01A0XYA.18.59.F04.1.454.CMB.1.raw
  modified_base (247)..(247): a, c, t, g, unknown or other
  misc_feature (247)..(247): n is a, c, g, or t
  modified_base (269)..(269): a, c, t, g, unknown or other
  misc_feature (269)..(269): n is a, c, g, or t
  modified_base (306)..(306): a, c, t, g, unknown or other
  misc_feature (306)..(306): n is a, c, g, or t
  modified_base (433)..(433): a, c, t, g, unknown or other
  misc_feature (433)..(433): n is a, c, g, or t
  modified_base (444)..(444): a, c, t, g, unknown or other
  misc_feature (444)..(444): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttanaactatgtctcctggtaccaanagcacccaggacaaacgcccccaaactcatgatttangatgtcactaatcgccctcagggtttctaatcgtcttctctgctccagtctgcaacacgcctcctgaccatctctcgggcctccgaggctgacggacgaggctagtatttattactgcagctcatanaacagcaccanctactctctattcgtcgttacggaacgtcggggaacctaacggtcctacccgtcctaggtccacgaccccaacggcccaacccgtacg

SEQ ID NO: 198430 - DNA, 619 bp, Homo sapiens
  misc_feature: GYAE6OF01A087D.18.59.F04.1.454.CMB.1.raw
  modified_base (248)..(248): a, c, t, g, unknown or other
  misc_feature (248)..(248): n is a, c, g, or t
  modified_base (381)..(381): a, c, t, g, unknown or other
  misc_feature (381)..(381): n is a, c, g, or t
  modified_base (536)..(536): a, c, t, g, unknown or other
  misc_feature (536)..(536): n is a, c, g, or t
  modified_base (614)..(614): a, c, t, g, unknown or other
  misc_feature (614)..(614): n is a, c, g, or t
tcagtacgagtatgcacgaccggtgctcgatttagtacacacacttagggattggggagagagacccctcccctgggatcctgggcccagtctgccctgactcagcctgcctccgtgtctgggtctcctggacagtcgatcaccatctcctgcactggaaccagcagtgacgttggtgttataactatgtctcctggtaccaacaggcacccgaggaccaaaacgcccccaaaatcaatgtaatttangatgtacaactaatcacgcccttgaggggttttctaatcgtcttctctggctccaagtctggcaacgaccggcctccctgacctatcctcgtgggcctacgaggtctgacggacgaggctgtattattactgntagctacaatactaacagtacacacgctacgtctcttaacgtgttaccgttacggaacttacgggaacctaaacggtcctaacccgttactaacggtacacgaacccaacgggaccccaaaccctacgtacctacctaactccgttacgtccccnccgttaccctacctactaccgtcggtaccttcggaacggtccgggtacgtacggacgaacggccgacctattaacggngtacg

SEQ ID NO: 198431 - DNA, 666 bp, Homo sapiens
  misc_feature: GYAE6OF01B0DKZ.18.59.F04.1.454.CMB.1.raw
  modified_base (231)..(231): a, c, t, g, unknown or other
  misc_feature (231)..(231): n is a, c, g, or t
  modified_base (255)..(255): a, c, t, g, unknown or other
  misc_feature (255)..(255): n is a, c, g, or t
  modified_base (272)..(272): a, c, t, g, unknown or other
  misc_feature (272)..(272): n is a, c, g, or t
tcagtacgagtatgcacgaccggtgctcgatttagtacacacacttagggagttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatccaccatcctcctgcactggaaccngcagtgacgttggtgttataactntgtctcctggtaccaanagcaccgaggacaaacgcccccaaatcatcgtatttatgtatagtctaactaacgtccggtacccttcgtacggggtttacctaacgttcgtccgtttctcgttacgggtccttaccgaagtttccgtcggtaccaaccgaccggtccctcccgtacgaccctactcgttacgtcggtaccttaccgacggtctacgggacggtacggtacggtacgttagtaacgttttactacgtagaccgtacgtcctactaactaactaacgaacgccaacgcaacgcctacacgtaacgtcgttacggaacggtaccggtaccgtaaggttaccctacccggtaccgttacggtaccgtaccggacccgaaaccggacccctaaccccgtcgttacccg

SEQ ID NO: 198432 - DNA, 660 bp, Homo sapiens
  misc_feature: GYAE6OF01BMUM5.18.59.F04.1.454.CMB.1.raw
  modified_base (254)..(254): a, c, t, g, unknown or other
  misc_feature (254)..(254): n is a, c, g, or t
  modified_base (259)..(259): a, c, t, g, unknown or other
  misc_feature (259)..(259): n is a, c, g, or t
  modified_base (277)..(277): a, c, t, g, unknown or other
  misc_feature (277)..(277): n is a, c, g, or t
tcagtacgagtatgcacgaccggtgctcgatttagtacacacacttagggagttgggggggggtctcaggaggcagcgctctcgggacgtctccaccatggcctgggctctgctattcctcaccctcctcactcagggcacagggtcctgggcccagtctgccctgactcagcctgccctcgtgtctgggtctccgtggcagtcgatcaccatcctcctgcacgtggaaccagctagtgtacgttggtagttanaactntgtctcctggtaccaacngcaccaggacaaacgcccccaaatcatcgatttatgatgtacactaatccggaccctgtacgggtttactaacgtcgtacttcgtctgtctccgtagtctggacaaccgcgtaccctcctagtacccatcctcgtcggtcgtccgacggtacgtcggaacggaccggacggtactacggtaatttacgttacgtgtacgacggtctactacgtaacgttaaccaagtacctaaccgtacgtacctaccttacctaccttacgttaccgttaccgttaccggtaacggtaccgggtaacccggaaccggttcccgaaccgtttacccgaccgggttccaaacccggtaccccgacccggaaaccccgtaaccccgtaaccccgg

SEQ ID NO: 198433 - DNA, 601 bp, Homo sapiens
  misc_feature: GYAE6OF01CXUZ6.18.59.F04.1.454.CMB.1.raw
  modified_base (381)..(381): a, c, t, g, unknown or other
  misc_feature (381)..(381): n is a, c, g, or t
tcagtacgagtatgcacgaccggtgctcgatttagtacacacacttagggattgggggggggtctcaggaggcagcgctctcggggacgtctccaccatggcctgggctctgctattcctcaccctctcactcagggcacagggtcctgggcccagtctgccctgactcagcctgcctccgtgtctgggtctcctggacagtcgatccaccatctcctgccactggaaccagcagtgtacgttggtaggttataactatgtctctggtaccaacagccacccaggacaaacgcccccaaactcatgtatttatgatgtcactaatccggccctcgtaggggtttactaatcgcttctcgtgctacctaagtctggacaacncggcctcctcgaccatctctgggcctccgaggctggacggacgaggctgaatttatactgtacagctacagttactaacgaacgaccaacgacgtactacctcttacttcttcgttccgttacgggaaccgttacggggtaccaaacgggttccacccgggttacccgttacgggtccctaaccggaccccgaaacggacccccgtaaaccccgtacccg

SEQ ID NO: 198434 - DNA, 752 bp, Homo sapiens
  misc_feature: GYAE6OF01CNS4D.18.59.F04.1.454.CMB.1.raw
  modified_base (226)..(226): a, c, t, g, unknown or other
  misc_feature (226)..(226): n is a, c, g, or t
  modified_base (240)..(240): a, c, t, g, unknown or other
  misc_feature (240)..(240): n is a, c, g, or t
  modified_base (250)..(250): a, c, t, g, unknown or other
  misc_feature (250)..(250): n is a, c, g, or t
tcagtacgagtatgcacgaccggtgctcgatttagtacacacacttagggattggggggggtctcaggaggcagcgctctcgggacgtctccaccatggcctggctctgctattcctcaccctcctcactcagggcacgagggtcctgggcccagtctgccctgactcagcctgcctcgtgtctgggtctcctggacagtcgatcaccatctcctgcatggaaccngcagtgacgttggngttataactntgtctctggtacaacagcaccaggacaacgccccaaactcatcgtatttactgtatgtacaagtaacgtccgtcccgtcgtacggggtttactaacgtcgtacttcgtcgtacggtcctaccgtaagtcgtcggaccaaccgtaccgggtcccttacccgtacggtaccctaacgttccgtcgttaccggggtaccttcccggtaacgggtccgttacgggaacgggtaaccgggaggtccgttagggttaacttttaacgttaccgtcgtaccgtacggtccttaactaagttaaccttaaacgaacggtaccgacggtaaccgaacggtaacctaaccgttaaccggttaaacggttacccggttaaccgggtaaaccgttaccggggtaaaacccggtaacgggttacccgtaaccccgggttaccgttaaaccgggtaccgtaacccggtaacccccgaaaccgggtaccccctaaacccccgtacggttaaccccgg

SEQ ID NO: 198435 - DNA, 630 bp, Homo sapiens
  misc_feature: GYAE6OF01ET6ZB.18.59.F04.1.454.CMB.1.raw
  modified_base (270)..(270): a, c, t, g, unknown or other
  misc_feature (270)..(270): n is a, c, g, or t
  modified_base (276)..(277): a, c, t, g, unknown or other
  misc_feature (276)..(277): n is a, c, g, or t
  modified_base (328)..(328): a, c, t, g, unknown or other
  misc_feature (328)..(328): n is a, c, g, or t
tcagtacgagtatgcacgaccggtgctcgatttagtacacacacttagggagttggggggggtcgtcaggaggcagcgctctcgggacgtctccaccatggcctgggctctgctattcctcaccctcctcactcagggcacagggtcctgggcccagtctgccctgactcagcctgcctccgtgtcgtgggtctcctggacagtcgatcaccatctcctgcactggaaccagcagtgacgttggtggttataaactattggtcttcccgngtcgtnnaccaacgacgaccaccgacgacaaccgaccccaactgactatatattagtntagtacgtagtacgtacgtacgtccgtacgttacgttacgttacgtcgtacgttcgtcgtacgtactacgtacgtacgtacgacgtaccgtaccgtaccctactactaccgtacgtacgtacgtacgtacgtacgtacgtacggacggtacggtacggtacgtacgtacgttacgttacgtacgtactacgacgtactactactaactaacgacgacgacgacgacgactacgtacgtacgtacgtacgtacggtacgacgtacgtaccgtacgtacgtaccgtacgtaccgacccgacccg

SEQ ID NO: 198436 - DNA, 710 bp, Homo sapiens
  misc_feature: GYAE6OF01D3IK4.18.59.F04.1.454.CMB.1.raw
  modified_base (236)..(236): a, c, t, g, unknown or other
  misc_feature (236)..(236): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacgagggtcctgggcccagtctgccctgactcagcctgcctcgtgtcgtcgggtctccgtggactgtcgatccacctatcctctgcacgtaggaaccngcaggtgtacggttggtagttaatacgttgtcgtccttccgtacggtaaccaacgacgaccgaaccgaggaaccaaaacccggacccccctaaaagtccgtaagttacgttaatttagtacgtacgttcgtaacctaacttaacggtccccggtacccgttacggttaacgggttttacctacgtccgttcttcgtcgtacgtcctacgtacgtcgtacgacctaaccgcccggtcccttaccgcgtaacctacgttccgtccggtacggtcctacggtacggtcgtaacgggacggacggtacgtacgttagttaacttacgtacgtcgctacgtactacaatacgtaacgacgtaccaacctacgtctacgttactacgtgttcgtaccgtacggtaacggtccggaacgtaccgtaccgtacccggtagtaccgtaccgaacccgtacccgacccgtaacccgacctacgg

SEQ ID NO: 198437 - DNA, 840 bp, Homo sapiens
  misc_feature: GYAE6OF01C0Q8X.18.59.F04.1.454.CMB.1.raw
tcagtacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggtatttttccttgctgtcttaattttaaaaggtgtcagtgtgaggtgcagcgtggtggagtcgtgggggaggtcgttagggtaaacgggcccgggggggttcccttaggacccttccccgtgtacacgcctcgtggtatttcacttttcgaggttaaggcctggataggaacgtcggggtcccgcccgagggcctaccggagggggaacggggtcgtggggagggtcggggtttagggaccggttaaaagtttaaaaacccgaaaaacgttggaaacggttaggggtacgggaaaccaaacgaacggtaaccgtaaccggcttacggacccgtaacccggtaaggaaacggccaaggtactttaccaacccgtattacctaacgaaacgtagtaacgtagtaaacttaaacgaaaaacggcctaaacggtccgttagtaactcgttacgaactaaaacgttcgaaacctaacggtacccgtaaacggaaccgggtaaacccggagggaaaccaacccggtaagtaccccggttagtttaaccgttaacccgttaacgtaaccccaaccgttaaacccgttacccccgtaaggaaaacccgttccggtaaacccttaaaccgttaaccccttaaacgttaaacccgttacggttaaaccgttccgggtaaccccgttaccgggg

SEQ ID NO: 198438 - DNA, 698 bp, Homo sapiens
  misc_feature: GYAE6OF01DCBCT.18.59.F04.1.454.CMB.1.raw
  modified_base (185)..(185): a, c, t, g, unknown or other
  misc_feature (185)..(185): n is a, c, g, or t
  modified_base (270)..(270): a, c, t, g, unknown or other
  misc_feature (270)..(270): n is a, c, g, or t
  modified_base (520)..(520): a, c, t, g, unknown or other
  misc_feature (520)..(520): n is a, c, g, or t
  modified_base (532)..(532): a, c, t, g, unknown or other
  misc_feature (532)..(532): n is a, c, g, or t
tcagtacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggtattttcctgctgcttattttaaaggntccagtgtgaggtgcagcgtggtggagtcggtgggggagtcgttagggtaacgggccgggggttcctagtacccgtcctagtacncgtcctgtgtacttctacttacgaggtacgtccgtaggatacgtacgtcggtccgaccgacggccgtacggaggggtacgggtcgtagggtacggttcggggttacgtaaccgttaaacgttaaaaaccgaacggttagtaacggtagggtaacgacaacgaacgtaccgtacgcgtacgaccgtaccggagaacgcgaagtactaccaactcgtacaacgagagtatagtaataacgaaagcgaacgtntacgtatacganaactataacgacacgacgtagaaccggaacgacgtacaccggtacgtaccgttagtaaccgttacgtacgtaaccctaccgtacccgtaacccgaagtaacccgtcctaaaccctaccgttaactaccgttaacgttaaccggacggttccgacccggttaccggg

SEQ ID NO: 198439 - DNA, 621 bp, Homo sapiens
  misc_feature: GYAE6OF01C6S2G.18.59.F04.1.454.CMB.1.raw
  modified_base (321)..(321): a, c, t, g, unknown or other
  misc_feature (321)..(321): n is a, c, g, or t
  modified_base (407)..(407): a, c, t, g, unknown or other
  misc_feature (407)..(407): n is a, c, g, or t
  modified_base (510)..(510): a, c, t, g, unknown or other
  misc_feature (510)..(510): n is a, c, g, or t
tcagtacgagtatgcacgaccggtgctcgatttagtacacacacttagggattgggggtctgggagaggagccccagccttgggattcccaagtgttttcattcagtgatcaggactgaacacagaggactcaccatggagtttgggctgagctggatttttccttgctgctattttaaaaggtgtccagtgtgaggtgcagctggtggagtcgtggggggaggtcgttgggtaaaggcccggggggggttcccttaaggacctcccccgtgtaccacgcctctggattcactttcagtaaggcctggatgaactggcccncaggctccgagggagggctggagtgggtggccgtaataaaccaaatgagtggtggacacgagactagctgccaccgtagaagcagnttacacctatcacaagagatgaattacaaaagtcaacgtcttagtacttctagactaaaatcgaaacacgcctagaacgaaccgaggaaccacgtacgccgtnttaacgtacttacgtaacccaacacctcccgtaacgaaccgtcctaacctaaccttaccttaactaccgttaacggtaacgttacgacccgttcgacggggtaaccccggg

SEQ ID NO: 198440 - DNA, 545 bp, Homo sapiens
  misc_feature: GYAE6OF01A2HWY.18.59.F04.1.454.CMB.1.raw
  modified_base (303)..(303): a, c, t, g, unknown or other
  misc_feature (303)..(303): n is a, c, g, or t
  modified_base (347)..(347): a, c, t, g, unknown or other
  misc_feature (347)..(347): n is a, c, g, or t
  modified_base (459)..(459): a, c, t, g, unknown or other
  misc_feature (459)..(459): n is a, c, g, or t
tcagtacgagtatgcacgaccggtgctcgatttagtacacacacttagggattgggggctgggggtctcaggaggcagcgctctcgggacgtctccaccatggcctgggctctgctattcctcaccctcctcactcagggcacagggtcctgggcccagtctgccctgactcagcctgcctccgtgtctgggtctcgtggacagtcgatcaccatcctcctgcactggaaccagcagtgacgttggtgttatactatgtctcctgtaccacagcaccagacaacgccccaatcatgtatttangtatgtacactaagtccgcctgtacgggttctagtcgtcttctntcggctcagtctcggacacgccgtccctccgtacgacctacgtcgtcgtcgggcctccggaggtcgtaggaacggacgacggtctagtattactactgcagtctacaattanactaacgcaccagacctactcttactagtcgttcgtacggacgtcggacacggtccaccgttcgtacgacacgcccgaacgacccc

SEQ ID NO: 198441 - DNA, 572 bp, Homo sapiens
  misc_feature: GYAE6OF01DOYCD.18.59.F04.1.454.CMB.1.raw
  modified_base (379)..(379): a, c, t, g, unknown or other
  misc_feature (379)..(379): n is a, c, g, or t
  modified_base (482)..(482): a, c, t, g, unknown or other
  misc_feature (482)..(482): n is a, c, g, or t
  modified_base (531)..(531): a, c, t, g, unknown or other
  misc_feature (531)..(531): n is a, c, g, or t
  modified_base (566)..(566): a, c, t, g, unknown or other
  misc_feature (566)..(566): n is a, c, g, or t
  modified_base (568)..(568): a, c, t, g, unknown or other
  misc_feature (568)..(568): n is a, c, g, or t
  modified_base (570)..(572): a, c, t, g, unknown or other
  misc_feature (570)..(572): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggacaaacgccccaaactcatgtatttatgatgcactaatccggcctgtaggggtttctaatcgtcttctcgtggctaccaagtctggacaacaccggccctccctgacctatcctcgtcgggctccaggctggacggacgaggctagtattaattacgtgcagtctacaataanaacacgacaaccagcacttctactattcgttaccgtaggaactgggtaacccaaggtcctaaccggttccgtaggtccaccgaccccgaacggccccaacccngtcgtaccacttccgtccgttcccccgccctcctaccatacctcgtacnggacgcgggtctagggcaacgggcacaagtacggntncnnn

SEQ ID NO: 198442 - DNA, 821 bp, Homo sapiens
  misc_feature: GYAE6OF01AHG71.18.59.F04.1.454.CMB.1.raw
  modified_base (371)..(371): a, c, t, g, unknown or other
  misc_feature (371)..(371): n is a, c, g, or t
tcagtacgagtatgcacgaccggtgctcgatttagtacacacacttagggagttggggggggtctcagggaggcagcgctctcgggacgtctccaccatggcctgggctctgcttatcctcaccctcctcactcgagggcacgacgggtcctcgggcccagtcctcgccctgactcacgcctgcctcgtgtcgtgggtcctccgtaggacagtcgactccaacctatcctccgtgcctacgtacgggaacctagcgtaaggttcggtacggtttggttagttaactaacttgtcgttcctccgttacggtaaccaacgacgaccaaccgacggtaaccaaaccgaccccctaaatcgtaatgttatttagngtatcgtacctaacgtaaccgtcccggtaccgttacggttaacgggtttactaacgtcgttacctttcgccgttaccgggtcctaaccggttaactccggtaccggaacccgtaaacccggtccccgggtaccccttacccgacgtaaaccccgttcttccccgggttccggtacccggtaccgtaccgggtacgggtcgttaacggggaaacgggtcgttaacggttctaacgggttttaattaaccggttacgcgtaccggtaactactaacgtaactaaccgtaacgaacccgtacctaacccgcgttacctaaccgttacgttacgttacggttaccgttaccggtaaccgggaaccgggttacggtaacccggtaccggtacccgtaaccgttccggaaacggcccctaaacccggaccctaacccggtccctaaacccggttcg

SEQ ID NO: 198443 - DNA, 724 bp, Homo sapiens
  misc_feature: GYAE6OF01DEMJO.18.59.F04.1.454.CMB.1.raw
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccattctcctgcacgtcggaaccagcagtgacgttggtggttatactatgtctcctggtaccaacagccaccaggacaaacgcccccaaactcactgatttatgatgtcactaactccggtcctacgtagggttctaagtcgtctttcgtctcggtctaccgtaagtcgtcggaccaaccgtccgggtcccctccccgttagacccctacttccttccggtcggggtcccttacccgagggtcccgttagggaacgggtaaccgggtaagggtccgtttacgtaacgtttttaacgtttaaccgtcgtaccgtaacgtcccttaactattaaacttaaccggaaacgtcccaaccgaacgtcctaacctttccgttacttaacgttcggttaccggtttaccgggtaaaccggttacgggaaaccccgttaacgggttcccgttaacccggttaccgtaaccgggttacccaaccggtaaccccgaaaccccgggacccctaaaccccgtaaccgg

SEQ ID NO: 198444 - DNA, 599 bp, Homo sapiens
  misc_feature: GYAE6OF01CCTYJ.18.59.F04.1.454.CMB.1.raw
  modified_base (230)..(230): a, c, t, g, unknown or other
  misc_feature (230)..(230): n is a, c, g, or t
  modified_base (371)..(371): a, c, t, g, unknown or other
  misc_feature (371)..(371): n is a, c, g, or t
  modified_base (592)..(592): a, c, t, g, unknown or other
  misc_feature (592)..(592): n is a, c, g, or t
  modified_base (595)..(595): a, c, t, g, unknown or other
  misc_feature (595)..(595): n is a, c, g, or t
  modified_base (597)..(599): a, c, t, g, unknown or other
  misc_feature (597)..(599): n is a, c, g, or t
tcagtacgagtatgcacgaccggtgctcgatttagtacacacacttagggagttgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagccccaaatcatgatttangatgtcactaatcggcctgaggggtttcaatcgtacttctactggtctccaagtctaggcaacgacggcctcctagaccctatcctcgtcgggcctaccgaggctaggacgtacggaggtcctagtaactttacgttaacngctaagtcttacaattaacacaagcagcagctactgaagttcttacggaactcgggaactacggtccaaccgtcgtaaggtcacgacccgtaacggaccctaaaccccgtgtacgtacctaacgttcccttaccgttacccccgcccttaccgtacctaaccgttctaccgttactacggacgggtccggtacgtcggaaccgtaaggcctacaagtacgncancnnn

SEQ ID NO: 198445 - DNA, 638 bp, Homo sapiens
  misc_feature: GYAE6OF01CVXUE.18.59.F04.1.454.CMB.1.raw
  modified_base (249)..(249): a, c, t, g, unknown or other
  misc_feature (249)..(249): n is a, c, g, or t
  modified_base (254)..(254): a, c, t, g, unknown or other
  misc_feature (254)..(254): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaaccagcagtgacggtttggtgttanaactntgttcctctggtaccaacagccaccagacaaacgccccaactcatgtattatgatcgtactactaacgtccggtcccttacgtaggggtttactaacgttccgtactttcgtccgttcggtacctacccgtaagtcttacggaccgaaaccgaccggtcccttcccgtacgaccctacgtctccggtcggcctccgaggccgtggaacgggacgacggtactagtatttacgtacgtgctagtcctatagtaactaacgtaacgaccaccgtacgacctaccgtcttactagttcgttaccgttacggaccggtaccgggtacgtaacggtcccgtacccgttacgtcggtacaccggacccgacccggacccaacccgtaccg

SEQ ID NO: 198446 - DNA, 669 bp, Homo sapiens
  misc_feature: GYAE6OF01EZ1UQ.18.59.F04.1.454.CMB.1.raw
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgactttggtgttataactatgtctcctggtaccaacagcaccaggacaaacgcccccaaactcatgatttatgatgtcactaatccgcctcgtagggtttacaatcgcttctctgcctacaagtctggccaacgaccggccctcccgtcgaccctattcctcgtcgggtcctccgagggtcctagggaacgggaccggtagggtacctaggtaacttttaacgttaacgtgaccgtacggtccttactagttaaacttaacccgaaacgacccaacccgtaacgtaacctaccttaccgttaccttagttccgttaccgtttaaccggggtaaccgttacggggaaaccccgtaagggttcccgtaaacccgttcccgtaacgggttacccgaaccggacccccgaaaccgggtccccctaaaacccccgtaaccg

SEQ ID NO: 198447 - DNA, 340 bp, Homo sapiens
  misc_feature: GYAE6OF01D24XQ.18.59.F04.1.454.CMB.1.raw
  modified_base (194)..(194): a, c, t, g, unknown or other
  misc_feature (194)..(194): n is a, c, g, or t
  modified_base (324)..(324): a, c, t, g, unknown or other
  misc_feature (324)..(324): n is a, c, g, or t
  modified_base (330)..(340): a, c, t, g, unknown or other
  misc_feature (330)..(340): n is a, c, g, or t
tcagtacgagtatgcacgaccggtgctcgatttagtacacacacttagggattggggagagaagacaggattcaggacaatctccagcatggccggcttccctctcctcctcaccctcctcactcactgtgcagggtcctgggcccagtctgtgctgactcagccaccctcagcgtcgtcggggacccccgggnaggagggtcaccatctcttgttctggaacgcagctccaacagtcggaatcagacccaaggctcgccccctggtccacttctcgttcccgcctcctccactctcgtactgaggcggcgtggacgaggccgnagtagnnnnnnnnnnn

SEQ ID NO: 198448 - DNA, 721 bp, Homo sapiens
  misc_feature: GYAE6OF01DTQXU.18.59.F04.1.454.CMB.1.raw
tcagtacgagtatgcacgaccggtgctcgatttagtacacacacttagggattggggctgggagaggagccccagccttgggattcccaagtgttttcattcagtgatcaggactgaacacagaggactcaccatggagtttgggctgagctggattttccttgctgctatttaaaaggtgtccagtgtgaggtgcagctggtggagtcgtggggggagcgttagggtaaacggcccgggggggtcccttagacctcccccgtagtaccagcctcgtggattcgtactttcaagtaaggcctggatgaactggtccgcaggctcgagggaagggctgggagtgggtgaccgtaataaaaccaaatgagtggtaggacaacgagacacgctgacgacccgtagaaacgcagacttcaactagtactacgaagagtaatagtaacgttaacaaaaaacggcccgtaacgtaacttagttacgtaccgtagaactaaaacgtacggaaaccaacgggtacccttaaggaaccggaaaacccggaacggtaaaccgaaccgtaacggtacccggttaagtttaaccgtttaaccgttaccggtaaaccctaaccgtaccctaccccgtaaggtaaaaccgtacggtaacctaaaccttaaccgtaaaccgttaacgtaaccggttacgtacggtaaccccgttcgggttaccggggaaaccccgg

SEQ ID NO: 198449 - DNA, 620 bp, Homo sapiens
  misc_feature: GYAE6OF01DXHO6.18.59.F04.1.454.CMB.1.raw
  modified_base (456)..(456): a, c, t, g, unknown or other
  misc_feature (456)..(456): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcctggtaccaacagcaccaggcaaacgcccccaaactcatgatttatgatgtacactaatcgccctcgtacgggtttctaatcgtcttctctggtctcctagtctggacaacgacggccctccctacgaccctactctcgtcgggcctccgaggtctggacggacgaggtcgtagtaattacgttactgcacgtctanaataataacaacgtaccaaccacgacctacgttctacgttactcgttaccgttaccgggaaaccgttcgggtaaacccgtacggttcccgtaaccccggtaccggttaaccgggttacccaacccggaaccccggaaacccggtcccccaaacccccgttaccg

SEQ ID NO: 198450 - DNA, 664 bp, Homo sapiens
  misc_feature: GYAE6OF01C0N73.18.59.F04.1.454.CMB.1.raw
  modified_base (308)..(308): a, c, t, g, unknown or other
  misc_feature (308)..(308): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatcctcctgcactggaaccagcagtgacgttggtgttataactatgtctcctggtaccaacagcaccaggcaaacgaccccaaactcatgtatttanagatgtacactaacgtcggccctacgtagggtttctaagtcgtacttctcgtcggtctacctaagtctacggcaacgaccggtccctccctcgtaccctatccttcgtcgggaccttccgagggtccgtagggaacgggaccggtacgggtcgttacggttaatttaacgtttaccgtcgacctacggtcttaactaacttaaacgttaaccaacggtaccaacccgtacgacctaacttccttactagttccgttacgttacccgggtaacgttacgggtaaacccgtaaccgggttccctaacccggttaccgtacgggtaccaaccggtaccccggaaccggtaaaccccccg

SEQ ID NO: 198451 - DNA, 614 bp, Homo sapiens
  misc_feature: GYAE6OF01CN8DA.18.59.F04.1.454.CMB.1.raw
  modified_base (390)..(390): a, c, t, g, unknown or other
  misc_feature (390)..(390): n is a, c, g, or t
  modified_base (590)..(590): a, c, t, g, unknown or other
  misc_feature (590)..(590): n is a, c, g, or t
tcagtacgagtatgcacgaccggtgctcgatttagtacacacacttagggattgggggtctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcgttgggtaaaggccgggggggtcccttaggactcccctgtacacgcctctggacttcacttttcgagtaaggcctggatgaacgtgggtccgccaggcctccgaggggagggctggagtgggtgcgtaataaaaccaaactgagtggtaggaacaacgagactacgntcgacaccgtagaaggcagattcaccatcacaagagtatagaattacaaaacgcgtacgacgttacgtatccgtagaactaaagtcgaacacgcgtagaacgtaaccggaggaccaacgtacgtaccgtagttaactacgtacgtacccactaccgcccgttagaacgtcctaactaactactaacgtacctacggtacngtacccgtcggtacgggtaaccgg

SEQ ID NO: 198452 - DNA, 766 bp, Homo sapiens
  misc_feature: GYAE6OF01DLC2E.18.59.F04.1.454.CMB.1.raw
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgtcctgactcagcctgcctccgtgtctgggtctcctggacagtcgatcaccatcctcctgctacgtggaaccagcagtgtacgttggtagttatactatgtctctggtacaacagcaccagacaaacgccccaaatcatgtatttatgatgtactaactaacgtccggtcccttacggtacgggtttactaagtccgtctttaccgtcgttcggtccctaccgtaagttcgttacggacctaaaccgtcccggtacccctcccgtacgtaccctacgttccgtaccggtcgggtcccttacccggagggtccgtaacgggaacgggaaccgggtaggtaccgttagtaactttaacgttaaccgtgtaccgtacggtacttaccgtaagtttaacctaacgaaaccggtaccgaacccgtaacggtaccctacctttaccgttaacgttacgttacgggttaacccgtttaaccgggaaacccggttaccggggtaaaccccgtaacgggttacccccgttaaccccgggttacccgtttaacgggtacccgaaaccccggttaaccccggaaaccccggtaaaccccctaaccccggttaacccgg

SEQ ID NO: 198453 - DNA, 740 bp, Homo sapiens
  misc_feature: GYAE6OF01BTWHK.18.59.F04.1.454.CMB.1.raw
  modified_base (317)..(317): a, c, t, g, unknown or other
  misc_feature (317)..(317): n is a, c, g, or t
  modified_base (338)..(338): a, c, t, g, unknown or other
  misc_feature (338)..(338): n is a, c, g, or t
tcagtacgagtatgcacgaccggtgctcgatttagtacacacacttagggtagtttgggggggactgggggtactcaggagggccacgcggcttctcgggacgtctccgaccacttgggcctggggctctgcctattacctctacccgtcctcacgtcagggcacgacggtccgtggcccagtctgacccgtgactcagcctgcctccgtgtcgtgggtctcgtgacgacgtcgatcaccatctcctgcactggaaccagcagtgacgttggtgttataactatgtctcctggtaccaacagccaccaggacaaacnccccaaactcatcgtatttangtatcgtaccactaacgtccggtcccttcgtacggggttttacctaacggtccgtcttcctcgtcggtcctaccgtaacgttccgtacgggtaccaaacccgtaccggtccccttccccgtacggaacccctacgtttccgttccggttaccggggtcccttacccggtaacgggtccgttacgggtaaccgggaaccggggtacgtacggtttacgttaacttttaacgttaccgttcgggacctacggtcttactaacgttactaaccgtaacgacccgtaaccgacgtacctaaccgttccttacgttacgttaccgtttaccgttaccgggtaacgtacgggtaacctacggtaccctaccgtacgtaccggtacaccgcccgtaacccggaaccccc

SEQ ID NO: 198454 - DNA, 630 bp, Homo sapiens
  misc_feature: GYAE6OF01A1NXP.18.59.F04.1.454.CMB.1.raw
  modified_base (228)..(228): a, c, t, g, unknown or other
  misc_feature (228)..(228): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataactatgtctcctggtaccaacagcacccaggcaaacgcccccaaactcatgatttatgatgtcactaatccggccctcgtagggtttctaatcgtcttctctcggctcaagtctggcaacgacggccctccctgaccactccgtcgtcgggcctccgaggtcgtggacgggacggaggtctaggtatttacttacgtgctagctacaattaactaaccaagtcccaaccgtacgtacctaccgttccttacgttacgttcgttaccgtttaccgggtaaaccgtccggggtaacccgtaacgggttcccgtaaccccggttaccgtacgggtacccgaaccggtacccccgaaccgggtaccccctaaacccccggtacccg

SEQ ID NO: 198455 - DNA, 624 bp, Homo sapiens
  misc_feature: GYAE6OF01ESA04.18.59.F04.1.454.CMB.1.raw
  modified_base (307)..(307): a, c, t, g, unknown or other
  misc_feature (307)..(307): n is a, c, g, or t
tcagtacgagtatgcacgaccggtgctcgatttagtacacacacttagggattggggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtggggggaggcgttggtaaaggccgggggggtcccttagactcccctgtaccagcctctggattcactttcagtaaggcctggatgaactgggtccnccaggcctcgagggaggggctgggaggtggggttcggccgtaattaaaaccgaaactgagtgggtagggacaacagactacgctgccacccgtagaaacggcaagacttcacctatctacaagagatagaattaacaaaagcaacggtctagtatcagactaaatcgaaactgacctagacgaaccgagaaccacgacggtccgtagtacttacacgtaccactactccccgtagaaacgtccgtaactaacctaacttacctaacgtacggtaacgtacggacccttaggccggggtacccgaagggtaaccccgg

SEQ ID NO: 198456 - DNA, 526 bp, Homo sapiens
  misc_feature: GYAE6OF01C4CTK.18.59.F04.1.454.CMB.1.raw
  modified_base (270)..(270): a, c, t, g, unknown or other
  misc_feature (270)..(270): n is a, c, g, or t
  modified_base (303)..(303): a, c, t, g, unknown or other
  misc_feature (303)..(303): n is a, c, g, or t
  modified_base (315)..(315): a, c, t, g, unknown or other
  misc_feature (315)..(315): n is a, c, g, or t
  modified_base (336)..(336): a, c, t, g, unknown or other
  misc_feature (336)..(336): n is a, c, g, or t
  modified_base (358)..(358): a, c, t, g, unknown or other
  misc_feature (358)..(358): n is a, c, g, or t
  modified_base (367)..(367): a, c, t, g, unknown or other
  misc_feature (367)..(367): n is a, c, g, or t
  modified_base (422)..(422): a, c, t, g, unknown or other
  misc_feature (422)..(422): n is a, c, g, or t
  modified_base (437)..(437): a, c, t, g, unknown or other
  misc_feature (437)..(437): n is a, c, g, or t
tcagtacgagtatgcacgaccggtgctcgatttagtacacacacttagggattggggggggtctcgggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcactggaaccagcagtgacgttggtgttaatactatgtctcctggtaccaanagcaccaggcaaacgccccaaatcatgatttangatgtcactaanccggcctgagggtttcaatcncttctctgctcagtctgcaacncggcctccngacctatctcgtcggctccgagtcgtggaggcggagctgtattatcgtgcatctnatatacaagcaacgngcactctctatcgtacctacggtaacgtcgggtaaccaggtcctaccgtccgtaggccaccggaccctaacgaccccaaccctgtaccg

SEQ ID NO: 198457 - DNA, 763 bp, Homo sapiens
  misc_feature: GYAE6OF01A37X1.18.59.F04.1.454.CMB.1.raw
  modified_base (310)..(310): a, c, t, g, unknown or other
  misc_feature (310)..(310): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcctggtaccaacagcacccgaggcaaacgcccccaaactcatgtatttangatgtactactaactccggtccctacgtacggggtttactaagtccgtcttcctacgtcggtccttaccgaaggtctacggacctaaaccgccggtccctcccgtagtaccctagttcccgtcggtacgggtccttacccggaggtccgtaacgggtacgggtaaccggtacggggtacctttaggtaacttttaaccgtttaccgtcggtacccgtacggtacctttaaccgtaaatttaacccgtaaaccgtaaacggacccctaacccggaaccgtaccctaacccgtttcccgttacgttaacgtttaccggttacccggttttaacccggggtaaacccggttacggggaaaccccggttaacccgggttaaccccggtaccccggtttaacccgggttaccggtaccgaaccccggtaccccgggtaaaacccggtaaccccccccg

SEQ ID NO: 198458 - DNA, 680 bp, Homo sapiens
  misc_feature: GYAE6OF01CD0G8.18.59.F04.1.454.CMB.1.raw
  modified_base (258)..(258): a, c, t, g, unknown or other
  misc_feature (258)..(258): n is a, c, g, or t
  modified_base (552)..(552): a, c, t, g, unknown or other
  misc_feature (552)..(552): n is a, c, g, or t
tcagtacgagtatgcacgaccggtgctcgatttagtacacacacttagggagttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgccacgtcggaaccagcagtgacgtttggtagtataactntcgtactccgtacggtaccaacacgaccaccgaggaccgaaaaccgaccccccaaaactccaattaggtaacttttatgaagttcgtacctaactaacgtcccggtcccttacgtacggggttttacctaaagttccggtcctttacgtccgtacggtacccttacgtaacggtccgtacggacctaaaccgcccggtacccttccccgtaccgtaccctattcccgtaccgttcgggtaccctcccggaggtccgtaggtacggaacggacgtctagtaactttactaccgtnaccgactcgtacataactacgtaacgactaccgagccaactacgagttccgtacggacgtacggaccgtacgtaccgtaccggtcgtagtaccaccgtacccaacggaccccaaccctgtccgtaccc

SEQ ID NO: 198459 - DNA, 636 bp, Homo sapiens
  misc_feature: GYAE6OF01DMT7D.18.59.F04.1.454.CMB.1.raw
  modified_base (221)..(221): a, c, t, g, unknown or other
  misc_feature (221)..(221): n is a, c, g, or t
  modified_base (348)..(348): a, c, t, g, unknown or other
  misc_feature (348)..(348): n is a, c, g, or t
  modified_base (467)..(467): a, c, t, g, unknown or other
  misc_feature (467)..(467): n is a, c, g, or t
  modified_base (479)..(479): a, c, t, g, unknown or other
  misc_feature (479)..(479): n is a, c, g, or t
  modified_base (496)..(496): a, c, t, g, unknown or other
  misc_feature (496)..(496): n is a, c, g, or t
tcagtacgagtatgcacgaccggtgctcgatttagtacacacacttagggagttgggggggggtctcaggaggcagcgctcgtcgggacgtctccaccatggcctggctctgctattcctcaccctcctcactcagggcacgagggtcctgggcccagtctgccctgactcagcctgcctccgtgtcgtgggtctccgtggactgtcgatcaccatcctcngcacgtacggaaccagctaggtgtacggtttggtagtttaactaacgttgtacgttctaccggtacggtaaccaacgacgaccaacccgaaggaaccaaaccgacccccaaatcatagtactttagngtatcgtactaactagtccggtcctaggttacggttacacgttcgtcttactgtcgtctaccgtagtcgacgtaccaacgccgtcctcgacgactctcgtcggtcgacgtcgaggtcgnggaacgagcgtntagtattagtacgcgancgtactacgaactacgaaacgtacaccgaacgtctacctacttccgtattacgtcgttaccggtaaccgaaggtcgaacccggtacgtaccgtacgtaccgtaagccgtaacccacccgtaaccggtcccctaccggttc

SEQ ID NO: 198460 - DNA, 665 bp, Homo sapiens
  misc_feature: GYAE6OF01BU02F.18.59.F04.1.454.CMB.1.raw
  modified_base (310)..(310): a, c, t, g, unknown or other
  misc_feature (310)..(310): n is a, c, g, or t
tcagtacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggagcgttgggtaaaggccggggggtccttagacctccccgtgtacacgcctcgtggtattcactttcagtaaggcctggatgaactgggtccnccgaggctccgaggggaacggggctgggaggtgggttggaccgttaataaaaaccgaaacgtgtagtggtaggaacaacgagactacgctacgccaccgtagaaacggcagtactacaccatctacgaagagatagattaacgaaaaagcaacgctagtactacgtagtaacaaagtcgaaactcgaccgtagaaacgtaacccggaagaaccgaacgacggtacccgttagttaacgttacgtaccgtaacccgaacctccttaccccgtaagaaccgtaccgtaactaacctaacgttaaaccgtaccgttaacggttagtaccggtacccgtcggtaccggggtaaacccgg

SEQ ID NO: 198461 - DNA, 625 bp, Homo sapiens
  misc_feature: GYAE6OF01BFIE6.18.59.F04.1.454.CMB.1.raw
  modified_base (301)..(301): a, c, t, g, unknown or other
  misc_feature (301)..(301): n is a, c, g, or t
  modified_base (473)..(473): a, c, t, g, unknown or other
  misc_feature (473)..(473): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgccactgggaaccagcaggtgacgttggtagttaataactatgtctcctggtaccaacagcaccaggacaaacgacccccaaacncatcgatttatgatgtactactaactccggtccctcgtacgggtttactaacgtcgtcttctctggcctcctaagtctcggacaacgaccggccttccacgacctactcctacgtcgggtcctccgacggtcgtggaacgggacggaggtactaggtaatttaacgttacgngtacctagtacctacgtaataactaaacaacgacctaccgacgcctaactctacttactcgttacgttaccgggacgtcgggaactaacgggtccctaccggttaccgtacggtaccgaccgaaccccgaccggaccccaaccccgtacccg

SEQ ID NO: 198462 - DNA, 675 bp, Homo sapiens
  misc_feature: GYAE6OF01EAQHW.18.59.F04.1.454.CMB.1.raw
  modified_base (368)..(368): a, c, t, g, unknown or other
  misc_feature (368)..(368): n is a, c, g, or t
  modified_base (664)..(664): a, c, t, g, unknown or other
  misc_feature (664)..(664): n is a, c, g, or t
  modified_base (671)..(671): a, c, t, g, unknown or other
  misc_feature (671)..(671): n is a, c, g, or t
  modified_base (673)..(673): a, c, t, g, unknown or other
  misc_feature (673)..(673): n is a, c, g, or t
  modified_base (675)..(675): a, c, t, g, unknown or other
  misc_feature (675)..(675): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcaccaggacaaacgcccccaaatcatgtatttatgatgtacactaagtccggtcctacgtacgggtttctaattccgctttctcgtcggtccttaccgaagttctcggaccaaaccgacggtcccctcctcgacctactcctcgtcgggcctcacggtctggagggacgnggactacgtaattttatacgtgcgacgtctacaatactaacgacgcaaccagtcctaactcgttacttagttcgttacgttacgaacggttacggaaacgtacggtaccgtaccgttacgtacgtaccgacccgaacccgaacccggaccccaaaccccgttcttaccgtaccttacccgttacccgttttacccgtacccccttaaccccgttccccttactaaccctttacccgtacgtacgttaccggacgggcccgggtacgtacgggaaccgtcggaccggtataacggtntgatcgngngn

SEQ ID NO: 198463 - DNA, 721 bp, Homo sapiens
  misc_feature: GYAE6OF01B5C7C.18.59.F04.1.454.CMB.1.raw
  modified_base (189)..(189): a, c, t, g, unknown or other
  misc_feature (189)..(189): n is a, c, g, or t
  modified_base (281)..(281): a, c, t, g, unknown or other
  misc_feature (281)..(281): n is a, c, g, or t
tcagtacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggtattttccttgctgcttaattttaaaaggtntccagtgtgaggtgcagctgggtggagtcgtgggggagcgttagggaaacggccggggggtcccttagacctccccgtgtaccacgcctcgnggtattctactttcagttaaggcctggatgaacgtgggtcccgccgaggccgtccggaaggggaacggggcgtgggaggttggggttcggacccggttaaattaaaaacccgaaaacgtgaagtagggtagggaaccaaacgagaacctacgcgtacgaccaacccggtagaaacggcaaggtacttaccaacctagtcctaacgaaaggagtaagtagaaactttaaacgaaaaaacgtcgaaccgcttagtaacttcgaacgaactaaagtacgaaacacgtaccctaaggaaaccgaacccggaaggtaacccaacgtacggtacccgttagtaaccttaacgtacgtaaacccctactaccgtaccccgtaagaaaccgtccgtaacctaaaccgttaactaccgttaacgtacggtactacggtacccttacggg

SEQ ID NO: 198464 - DNA, 521 bp, Homo sapiens
  misc_feature: GYAE6OF01EHB94.18.59.F04.1.454.CMB.1.raw
  modified_base (356)..(356): a, c, t, g, unknown or other
  misc_feature (356)..(356): n is a, c, g, or t
  modified_base (460)..(460): a, c, t, g, unknown or other
  misc_feature (460)..(460): n is a, c, g, or t
  modified_base (517)..(521): a, c, t, g, unknown or other
  misc_feature (517)..(521): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaaactcatgatttatgatgtcactaatcggcctcaggggtttctaatcgcttctctggctccaagtctggcaacacggcctcctgaccatctctgggctccaggctgaggacgaggctgattattactgcagctcatanacaagcacagcactctctatgtcttcgaactggaccgaaggtcaccgtcctaggtcacgcccaacggcccaaccccactcgtcctaacttcctacggttccccncccttcctccacttacctcgtactgacggccgggtctaggctaagggccacagtgannnnn

SEQ ID NO: 198465 - DNA, 531 bp, Homo sapiens
  misc_feature: GYAE6OF01AL7QB.18.59.F04.1.454.CMB.1.raw
  modified_base (249)..(249): a, c, t, g, unknown or other
  misc_feature (249)..(249): n is a, c, g, or t
  modified_base (364)..(364): a, c, t, g, unknown or other
  misc_feature (364)..(364): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttanaactatgtctctggtaccaacagcaccaggcaaacgccccccaaactcatgatttatgatgtacactaatccggccctcgtacggggtttctaactcgtcttctctgctcagtcngcaacgccgcctcctcaccactctcgtggcctcgagcgtgaggacgaggctgtattacgttactcgcagctacgatactacaagccacacgctactctctatcgtctacggaacgtcggtacacggtccgaccgtcgtacgtaccacgacccacgtcccaccctacg

SEQ ID NO: 198466 - DNA, 673 bp, Homo sapiens
  misc_feature: GYAE6OF01DJT86.18.59.F04.1.454.CMB.1.raw
  modified_base (304)..(304): a, c, t, g, unknown or other
  misc_feature (304)..(304): n is a, c, g, or t
tcagtacgagtatgcacgaccggtgctcgatttagtacacacacttagggagttggggggggtctcaggaggcagcgctctcgggacgtctccaccatggcctgagctctgctattcctcaccctcctcactcgagggcacagggtcctgggcccagtctgccctgactcagcctgcctcgtgtctgggtctcctggacagtcgatcaccatctcctgcagtggaaccagcagtgacgttggtgttataactatgtctctggtaccaacagcaccaggcaaacgaccccaaactcatgtattangatgtcactaatccgcctcgtagggtttctaagtccgtcttctcgtcggtcctaccgaagtcctggaccaaacgccggtcctccctcgaaccctagtcctcgttcgggccttaccgaggcctaggaacggacggtaggcttcggtaatttacgttaacgtggactacggtcctaacgtaattaactaacaaacggaccctaacccgaacgtacctaaccgttcccttacgttaaacgttcggttacccgtttaaccggggtaaaccgttaccggggaaacccctaaaacgggttccccgtaaccggttacccgtacgggttaaccaacccgggacccctaaacccggggaaccccctaaaacccccggg

SEQ ID NO: 198467 - DNA, 593 bp, Homo sapiens
  misc_feature: GYAE6OF01B615T.18.59.F04.1.454.CMB.1.raw
  modified_base (208)..(208): a, c, t, g, unknown or other
  misc_feature (208)..(208): n is a, c, g, or t
  modified_base (335)..(335): a, c, t, g, unknown or other
  misc_feature (335)..(335): n is a, c, g, or t
  modified_base (570)..(593): a, c, t, g, unknown or other
  misc_feature (570)..(593): n is a, c, g, or t
tcagtacgagtatgcacgaccggtgctcgatttagtacacacacttagggattggggggctttgtctgggtctcctggacagtcgatcaccatctcctgcactggaaccagcagtgacgttggtggttataactatgtctcctggtaccaacagcacccaggcaaacgcccccaaactcatgatttatgatgtcactaatcggccctnaggggtttcaatcgcttctctggctccaagtctggcaacaccggcctccctgaccatctctgggctcaggctgaggacgaggctgattatacgtgacagtctacattaacaacaacgccaaccgtanacctactctacttagtcgttaccgtacgggaacgtcgggaaccgtaaacggtccaacccggtaccgttaacggacaccggaccccaaacgggacccccaaaccccgtcttacgacctaccttccgtttacccgtaccccctacccttcccctacctaaccttacccgttaccgttaacgtcggaacggggtccgggtacgtacgggaccgtaaacggggcctaaccaaggtacgnnnnnnnnnnnnnnnnnnnnnnnn

SEQ ID NO: 198468 - DNA, 652 bp, Homo sapiens
  misc_feature: GYAE6OF01CIKW3.18.59.F04.1.454.CMB.1.raw
  modified_base (229)..(229): a, c, t, g, unknown or other
  misc_feature (229)..(229): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtaggttataactatgtctctggtaccaacagcaccaggacaaacgacccccaaactcaatgatttatgatgtactactaatccgccctacgtaggggtttactaagtcgtcttctctcggctaccaagtctggaccaacgacgtcctccctgaccactctcgtgggcctccgacggtcgtaggagggacgagggccttagtaatttacttacgtcggactacgtactactaataactaaccgaaagtacccaacccgacgtacctaaccttccttaccgtttacgtttacgttacccgtttaacccgggtaaccggttacgggggtaacccgtaaacgggtccccgtaacccgttaccgtacgggtacccgaaccgacccgtaacccggaccccaaccccggttaacccg

SEQ ID NO: 198469 - DNA, 640 bp, Homo sapiens
  misc_feature: GYAE6OF01BMIQC.18.59.F04.1.454.CMB.1.raw
  modified_base (303)..(303): a, c, t, g, unknown or other
  misc_feature (303)..(303): n is a, c, g, or t
  modified_base (367)..(367): a, c, t, g, unknown or other
  misc_feature (367)..(367): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctctggtaccaacagcaccagacaaacgcccccaaactcatgatttangtatgtcactaactcggtccctgtagggtttctaactcgcttctctggctacagtctggcaacncggccctccgtgaccctatccgtcgtcgggtcctccgtaggtcgtaggaacgggtacggagccgttaagtaacgtttataaccgtgtacgtacgtactacgtaacttaactaacgaacggtaccaacccgtacgtacctaaccttccttaccgttaagtccgtttaccgtacggtaaccggtcgggtaaaccctagggttcccaaccccggttaccgttaacgggtccctaacggaacccccgtaacggacccccgtaaacccccttaaccgg

SEQ ID NO: 198470 - DNA, 616 bp, Homo sapiens
  misc_feature: GYAE6OF01DGDPW.18.59.F04.1.454.CMB.1.raw
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccagcagtgtacggttggtaggttataactatgtctcctggtaccaacagcaccaggacaaacgcccccaaactcatgtatttatgatgtactaactaactccggcccttcgtacggggtttactaacgtcgtctttcgtcgtacggtcctccgtaagttcgtcggacaaccgaccggtccctcccgtacgtacctacttctacgtcggcctccgacggcgtagacggacgaggtctagtactttacttacgtcgtcacgtctacgtataactacaacgcgtagcactacctactacgtaacgtccgtacgggtaacgtacgggaaccgtacggtaccgtaccgtaccgtaaggccgaccgtaacccgaacgaccccaacccgtcgtacccg

SEQ ID NO: 198471 - DNA, 596 bp, Homo sapiens
  misc_feature: GYAE6OF01EVTC3.18.59.F04.1.454.CMB.1.raw
  modified_base (253)..(253): a, c, t, g, unknown or other
  misc_feature (253)..(253): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccagcagtgacgttggtaggttataactntgtctcctgtaccaacagccaccagacaaacgacccccaaactcatgatttatgatgtacactaagtccgcctcgtagggttctaacgtcgtcttctctcgctcagtctgcacgcgcctcctgaccatctcgtcggcctcgacggtctggacgggacgacggtctaggtaactttagtacgtcgacgagtctactaatacttaacgaacgtaccaaccacgtacctaccttccgttacttacgtcgtttccggttaacggtaacggtaccgggaaccgttaacggtcctaacccggttaccgtacggttaccaccgaacccggaaccgccccgaacccctacg

SEQ ID NO: 198472 - DNA, 752 bp, Homo sapiens
  misc_feature: GYAE6OF01C5D2E.18.59.F04.1.454.CMB.1.raw
  modified_base (187)..(187): a, c, t, g, unknown or other
  misc_feature (187)..(187): n is a, c, g, or t
  modified_base (203)..(203): a, c, t, g, unknown or other
  misc_feature (203)..(203): n is a, c, g, or t
  modified_base (238)..(238): a, c, t, g, unknown or other
  misc_feature (238)..(238): n is a, c, g, or t
  modified_base (747)..(747): a, c, t, g, unknown or other
  misc_feature (747)..(747): n is a, c, g, or t
tcagtacgagtatgcacgaccggtgctcgatttagtacacacacttagggattggggagagagacccctcccctgggatcctgggcccagtctgccctgactcagcctgcctccgtgtctgggtctcctggacagtcgatcaccatctcctgcactggaaccagcagtgacgttggtgttataactntgtctctgtaccaacngcacccaggacaaacgccccaaatcatgtatttangatgtacagtactccggcctagtacgggtttactaatcgtcttctcgtcggtcctaccgaagtcgtcggaccaaaccgccggtccctcccgtacgaccctactccttcgtcgggtcctccgtaggctaggaacggacgaggtctaggtatttaactacgtgacacgtctacgataactaacaacgaccaccgagcctactcttacttcgtcgttacgttaccggtaacggtaccgggaaccgtaaacgggtcccgtaacccgttaccgtacggtacccgaacccgtaaccccgaaccgggtaccccctaaacccgtaccgttaccggtaccctaacccgtttccccgtttaccccgtttaaccccccctaccccgtttaacccttacccttaaacccgttaacccgtttacccggtaaacccgttccggggtaacccggggtcccggggttaacccggtccggggtaaacccgtaaccggggtacccccggaacttaaacggccggtancgtac

SEQ ID NO: 198473 - DNA, 883 bp, Homo sapiens
  misc_feature: GYAE6OF01DUD4U.18.59.F04.1.454.CMB.1.raw
tcagtacgagtatgcacgaccggtgctcgatttagtacacacacttagggattggggagctctgggagaggagccccagccttgggattcccaagttgttttcattcagtgatcaggactgaacacagaggactcaccagtggagtttgggctgagctggtattttcctgctgcttaagttttaaaggtgtccagtgtggaggtgcagcgtgggtggtaggtcggtgggggaggtcgttaggggtaaacgggtcccgggggggttcccttacggacccgttccccgtagtaccgacgtccttcgtaggtacttaccgtacgtttacgaaggttaacggtccgttagggtaacgtacggtaaccggtcggggtaccccgaccggtacgggtccgtaccgggaagggggggtaacggggtccggttaggggtacgggtttgggggttaccgggtaaaccggttttaaaaacgttaaaaaacccgaaaagttaggtaacggtagggtaacggaaaccaaacggtaacgtaacgtaacggaccgtacgaccgaacccggtaaggaaacggcgaacgtacgtaccaacctacttaccgaacgaagtaacgtacgtaagttaaaccgtaaaagaaaacgtccaagttacgtacgttaactcgtaaagtaaaccctaaaggaccgaaaggtaccgtaccggtaaacgaacccggtaacggacggaaccctacggtaccgttacgttacggttaactttaaccggactaaccccgaaccgtttaaccccgtccggtaaagaaacccggtcccttaaaacccgtaaactttaaccccgtttaaacgtaacccggttacgggttaacttacccgggtccccggtaaacggggg

SEQ ID NO: 198474 - DNA, 873 bp, Homo sapiens
  misc_feature: GYAE6OF01CSZIY.18.59.F04.1.454.CMB.1.raw
tcagtacgagtatgcacgaccggtgctcgatttagtacacacacttagggattggggagctctgggagaggacgccccagccttgggattcccaagttgttttcattcagtgatcaggactagaacacagaggactcaccagtggagtttgggctgagcgtggtacttttccttgctgacttaatttaaaggtgtcagtgtgaggtgcgagcgtgggtggaggtcggtgggggaggtccgtttaggggtaaacgggtcccggggggggttaccctttaacggacccgttccccgttaggtaaccgacggtcccttcgtaggtaactttccgtaaccttttcgaacggttaaacggccgttagggtaagttacggtaaccgttcggggtccccgaccggacgggtaccgtacccgggaaaggggggtaacggggcggttaggggtagggttcgggggtttacggaacccggtttaaaaacgtttaaaaacccgaaaaacgttggaaaggttacgggtaacgggaaaccaaaacggtacggaaccgtaaccggcgttacggacccgtaacccggtaaggaaaacggctaaaggtaaccttacgaaccgtacgtacctaacgaaagagtaactaacgaacttaaacaaaaagccaaacggtcgttaacgttacgtacgtaagtaacgtaaaacgtacgtaaacgacgtaccgtaaggaaccgggaaaccggaacggaacaaccggacgttaaccgtacgttaacgtaaccgtaccggaaaccctacgtaacccgtaccccgtaaaggaaccgttacccgtaacctaaaaccgtacttaacccgtaactaacgggtaatcccggtacggttaccggg

SEQ ID NO: 198475 - DNA, 658 bp, Homo sapiens
  misc_feature: GYAE6OF01DTQIO.18.59.F04.1.454.CMB.1.raw
  modified_base (233)..(233): a, c, t, g, unknown or other
  misc_feature (233)..(233): n is a, c, g, or t
  modified_base (274)..(274): a, c, t, g, unknown or other
  misc_feature (274)..(274): n is a, c, g, or t
  modified_base (299)..(299): a, c, t, g, unknown or other
  misc_feature (299)..(299): n is a, c, g, or t
  modified_base (311)..(311): a, c, t, g, unknown or other
  misc_feature (311)..(311): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatccacctatctcctgcactggaaccngcagtgacgttggtgttataactatgtctcctggtaccaanagcaccaggacaacgcccccaaacncatgtatttacngtatgtactaacttaacgtccggcccctacggtagggtttctaacgtcgtcttctcgtcggccttaccgtaacgttcctacggccaaaccgtaccgggtaccctcccgttacgaccctacttccgtcgtacgggtcctaccgaggtccgtaggaacgggcggagcgttacgtatttacgttacgtgcgtacgtctactaataacgttaaccgaagtaccaaccgacgacctaccttccgttctaacgttcggttaccgttaccgggtaaccggtcgggtaaacccgaacggtcccgtaaccccgttacggttacggtacctacgaaccccgaacccgtaaccccccg

SEQ ID NO: 198476 - DNA, 721 bp, Homo sapiens
  misc_feature: GYAE6OF01CBW88.18.59.F04.1.454.CMB.1.raw
  modified_base (228)..(228): a, c, t, g, unknown or other
  misc_feature (228)..(228): n is a, c, g, or t
  modified_base (252)..(252): a, c, t, g, unknown or other
  misc_feature (252)..(252): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataactntgtctcctggtaccaacagcaccaggacaaacgcccccaaactcatgatttatgtatgtacaactaatccggccctgtaggggtttctaactcgtcttctctcggctaccagtctcggcaacgccggcctccctgacctattcctcgtcggggtccttccgaagggtccgtagggacgggtacgtacgggtccttagggtaactttttaacgttaaccgtcgacgtacgtcgttactaagttaactaaaccgaacgcccgtaaacccgtacggtaccctaaccgtttcccttacgttaaccgtttcggttacccggttttaacccgggaaacggtttacccgggggtaaaccccgtaaacggggtttaccccgaaccccgggttttaccccggtaaccggggtttaaccccgaaccgggtaacccccccgtaaaccggggtacccccctaaaccccccggttacccggg

SEQ ID NO: 198477 - DNA, 328 bp, Homo sapiens
  misc_feature: GYAE6OF01DPL2Y.18.59.F04.1.454.CMB.1.raw
  modified_base (315)..(315): a, c, t, g, unknown or other
  misc_feature (315)..(315): n is a, c, g, or t
  modified_base (321)..(328): a, c, t, g, unknown or other
  misc_feature (321)..(328): n is a, c, g, or t
tcagtacgagtatgcacgaccggtgctcgatttagtacacacacttagggattggggagagaagacaggattcaggacaatctccagcatggccggcttccctctcctcctcaccctcctcactcactgtgcagggtcctgggcccagtctgtgctgactcagccaccctcagcgtcgtcgggacccccgggcagagggtcaccatctctgttctggaagcagctccaacatcggaagtcagcccaaggctcgccccctggtcactctcgttcccgccctcctccactactcgtactgacgcggctggcaaggcncatagnnnnnnnn

SEQ ID NO: 198478 - DNA, 601 bp, Homo sapiens
  misc_feature: GYAE6OF01A2IS1.18.59.F04.1.454.CMB.1.raw
  modified_base (253)..(253): a, c, t, g, unknown or other
  misc_feature (253)..(253): n is a, c, g, or t
  modified_base (270)..(270): a, c, t, g, unknown or other
  misc_feature (270)..(270): n is a, c, g, or t
  modified_base (303)..(303): a, c, t, g, unknown or other
  misc_feature (303)..(303): n is a, c, g, or t
  modified_base (381)..(381): a, c, t, g, unknown or other
  misc_feature (381)..(381): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtagttataactntgtctctggtaccaacngcaccagacaacgccccaaatcatacgatttangatgtacactaacgccgtcctcgtagggtttactaacgtcgtcttctctcggctacaagtctgacaacgccgcctccncgtacctatctacgtcgggcctccgaggtctaggacggacgacgtcgtagtatttactacgtgcagtctacaatactaacgaacgcctaaccacgacctacgtaccttacctagttccgtaccgttaccggtaacgtacgggtaacccgtaacggtccctaacccggttaccgtacggtaccgaaccgacccccggaacggaccccgtaaacccctaccg

SEQ ID NO: 198479 - DNA, 598 bp, Homo sapiens
  misc_feature: GYAE6OF01ECK91.18.59.F04.1.454.CMB.1.raw
  modified_base (272)..(272): a, c, t, g, unknown or other
  misc_feature (272)..(272): n is a, c, g, or t
  modified_base (306)..(306): a, c, t, g, unknown or other
  misc_feature (306)..(306): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacgagggtcctgggcccagtctgccctgactcagcctgcctccgtgtctgggtctctggacagtcgatcaccatctcctgcactggaaccagcagtgacgttggtagttataactatgtctcctggtaccaacngccaccagacaaacgcccccaaatcatgatttangatgtacactaacgtccgcctagtacgggttttctaagtccgtcttctcgtcggctacgaagtcgtggacctaacgccggtcccttccgtcgacctattccgtcgtcgggtacctccgaggtctaggacggacgtaggtctagtactttatacgtgtcgacgtctataagtactaacgagcaacgcgaactctaacgtacgtaacgtcgttaccggaagtacgggaaccgtaaggtcctaccgttaccgtaggacccgtacgaccccgaacgacccctaacccgtgtacccg

SEQ ID NO: 198480 - DNA, 629 bp, Homo sapiens
  misc_feature: GYAE6OF01CTAP3.18.59.F04.1.454.CMB.1.raw
  modified_base (228)..(228): a, c, t, g, unknown or other
  misc_feature (228)..(228): n is a, c, g, or t
  modified_base (270)..(270): a, c, t, g, unknown or other
  misc_feature (270)..(270): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataactatgtctcctggtaccaacngcaccaggcaaacgcccccaaactcatcgatttatgatgtcactaatccgccctgagggttctaatcgcttctctggctccaagtctggccacctcacgtccctccctggccatcactcggctccgaggctgagatcggagctacgactagttacctgccctagtccctaagtacgacctagtcggaacggtcttaggtacggtttggtttacggttagttcggttaccgtttaccggggtaaaccgttacgggggtaaacccctaaacggggttccccgtaaaccccggttaccccggttaacgggtaacccgacccggaacccccgtaaacggggtaccccccctaaaaccccccgg

SEQ ID NO: 198481 - DNA, 588 bp, Homo sapiens
  misc_feature: GYAE6OF01E3RWL.18.59.F04.1.454.CMB.1.raw
  modified_base (252)..(252): a, c, t, g, unknown or other
  misc_feature (252)..(252): n is a, c, g, or t
  modified_base (267)..(267): a, c, t, g, unknown or other
  misc_feature (267)..(267): n is a, c, g, or t
  modified_base (297)..(297): a, c, t, g, unknown or other
  misc_feature (297)..(297): n is a, c, g, or t
  modified_base (440)..(440): a, c, t, g, unknown or other
  misc_feature (440)..(440): n is a, c, g, or t
tcagtacgagtatgcacgaccggtgctcgatttagtacacacacttagggattggggggggtctcaggaggcagcgctctcgggacgtctccaccatggcctggctctgctattcctcaccctcctcactcagggcacagggtcctgggcccagtctgccctgactcagcctgcctccgtgtctgggtctccgtggactagtcgatcaccatctcctgcactagaaccagcagtgacgttggtgttatactntgtctctggtaccancgcaccagacaacgccccaatcatgattangatcgtcaactaactccggaccctagtacggtttactaactcgtcttcctcgtggactaccgtacgtcgtcggaccacgtaccgtccctccgtacgacctagtccgtacgtccggtaccaccggaggtccgtaggacggacgngtacgtagtattacgtacgtcgacgacgtacctatacgtataaccacgctaacacgtctaccgtactacgtacgttcgtacgtacgtacggacgtaacgtaaccggtcctacgtcgtacggtcaccgacccgacgaccccacgtaccg

SEQ ID NO: 198482 - DNA, 541 bp, Homo sapiens
  misc_feature: GYAE6OF01AXDD6.18.59.F04.1.454.CMB.1.raw
  modified_base (229)..(229): a, c, t, g, unknown or other
  misc_feature (229)..(229): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataactatgtctcctggtaccaacagcacccaggcaaacgcccccaaactcatgatttatgatgtcagtaatcggccctcgtaggggtttctaatcgtcttctctggctccaagtctcggcaacgaccggcctcccgtcgaccactcctcgtcgggctccgaggtctgacggacgacggtctgtatttatactgcagctcatactaacagcaccagcactctctatcgttcgttcggaacgtcgggacctaaggtccaccgtcctaggtccacgacccacggcccaacccgtacg

SEQ ID NO: 198483 - DNA, 642 bp, Homo sapiens
  misc_feature: GYAE6OF01AX06W.18.59.F04.1.454.CMB.1.raw
  modified_base (253)..(253): a, c, t, g, unknown or other
  misc_feature (253)..(253): n is a, c, g, or t
  modified_base (354)..(354): a, c, t, g, unknown or other
  misc_feature (354)..(354): n is a, c, g, or t
  modified_base (390)..(390): a, c, t, g, unknown or other
  misc_feature (390)..(390): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttaataactntgtctcctggtaccaacagcaccaggacaaacgcccccaaactccatcgatttatgatcgtacactaactcgccctcgtacgggtttctaactcgtcttcnctgctcaagtcgtcggactaaccgacggccctaccngaccgtatccgtacgtcgggccttccgacgggtctacggaaggacccggagggtccgtacggtaatttaacttaccgtcgacgacgtctactaagtacaactaacgaccgtaaccgacgtactacgtcttactaactcgtttaccgttaccgggtaacgtacgggtaaaccctacgggttccctaacccgggtaccttaacgggtaccctaaccgaccccgtaaacccggaaccccgtaaaccccgtaccgg

SEQ ID NO: 198484 - DNA, 581 bp, Homo sapiens
  misc_feature: GYAE6OF01ECOK8.18.59.F04.1.454.CMB.1.raw
  modified_base (192)..(192): a, c, t, g, unknown or other
  misc_feature (192)..(192): n is a, c, g, or t
  modified_base (549)..(549): a, c, t, g, unknown or other
  misc_feature (549)..(549): n is a, c, g, or t
  modified_base (556)..(557): a, c, t, g, unknown or other
  misc_feature (556)..(557): n is a, c, g, or t
  modified_base (559)..(559): a, c, t, g, unknown or other
  misc_feature (559)..(559): n is a, c, g, or t
  modified_base (561)..(563): a, c, t, g, unknown or other
  misc_feature (561)..(563): n is a, c, g, or t
  modified_base (565)..(565): a, c, t, g, unknown or other
  misc_feature (565)..(565): n is a, c, g, or t
  modified_base (567)..(570): a, c, t, g, unknown or other
  misc_feature (567)..(570): n is a, c, g, or t
  modified_base (572)..(573): a, c, t, g, unknown or other
  misc_feature (572)..(573): n is a, c, g, or t
  modified_base (575)..(581): a, c, t, g, unknown or other
  misc_feature (575)..(581): n is a, c, g, or t
tcagtacgagtatgcacgaccggtgctcgattttagtacacacacttagggagttggggggctttgtctgggtctcctggacagtcgatcaccatcctcctgcactggaaccagcagtgacgttggtggttataactatgtctcctggtaccaacagcacccaggcaaacgcccccaaatcatgtattttangatgtcagtaactcggccctgaggggtttcaatcgcttctctggctcaagtctggacaacacggcctcctgaccatctcgtgggctccaggctggaggacgaggtctagtaatttacgtacgtcggactacggcttaccaagttactacgaagcagccagccacgtacgaagttcgttacggaactcgggaaccaagggtccaccggtacctagggtcaccggaccccgaaacggccccaaaccccctacttcgtaccctaccgtccttacccgtttaccccctaccctcccgtacctactaccgttcgtactcggtacgtcgggtcgtcgggacgacggcgtacgtagtacgtcgngcgcgannancnnncncnnnncnntnnnnnnn

SEQ ID NO: 198485 - DNA, 524 bp, Homo sapiens
  misc_feature: GYAE6OF01ER19E.18.59.F04.1.454.CMB.1.raw
  modified_base (443)..(443): a, c, t, g, unknown or other
  misc_feature (443)..(443): n is a, c, g, or t
  modified_base (512)..(512): a, c, t, g, unknown or other
  misc_feature (512)..(512): n is a, c, g, or t
  modified_base (520)..(524): a, c, t, g, unknown or other
  misc_feature (520)..(524): n is a, c, g, or t
tcagtacgagtatgacacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaatcatgatttatgatgtcactaatcggccctcaggggttttctaatcgcttctctggctccaagtctggcaacaccggccctccctgacccatcctctgggcctccgaggctggaggacgaggctgattattactgcagctcatatacaagcacagcactctctagtgtcttcgaactcgggaaccaggtccaccgtcctaggtcacgcccaagcccaaccccntcgtcactctcgttccccacccttccgtaccacgtacctcgtactggacgcgggctagggctaggccgnaacgtgcnnnnn

SEQ ID NO: 198486 - DNA, 833 bp, Homo sapiens
  misc_feature: GYAE6OF01C6EZI.18.59.F04.1.454.CMB.1.raw
  modified_base (205)..(205): a, c, t, g, unknown or other
  misc_feature (205)..(205): n is a, c, g, or t
  modified_base (369)..(369): a, c, t, g, unknown or other
  misc_feature (369)..(369): n is a, c, g, or t
  modified_base (673)..(673): a, c, t, g, unknown or other
  misc_feature (673)..(673): n is a, c, g, or t
tcagtacgagtatgcacgaccggtgctcgatttagtacacacacttagggattgggggggggtctcaggaggcagcgctctcgggacgtctccacatggcctggctctgctattcctcaccctcctcactcagggcacgagggtcctgggcccagtctcgccctgactcacgcctgccctcgtgtcgtgggtcctccgtaggacngtcgactcacctatcctctgacctacgtacggaaccagcgtagtcggtacgtttgggacgtttaataacgtagtcgtccgtcgtacggtaaccaacgacgaccctaaccgacggaaccaaaacccgaccccctaaaacgttccaacgttacgttaactttacgngtattacggttaacgtaacgttaaccgttccggtaccccgtttagggttaacgggtttacctaagttccgttccgtttccgttacgtacgggtaccttaaccgtaacggttccgacgggtaacctaacccggaccgttcccgtacccgtacgtaacccgttcgttaccgttcggcggtacccctacggaccgggtctaaaggggccgtaaccggacgggttaccttagttaaccgtttaacgttcgggtacgacgtaacggtcctaacgtaactttaacgaacccgaaggtaccgtacgaaccnccgttaaccgaccgtttaccgtaaaccggtttccggtaaaacccgggtcggttacccgggaaaaccccgttacggtacccgttacccggtttaccggacccgtaaacccggtacccggtaccccgtaaacccggacccccttaacccggtcgttacccgg

SEQ ID NO: 198487 - DNA, 692 bp, Homo sapiens
  misc_feature: GYAE6OF01CTZSX.18.59.F04.1.454.CMB.1.raw
  modified_base (308)..(309): a, c, t, g, unknown or other
  misc_feature (308)..(309): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctctggtaccaacagcaccaggcaaacgaccccaaactcatgtatttannatgtacactaactcggccctacgtaggggtttctaacgtcgtcctttctcgtcggtcctacctaacggtccgtacgggacctaaaccgaccggtccctcccgtacgaccctaactccgttcgtcgggtcctaccgaacggcgtggaacgggccggtaaggtccgttacgtatttaacgtttaccgtacggtacagtccttaacctaattaacttaaacgaacgtacctaacccgtaacgtcccttaacttccttaccttagttaccggttacccgtttacgggaaaccggttaccgggtaaaccggttaacccgggttacccgtaccccggtttaccgttaacgggtacctaaccggtaccccgtaaacccgggaaccccccc

SEQ ID NO: 198488 - DNA, 1002 bp, Homo sapiens
  misc_feature: GYAE6OF01C4E7A.18.59.F04.1.454.CMB.1.raw
tcagtacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggtattttccttgctgtcttaatttaaaaggtgtccagtgtgaggtgcagcgtgggtggagtcggtgggggaggtcgttagggtaaacgggtcccgggggggttaccccttaacggacccgttccccgttggtaaccgacggtcccttcgtggtaactttccgtaaccttttacgaaggttaaacggtcccgttagggtaacgttacggtaaacccggtttccgggggtacccccggaccccggtaacggggtcccccgtttaacccggggaaagggggggtaaaccggggggtccggttaggggggttaacgggggtttacggggggttttaaccgggtaaccccggttttaaaaaacgtttaaaaaaacccccgaaaaaccggtttgggtaaacgggttaacggggttaacggggaaaaccgtaaacggtaaaccggtaacccgtttaacccggcccgtttacggaaccccgtaaaccccgggtaaggaaaacgggccgtaaacggtaactttacccgaaacccgtacttaccgtaaccgaaaggtaacgtaacgttaacgtaaaacgttaaaacccaaaaaacggtcctaaaccggtacgtttaacgttaaccgttacgttaacgaacgtaaaagtaacgaaccgtaacgtacccgtaaggaaaccggaacccggagaacccaacgtcggtaccgttagttaacctttaacgtacccgaaacctaacccgtaccgtaaccccgtaaaggaaacgttccccgttaaacctaaaaccctttaccgtaaacccgtttaaccgggtaaccgttaacggtaccccggggttaccccttaaccgggggg

SEQ ID NO: 198489 - DNA, 654 bp, Homo sapiens
  misc_feature: GYAE6OF01CBA8O.18.59.F04.1.454.CMB.1.raw
  modified_base (228)..(228): a, c, t, g, unknown or other
  misc_feature (228)..(228): n is a, c, g, or t
  modified_base (252)..(252): a, c, t, g, unknown or other
  misc_feature (252)..(252): n is a, c, g, or t
  modified_base (643)..(643): a, c, t, g, unknown or other
  misc_feature (643)..(643): n is a, c, g, or t
tcagtacgagtatgcacgaccggtgctcgatttagtacacacacttagggagttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcatcaccatctcctgcactggaaccngcagtgacgttggtgttataactntgtctcctggtaccaacagccaccaggacaacgcccccaaactcatgtactttatcgattgtaccaactaacgtccggtaccctcggtaacggggttttctaacttccgtacctttctacgtcggtcccgttacctaacggttccgtacgggacctaaaccggtcccggtaccccgttccctaccggtaacccaacgtttccgtccgtcgggtcccttaccgacgggtctacgggacgggaaccggtacgggtcgttacgtaacttttacgtaacgtacggtcgtaacgctacctaaatacgaacgtacgacctaacgacgtacctacgtctacttcgtcgtcgtacgaccggtgacccgaagtcctaacgtctacggcacgacccgaacncccaaccctcg

SEQ ID NO: 198490 - DNA, 695 bp, Homo sapiens
  misc_feature: GYAE6OF01C4IOX.18.59.F04.1.454.CMB.1.raw
  modified_base (293)..(293): a, c, t, g, unknown or other
  misc_feature (293)..(293): n is a, c, g, or t
  modified_base (304)..(304): a, c, t, g, unknown or other
  misc_feature (304)..(304): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatctctgcactggaaccagcagtgtacggttggtgttataactatgtctcctggtacaacagcaccagacaaacgccccaancatagtattangatgtctaactaatccgcctcgtagggttactaagtcgcttcgtcgtggtctactaagtctacggcaaccgtacccggtcccttaccccgtcgaaccctacttccgtccggttacgggcccttaccggacggtaccgggtacgggtaacgggaaccgggtaacgggtcgttaacggtttaagttttaaccgtttaacgtaccgtaccacggttaccttaacctaagttaacctaaaccgaaaccgacccgtaaaccacgtaccctaacgttctacggttaccttacggtaccggttaccggaacggtaccggaaccgtaaccgggtaccgtacccggttaccgtacggtacccgtaaccgacccgaaaccggacccctaaccccgtaaccg

SEQ ID NO: 198491 - DNA, 618 bp, Homo sapiens
  misc_feature: GYAE6OF01BEXF0.18.59.F04.1.454.CMB.1.raw
  modified_base (231)..(231): a, c, t, g, unknown or other
  misc_feature (231)..(231): n is a, c, g, or t
  modified_base (306)..(306): a, c, t, g, unknown or other
  misc_feature (306)..(306): n is a, c, g, or t
  modified_base (362)..(362): a, c, t, g, unknown or other
  misc_feature (362)..(362): n is a, c, g, or t
  modified_base (369)..(369): a, c, t, g, unknown or other
  misc_feature (369)..(369): n is a, c, g, or t
  modified_base (480)..(480): a, c, t, g, unknown or other
  misc_feature (480)..(480): n is a, c, g, or t
tcagtacgagtatgcacgaccggtgctcgatttagtacacacacttagggattgggggctggggtctcaggaggcagcgctctcgggacgtctccaccatcgcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataactatgtctcctggtaccaacagcacccaggcaaagcccccaaatcatgatttangatgtcactaatccggccctagtaggggtttctaatcgcttctcgtcgcccagtcnggcaacnccggccctcctcgaccattcctcgtgggcctccgaggctaggacggacgaggctagttacttagttacgtgacctagtcctacaataactaacgtaacgacctaaccgacnccgtaaccttcgtacttagttccgttaccgttaccgggtacgtaccgggtaacccgtaacggttcccgtaacccggtttcccgtaacgggtttccgaaacccggaacccctaacggggtaaccccctaaaccccccgg

SEQ ID NO: 198492 - DNA, 707 bp, Homo sapiens
  misc_feature: GYAE6OF01AJEGN.18.59.F04.1.454.CMB.1.raw
  modified_base (230)..(230): a, c, t, g, unknown or other
  misc_feature (230)..(230): n is a, c, g, or t
  modified_base (275)..(275): a, c, t, g, unknown or other
  misc_feature (275)..(275): n is a, c, g, or t
  modified_base (314)..(314): a, c, t, g, unknown or other
  misc_feature (314)..(314): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtcctccgtggacagtcgatcaccatctcctgcactggaaccngcagtgacggttggtaggttataactatgtctcctggtaccaacngccaccaggaccaaacgcccccaaactcaatgtatttangtatgtacacgtaacgtccggccctcggtacgggtttactaacgtcgtcttctctcggtcctccgtaacgtcgtcggaccaaccgtacccgtccctcccgtcgaccctattcctcggtcgggcctccgacgggtctacgggacggtacgacggtcttacggtatttaactcgtcggccagtccttaagtaacttaacgtaaccgaacgcctaacccgtacgtaccctaccgttaccttaccgttacggttccgttaccggttaaccgggtaaccggttaccggggaaacccgttaacggttacccggtaaccccggttacccggttaaccgggtaacccggtacccggaaaccccggtaacccgggtaacccccgtaaaccccggttaacccg

SEQ ID NO: 198493 - DNA, 719 bp, Homo sapiens
  misc_feature: GYAE6OF01CCWWP.18.59.F04.1.454.CMB.1.raw
  modified_base (575)..(575): a, c, t, g, unknown or other
  misc_feature (575)..(575): n is a, c, g, or t
tcagtacgagtatgcacgaccggtgctcgatttagtacacacacttagggagttggggggggtctcaggaggcagcgctcgtcgggacgtctccaccatcggcctggctctgcttattcctcaccctcctcactcgagggcacgagggtcctcgggcccagtcctcgccctgactcacgtcctcgccctccggtgtcgtcgggtcctccgtaggactaggtccactaccacctactcctccgtcgaccaacgtacggaaaccagtcgtaaggttcgtacggtttggtagttaacttaacgtgtcgttacctacgtacggtaaccaagacgaccaaccgacgaaccaacccgaccccaatcagtatattagctatcactacgtacgtccgtactcggttacgttactacgtctcgttcgtcgtacgtacctacgaagtccgtacggaccaaccgtccgtccctaccgacgaccctgtccgtcggtcggacctcggacggtagtacggaacggacggtacgtcgtaagttacttaacgtcgtagtccaacgttactaacgtaacgttaacaaaccgngaaccctaaccgacgttaccctacgttactaccgttagttcccggtaccgttaacgggaaccggttaccggaacgttacccggtaccgtaacccggtcgttaacgtacccgaaccggaacccaaccggacccctaacggtaccg

SEQ ID NO: 198494 - DNA, 889 bp, Homo sapiens
  misc_feature: GYAE6OF01DPA8P.18.59.F04.1.454.CMB.1.raw
tcagtacgagtatgcacgaccggtgctcgatttagtacacacacttagggattggggtctgggagaggagccccagccttgggattcccaagtgtttcattcagtgatcaggactgaacacagaggactcaccatggagtttggctgagctggtactttcctgctgtcttaagttttaaaggtgtccgagtgtgtaggtgcgtagtcgtggtggtagtcggtggggtaggtcgttacgggtaaacgggtcccggggggttaccttacggtaccttccccgtagtaccgacgtccgtcgtagtacttcctacgtttcgaaggtaacggtccgtaggtacgtacggtaaccgtcggggtaccgaccggtaccggtaccgttaccgggaaagggggtaacggggtcgtacggggtacgggtttacggggttccggtaaacccggtttaaaacgttaaaaacccgtaaaacggttagggttacggttacggggtaacgggtaaaacccgtaaacgtaacggtaacccgtttaacggacccgtttacggtaaaccccggtaacccgggttaaaggtaaaccgggacgttaaacggtacctttaacccgaaccgttaacgtacccgttaacgtaaacggtacgtaacgttaacggtaaaccgttaacgaaaaaccgtcgtaacgtaccttaggtaactacgtacgtaacgtaacgtacgaaccgtcggtaccgtaaggaaccgtaccggtaacgaccgtaacggtcgtaccgttacggttaacttacgacgttaccgaaccgttaccgtacccgtaagtaaacccggtctaaccgttaaactaccgtaacgttaccgtaacggtacgttaccggaccttcgggacgggtaacccg

SEQ ID NO: 198495 - DNA, 712 bp, Homo sapiens
  misc_feature: GYAE6OF01BPS41.18.59.F04.1.454.CMB.1.raw
  modified_base (228)..(228): a, c, t, g, unknown or other
  misc_feature (228)..(228): n is a, c, g, or t
  modified_base (252)..(252): a, c, t, g, unknown or other
  misc_feature (252)..(252): n is a, c, g, or t
  modified_base (308)..(308): a, c, t, g, unknown or other
  misc_feature (308)..(308): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataactntgtctcctggtaccaacacgcacccaggacaaacgcccccaaactcatgtatttangtatgtcactaatcggcctcgtagggttctatcgcttctcgtcgtctccaagtctcggacaaccgaccggtcccttcccgtacgaccctacttccttccggtcgggtcccgttccgacgggtccgttacgggaacgggtaccggacgggtccgttaggtaacttttaacgttaccgttcgacgtacggtaccttacgtaaacgttaacgtaaaccgaagtacccgtaacccgtacgtaccctaccttaccgttaccgttaacgttcgtttaacccggttaccgggtaaacccggttacggggtaacccgttaacgggttccccgtaaccccggtttcccgttaacgggtacccgaacccggtacccccggtaaacccgggtaccccctaaaccccggttacccg

SEQ ID NO: 198496 - DNA, 646 bp, Homo sapiens
  misc_feature: GYAE6OF01BS6T2.18.59.F04.1.454.CMB.1.raw
  modified_base (449)..(449): a, c, t, g, unknown or other
  misc_feature (449)..(449): n is a, c, g, or t
  modified_base (474)..(474): a, c, t, g, unknown or other
  misc_feature (474)..(474): n is a, c, g, or t
  modified_base (492)..(492): a, c, t, g, unknown or other
  misc_feature (492)..(492): n is a, c, g, or t
tcagtacgagtatgcacgaccggtgctcgatttagtacacacacttagggattgggggctgggggtctcaggaggcagcgctctcgggacgtctccaccatggcctgggctctgcttattcctcaccctctcactcgagggcacgagggtcctgggcccagtctcgccctgacctcacgcctgcctccgtgtcgtcgggtctccgtggactagtcgatccacctatcctctgccacgtacggaaccagcaggtggtacggttggttacggttaataacgttatcgttccttaccgtcggtaaccaaccagaccaccgacggaccaaaccggacccccaaactcatggtaatttagtcgtatcgtactaactaacgtccggccctagtacgggtttactaacgtcgtcttctcgtcgtcctactagtctcggaccacgtccgcctaccgngacctatcccgtgtacggtctacgnggtctaggacggtacggngtacttgtaatttacgttgcgctagctactaatacacgaacgacctaacacgtacctctacttactagttcgttaccgtacggtacgttacgggaaccgttacggtaccgtacccgttacggacgttacgaacccgcccgaaccggtaaccccc

SEQ ID NO: 198497 - DNA, 1005 bp, Homo sapiens
  misc_feature: GYAE6OF01BQNFL.18.59.F04.1.454.CMB.1.raw
tcagtacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggtatttccttgctgcttatttaaaggtgtccagtgtgtaggtgcagcgtggtggagtcgtgggggaggcgtttaggggtaaacgggtcccgggggggttacccttacggtacccgttccccgttaggtaaccacggtccctcgtggtactttccgtaacctttttcgtaaggttaaacgggcccgttagggtaacgttacggtaaaaccggttcggggggtacccccggtaccccgtaacgggggtccccgtttaacccccgggaaggggggggtaaaacgggggggtcccggtttaggggggtaacggggttttcgggggggtttcggggtaaccccgggtttaaaaacgttttaaaaaaaaccccggtaaaaaacccggtttagggtaaacggttacggggggttaacgggggtaaacccgaaaaccggtaacgggtaaaacccgttaacccgggtacccgtttacgggaaccccggttaaacccccggggtaacgggtaaaaacgggggaccgtaaacggtaacttttacccgaaacccttaacgttacccgttaacgtaaaacgggaagtaacggttaaggtaaactttaaaaccgaaaaaaacggtccctaaacggtacccttaagggttaaacctttccggtaacgtaacctaaaaggtacgtaaaccgtacggtacccgtaagggaaaccgtaaacccgggaacgaacccgaacggtacggtaccgtagttaaccttaacgtaccgtaaaccctacctacctaccccgtaagaaccgtaccgtaacctaaaccgttaacctacgtaacccgttaaggtacgttcggtcccgttaaccgggg

SEQ ID NO: 198498 - DNA, 562 bp, Homo sapiens
  misc_feature: GYAE6OF01B0RQ4.18.59.F04.1.454.CMB.1.raw
  modified_base (363)..(363): a, c, t, g, unknown or other
  misc_feature (363)..(363): n is a, c, g, or t
  modified_base (434)..(434): a, c, t, g, unknown or other
  misc_feature (434)..(434): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctctggacagtcgatcaccatctcctgcactggaaccagcagtgacgttggtgttataactatgtctcctggtaccaacagcaccaggacaaacgcccccaaactcatgatttatgatgtcactaatcgccctcgtagggtttcaatcgtcttctcgtgctccagtctgacacncgccctcctgacctatctcgtggcctcgacgcgtgaggacgaggtcgtagtatttatacgtcgacagtctnaattatacaacgctaccgatccacttctacctgttcgtaccgttcggaacgtcgggtaaccgtaacggtcctaccccgttaccgtacggtaccgaccgaccccgaaccggtaccccaacccccgtacg

SEQ ID NO: 198499 - DNA, 312 bp, Homo sapiens
  misc_feature: GYAE6OF01EFJVB.18.59.F04.1.454.CMB.1.raw
  modified_base (171)..(171): a, c, t, g, unknown or other
  misc_feature (171)..(171): n is a, c, g, or t
  modified_base (192)..(192): a, c, t, g, unknown or other
  misc_feature (192)..(192): n is a, c, g, or t
  modified_base (248)..(248): a, c, t, g, unknown or other
  misc_feature (248)..(248): n is a, c, g, or t
  modified_base (305)..(305): a, c, t, g, unknown or other
  misc_feature (305)..(305): n is a, c, g, or t
  modified_base (309)..(312): a, c, t, g, unknown or other
  misc_feature (309)..(312): n is a, c, g, or t
tcagtacgagtatgcacgaccggtgctcgatttagtacacacacttagggattggggagagaagacaggattcaggacaatctccagcatggccggcttccctctcctcctcaccctcctcactcactgtgcagggtcctgggcccagtctgtgctgactcagccaccctnagcgtcgtcgggacccccggnaggaggtcaccatctcttgttctggaagcagctccaacatcggatcagcccaagcncgccccctggtcactctcgtcccacctcctcatctctactgagcggctggcaggccnatgnnnn

SEQ ID NO: 198500 - DNA, 621 bp, Homo sapiens
  misc_feature: GYAE6OF01D0ULT.18.59.F04.1.454.CMB.1.raw
  modified_base (247)..(247): a, c, t, g, unknown or other
  misc_feature (247)..(247): n is a, c, g, or t
tcagtacgagtatgcacgaccggtgctcgatttagtacacacacttagggattggggggggtctcaggaggcagcgctctcgggacgtctccaccatggcctggctctgctattcctcaccctctcactcagggcacagggtcctgggcccagtctcgccctgactcagcctgcctcgtgtctgggtctctggacagtcgatcaccattcctcctgcactggaaccagcagtgacgttggtagttanactatgtctctggtacaacagccaccgagaccaacgacccccaactcatgatttatgatgtcactaactccggcctacgtagggtttactaatcgtcttctctggctacaagtcgtacggacaaccgtaccggccctccgtacgacctactctcgtacggccttccgaggtcgtaggacggaacggtagtcgttagtactttacttactcgctacgctcctaataactaacgaacaccgtaccacgacctaacttccgttaacttacgtacgttaccggttacggtaccgttacgggtaaccgtacggtcccgtaacccgttacgttaccggtaccaaccggacccggtaaacccgtcccaaaccccgttaccg

SEQ ID NO: 198501 - DNA, 667 bp, Homo sapiens
  misc_feature: GYAE6OF01BMEF2.18.59.F04.1.454.CMB.1.raw
  modified_base (215)..(215): a, c, t, g, unknown or other
  misc_feature (215)..(215): n is a, c, g, or t
  modified_base (229)..(229): a, c, t, g, unknown or other
  misc_feature (229)..(229): n is a, c, g, or t
  modified_base (258)..(258): a, c, t, g, unknown or other
  misc_feature (258)..(258): n is a, c, g, or t
  modified_base (397)..(397): a, c, t, g, unknown or other
  misc_feature (397)..(397): n is a, c, g, or t
  modified_base (405)..(405): a, c, t, g, unknown or other
  misc_feature (405)..(405): n is a, c, g, or t
  modified_base (451)..(451): a, c, t, g, unknown or other
  misc_feature (451)..(451): n is a, c, g, or t
  modified_base (481)..(481): a, c, t, g, unknown or other
  misc_feature (481)..(481): n is a, c, g, or t
  modified_base (531)..(531): a, c, t, g, unknown or other
  misc_feature (531)..(531): n is a, c, g, or t
  modified_base (538)..(538): a, c, t, g, unknown or other
  misc_feature (538)..(538): n is a, c, g, or t
  modified_base (558)..(558): a, c, t, g, unknown or other
  misc_feature (558)..(558): n is a, c, g, or t
  modified_base (565)..(565): a, c, t, g, unknown or other
  misc_feature (565)..(565): n is a, c, g, or t
  modified_base (595)..(595): a, c, t, g, unknown or other
  misc_feature (595)..(595): n is a, c, g, or t
tcagtacgagtatgcacgaccggtgctcgatttagtacacacacttaggggattgggggctttgcctgggtgctgttggtaccaggagacatagttataaccacaacgtctaccaccactggcctcgggcgtctcgctacttcctcctccctccctcacctccgagggcacgtacggttccgacgggcccgacggtcttccgccctacgactccncgccgtccgtcccnccgtcgttcgtcgggtctaccgtcgacgngtcgtactccacctatcctcctagccacgacggaaccaggcagtcggtcggttaggtacggttaactaacgtagttcgtcgtcgttaccgaccgtaacaggcccaacggaccgtacaaaaccgtaccccaactgattanatttacgntatcgtacagtacctcggacctcggtaagggttccagtccgtcgtntccgtgtacgcctagttcgactaccgaacnccgaccttccgccacgtacctactcggtcgacgtcgagtccgtaacgggnggtacgnggtacttgtagtcgttaacncgttacnggttaccatacgtacacgacaactgaaccnccgtaacttcaattttccgaacgttccgtagggaacttaacgcccgggtaataccggttacccgtcggaacg

SEQ ID NO: 198502 - DNA, 676 bp, Homo sapiens
  misc_feature: GYAE6OF01CO117.18.59.F04.1.454.CMB.1.raw
  modified_base (210)..(210): a, c, t, g, unknown or other
  misc_feature (210)..(210): n is a, c, g, or t
  modified_base (215)..(215): a, c, t, g, unknown or other
  misc_feature (215)..(215): n is a, c, g, or t
  modified_base (218)..(218): a, c, t, g, unknown or other
  misc_feature (218)..(218): n is a, c, g, or t
  modified_base (226)..(226): a, c, t, g, unknown or other
  misc_feature (226)..(226): n is a, c, g, or t
  modified_base (272)..(272): a, c, t, g, unknown or other
  misc_feature (272)..(272): n is a, c, g, or t
  modified_base (312)..(312): a, c, t, g, unknown or other
  misc_feature (312)..(312): n is a, c, g, or t
tcagtacgagtatgcacgaccggtgctcgatttagtacacacacttagggattggggggggtctcaggaggcagcgctctcgggacgtctccaccatggcctggctctgctattcctcaccctcctcactcagggcacgagggtcctggcccagtctgccctgactcagcctgcctccgtgtctgggtctcctggacagtcgatcaaccntctcngcncgtgaacngcagtgacgttggtagttataactgtcgtcctccgtgtaaccaacngaccaccgaggaccaaaccgccccaaatcatcgtaattangaactgtacctaactaacgtcccggtacccttacggtagggttttacctaacgttcgtcctttacgtcggttcggtacctaccggtaacgttcgtacggaaccctaaaccggcccggtcccctacgttaccgtaccgtacttccgtccgtcggaccttccggaagtccgtaaggacggtacggagtcgttagtattaccgtagtcgtaacgtctacgtacaattaaccgtaacggaacctcctaaccgtactactacccttagttccttaagttacgtaccgttacggtaacggttacggaacgttacgtacccgtcggttaccaggttaacccacgaacccgtaacccgacccaaccgtcccg

SEQ ID NO: 198503 - DNA, 894 bp, Homo sapiens
  misc_feature: GYAE6OF01EJ6X4.18.59.F04.1.454.CMB.1.raw
tcagtacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggtattttccttgctgacttaatttaaaggtgtacctagtgtgaggtgcaggtcgtgggtgggagtcggtgggggacggtcgttaggggtaaacggggtcccgggggggttacccttaacggtaccccgttcccccgttaggttaccgacggtccccgttcgttacgggttactttccgttaaccgttttaccgaaacgggttaaacggtccgtaggtaacgtacggtaaccggttcggggtccccggaccggtacggtacccgtaccggggaacgggggtaacggggtcggtaggggtacggggttcggggttacggtaacccgtttaaaacgttaaaaaccgtaaacgtggtaacggtagggtaacgggtaaaccaaacggtaaccggtaacgtacccggtcgtaccgacccgtaacccgggtaggaaaacggtccgtaagtaccttaacccaaccgtaacttaccgtaacgaaagtaagtaacgtaacgtaaacgttaaacgaaaaaccgtcgaacgtaccgtagttaactacgtagaaactaacgaacggaaacctcggtaacgaggtaaacccggaaccgtacggaaccttaaccggacgttacccgtaagttaacccgttacgttacccaaacgtacccgtacccgtaacccggtagtaacccgacgttaaaccccaaagtttaaccccgtacgttaaacgttaccgggtaatccccgggtagtacccgggg

SEQ ID NO: 198504 - DNA, 572 bp, Homo sapiens
  misc_feature: GYAE6OF01AOBJ1.18.59.F04.1.454.CMB.1.raw
  modified_base (274)..(274): a, c, t, g, unknown or other
  misc_feature (274)..(274): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacngcacccaggcaaacgcccccaaactcatgatttatgatgtcactaatcggccctcgtaggggtttctaatcgcttctctggtctccaagtctggcaacacggcctcctgacctatctcgtcgggctccgacggctgacggacgacggcgtgtatttagtactgcgagctactaattacgtacaagtccaaccgtacgacctaacgttctcttaacgttgtaccgtttcggaacgttcgggaacctaacgggtccacccggtaccgttacggtacccacgaccccgtaacgggaccccc

SEQ ID NO: 198505 - DNA, 804 bp, Homo sapiens
  misc_feature: GYAE6OF01CO7DF.18.59.F04.1.454.CMB.1.raw
  modified_base (725)..(725): a, c, t, g, unknown or other
  misc_feature (725)..(725): n is a, c, g, or t
tcagtacgagtatgcacgaccggtgctcgatttagtacacacacttagggattgggggctttgtctgggtctcctggacagtcgatcaccatctcctgcactggaaccagcagtgacgttggtggttataactatgtctcctggtaccaacagcaccaggcaaacgccccaaactcatgatttatgatgtcactaatccggccctcgtaggggtttctaatcgcttctcgtggcctacaagtcgtggacaacgaccggcctcctagacctattcctcgtgggcctaccgaggtcctaggaacggacggtaggtaccgtaggtaacttttacgttaaccgttcgacctaacggttccttacgtaaatttaaccgtaaaccgaaacgtacccgtaaccgaacgtacctaaccgttccttaccgtaacgtttaccggttaccgttaaccgggtaaaccgttcgggggaaaccctaaacggggttcccgtaacccggtttaccgtaacggttacccgaaacccggaaccccgtaaaccggacccccttaaaccccgtacgttacggttacccctaacccgttttcccggtaaccccggtttacccccgacccctttacccgtaccgttaaaccgttacccgtttaaccgggtaacccgttacgggaaccggtttacccgggggacttaacccggggaacgaacccggggtcctaacggtaaacgtcggntcgacgtacgacgtcgacgtcacctcgtacgtacgacgtcgtacgtacgtacgtacgtacgtacgtacgtcgtcgtacg

SEQ ID NO: 198506 - DNA, 585 bp, Homo sapiens
  misc_feature: GYAE6OF01EJ88Z.18.59.F04.1.454.CMB.1.raw
  modified_base (248)..(248): a, c, t, g, unknown or other
  misc_feature (248)..(248): n is a, c, g, or t
  modified_base (253)..(253): a, c, t, g, unknown or other
  misc_feature (253)..(253): n is a, c, g, or t
  modified_base (308)..(308): a, c, t, g, unknown or other
  misc_feature (308)..(308): n is a, c, g, or t
  modified_base (465)..(465): a, c, t, g, unknown or other
  misc_feature (465)..(465): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtagttanaactntgtctcctggtaccaacagccaccaggacaaacgcccccaaaactcatgatttangatgtcactaatcgccctgagggtttctaatcgcttctcgtggctccaagtctaggccaacgaccggccctccctgacctatctacgtcggcctccgaggtctggaggacgaggctagtattatactgactacgctacataactaacaacgcaaccngacctactcttactatacgttccgttaccgggtaacgtacggggtaaccctaagggttcccaacccggttcccgtaacggttccaaaccggaccccgaaacggcccccaaaccccgtacg

SEQ ID NO: 198507 - DNA, 760 bp, Homo sapiens
  misc_feature: GYAE6OF01EM5C3.18.59.F04.1.454.CMB.1.raw
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctcgccctgactcagcctgcctccgtgtcgtgggtctcctggacagtcgatcaccatcctcctgcacgtggaaccagacagttcggtacggttgggttaggtttaactaactagttgtccttaccgtacggtaaccacacgaccacccgacgaccgaaacccgacccccaaatctatcgtaatttacgtaggacttacgtactaactaacgtcccggtccgttacggtacgggtttactaacgtcgttacttcgtacgtcggtcctacgtacgtacgtcggaacccaacgacccgtccctacccgtacgaaccctagttacccgtccggttacgggtcccaccgtacgggtcgtaccggggtaagggaccggttagggacctttacgttaaacttttcgtttaacgacgttacccgtacgttcttaaccgtaataaccgtaacggaacctccggaaacctaccgtacctacttacccttactaaagtttcccgtaacgggttacccgtaacgggtaacggtaaccgggtaaccgttacccgaacccgttacgggtaccgtacccgacccggaaccccgacccggtaaccccaaccccggttac

SEQ ID NO: 198508 - DNA, 783 bp, Homo sapiens
  misc_feature: GYAE6OF01ER6VB.18.59.F04.1.454.CMB.1.raw
tcagtacgagtatgcacgaccggtgctcgatttagtacacacacttagggattggggggggtctcaggaggcagcgctctcgggacgtctccaccatggcctgggctctgctattcctcaccctcctcactcagggcacgagggtcctgggcccagtctcgccctgactcagcctgcctccgtgtcgtggtctccgtggacagtcgactcacctatcctcctgccacgtacggaacctagccgtaggttcggtacggtttgggttagtttaacttaaactagttcgttaccgtccgtacggtaacccaacgacgaccaccgacggaaccaaaccgaccccaaaacgtctaactagttaattttagacgtattcggtacctaacgtaaccgttcccgggtacccgttcgttaacggggttttactaaccgttccgttacctttccgttccggtacgtacccgttaccgtaacggtccgttacggacctaaacccgggtcccgtccccgttaccgtaccgtaacccgtacgttccgtttaccggacgggttcccctacggtacgtacggtacgggtacggacggtacgtccgttacgtttaacgttacttacgtacggcctacgtaccttacgtaacgttaactaacgaacccgtacctaaccgtactaccgactttaccgttaactagttccgttaccttacgggaacgttacggtaaccgtacggtcccgtaccggtacgtacccggacctaacggacccctaacgacccctaacccgtaccg

SEQ ID NO: 198509 - DNA, 612 bp, Homo sapiens
  misc_feature: GYAE6OF01E0CWY.18.59.F04.1.454.CMB.1.raw
  modified_base (302)..(302): a, c, t, g, unknown or other
  misc_feature (302)..(302): n is a, c, g, or t
  modified_base (310)..(310): a, c, t, g, unknown or other
  misc_feature (310)..(310): n is a, c, g, or t
  modified_base (342)..(342): a, c, t, g, unknown or other
  misc_feature (342)..(342): n is a, c, g, or t
  modified_base (606)..(606): a, c, t, g, unknown or other
  misc_feature (606)..(606): n is a, c, g, or t
  modified_base (610)..(610): a, c, t, g, unknown or other
  misc_feature (610)..(610): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgcccccaaatcatgatttatgatgtcactaatcggcctcgaggggtttctaatcgcttctctggctccaagtctggacaacacggcctccngaccatcnctcggctccagctgagacgagctgattatacngacagctacatataacaagcaaccagctactcttactatcgtcgttacggaacgtgggaaccaagtccgtaccgtccgtaggtccaacgtaccccaacggaccccaaccccgtagtccgtacctaaccgttcccgttacccggtttcccccgaccccgtttaccccttaaccctacgttaaccccttacgggtaaccgttcgggaaacggtcccggggtactaggggacccgaaaacggggcccgtaagaaaccgttacgcgancgtngc

SEQ ID NO: 198510 - DNA, 674 bp, Homo sapiens
  misc_feature: GYAE6OF01CABLJ.18.59.F04.1.454.CMB.1.raw
  modified_base (228)..(228): a, c, t, g, unknown or other
  misc_feature (228)..(228): n is a, c, g, or t
  modified_base (253)..(253): a, c, t, g, unknown or other
  misc_feature (253)..(253): n is a, c, g, or t
  modified_base (309)..(309): a, c, t, g, unknown or other
  misc_feature (309)..(309): n is a, c, g, or t
tcagtacgagtatgcacgaccggtgctcgatttagtacacacacttagggattggggggggtctcaggaggcagcgctctcgggacgtctccaccatggcctggctctgctattcctcaccctctcactcagggcacagggtcctgggcccagtctgccctgactcagcctgcctccgtgtctgggtctcctggacagtcgatcaccatcctcctgcacgtggaaccngcagtgacgttggtagttataactntgtctcctggtaccaacacgcaccgaggacaaacgcccccaaactcatgtatttangatgtactaactaacgtccggccctagtacgggtttactaacgtcgtccttctcgtcggtcctaccgtaacgtcgtacgacctaaccgacccggtccctacccgtacgacctacttccgtacggtcgggcctaccgaggtcgtaggaacgggacgtaggtccgttagtaacgttttaactacgtgccgtacgtctacaattaacgtaacgtaacgcgtaacgacgtacggtaacctacgttaccgtaaaccggttacgtaccgggtaaacgtacccgggaaccgtaacggttacccgtaacccgttaccggtacgggtaccaacccggtaacccgaaaccggtaccccaacccgtaccgtaccgg

SEQ ID NO: 198511 - DNA, 595 bp, Homo sapiens
  misc_feature: GYAE6OF01AZAFV.18.59.F04.1.454.CMB.1.raw
  modified_base (228)..(228): a, c, t, g, unknown or other
  misc_feature (228)..(228): n is a, c, g, or t
  modified_base (312)..(312): a, c, t, g, unknown or other
  misc_feature (312)..(312): n is a, c, g, or t
  modified_base (372)..(372): a, c, t, g, unknown or other
  misc_feature (372)..(372): n is a, c, g, or t
  modified_base (398)..(398): a, c, t, g, unknown or other
  misc_feature (398)..(398): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataactatgtctcctggtaccaacagccacccgaggaccaaacgccccccaaaactcatgtatttangatgtacactaactccggccctacgtaggggtttctaactcgtcttctctgctcaagtcnggcacgcgcctcctagcctatctcgnggtcctcgacggtctaggacgggacgaggtctagtatttatacgtcgcctagtcctatgactagtgtacggtctggtaggttggttacgtagttcgttccgttcggtagttccggtacgggtaccgtaacggttcccgtacccggttaccgtaacggtaccgaaccgaccccgaaacggccccctaaccccgttccg

SEQ ID NO: 198512 - DNA, 783 bp, Homo sapiens
  misc_feature: GYAE6OF01CZ3L9.18.59.F04.1.454.CMB.1.raw
  modified_base (523)..(523): a, c, t, g, unknown or other
  misc_feature (523)..(523): n is a, c, g, or t
  modified_base (764)..(764): a, c, t, g, unknown or other
  misc_feature (764)..(764): n is a, c, g, or t
  modified_base (775)..(775): a, c, t, g, unknown or other
  misc_feature (775)..(775): n is a, c, g, or t
  modified_base (777)..(777): a, c, t, g, unknown or other
  misc_feature (777)..(777): n is a, c, g, or t
  modified_base (779)..(779): a, c, t, g, unknown or other
  misc_feature (779)..(779): n is a, c, g, or t
  modified_base (781)..(783): a, c, t, g, unknown or other
  misc_feature (781)..(783): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactaggaaccagcagtgtacggttggtaggtttataactatcgtcctccgtacggtaacccaacacgaccaacccgaacggaccaaaccgaccccccaaaatcaagtagttatttagagtatcgtactaagttaacgtcccggtacccgttacggttaacggggttttactaacgttccgtcctttcgttccgtacggtacctaccgtaacgttccgtacggacccgaaccgacccggttcccctacccgtaccgacctacttccgtaccggtcgggtcctccgagggtcgacgggacggacggtcggtacgttagttaacttacgttacgtcgacctacgtaccttaactaattaacgaacgacgtacgacgaccganacccgtaacgtacgttaaacggttccggttaaccgggaacggtaccgggtaaccgtaccgtcccgtaaccccgggttagaccgtaacccgaaccggaaccccgtaacccgacccccttaaccgtcgtacctacccggttacctttacccgttcccccctaacccctccccttacccgaccttaacgttcccaaccggttcggaaccgggtccggtaccgggacgtcggggaacgaccgttnaccgttagacnanancnnn

SEQ ID NO: 198513 - DNA, 656 bp, Homo sapiens
  misc_feature: GYAE6OF01DR0GW.18.59.F04.1.454.CMB.1.raw
  modified_base (201)..(201): a, c, t, g, unknown or other
  misc_feature (201)..(201): n is a, c, g, or t
  modified_base (260)..(260): a, c, t, g, unknown or other
  misc_feature (260)..(260): n is a, c, g, or t
  modified_base (323)..(323): a, c, t, g, unknown or other
  misc_feature (323)..(323): n is a, c, g, or t
  modified_base (548)..(548): a, c, t, g, unknown or other
  misc_feature (548)..(548): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacngtcgatcaccatcctcctgacacgtcggaaccagcagtgtacgttggtagttataactntcgtctccgtggtaaccaacacgccaaccaggacaaaccgaccccaaatctaatcgactttanagtatcgtacaacgtaacgtccggtcccttacggtacgggttttactaatccgttcttcgtcgtcggtacctacgaacgttcgtacggtacaaaccgccggtccctaccgtcgaccacttaccgtcgtcgggtcctacgaggtcgtagggaacggacggtcggacgttagtaactttagtactagacgtacgtactacgtaataacgtaacacgctaacgctaanacctagtacgacgttacgttaccggaaacggtacgggtaacccagggttaccctacccggtacgttacggacgaccgtaccgaaacccggtcccaaaaccgtgtaccg

SEQ ID NO: 198514 - DNA, 778 bp, Homo sapiens
  misc_feature: GYAE6OF01CJLFT.18.59.F04.1.454.CMB.1.raw
  modified_base (227)..(227): a, c, t, g, unknown or other
  misc_feature (227)..(227): n is a, c, g, or t
  modified_base (770)..(770): a, c, t, g, unknown or other
  misc_feature (770)..(770): n is a, c, g, or t
  modified_base (775)..(775): a, c, t, g, unknown or other
  misc_feature (775)..(775): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcacatctcctgcactggaaccagcagtgacgtggtgttataactatgtctcctggtaccaacagcaccgaggcaaacgccccaaactcatgattangatgtacactactcggcctacgtacggggtttactaactcgtccttcgtcgttggcctacctaagtccgtaggaccaaccgaccggtcccttcccgacgacctatcctcgtcggcctccgaggcctagggacggacgaggtctaggtaacttatacgtgactacgtctacgtaacttaacgaacgaaacgtaccaaccgaacgtacctaacctttccggtaacttaacggttccgtttaaccggttaccgggtaaacccggtcccgggttaaaccgtaacgggtacccgtaacccggttacccgtaacgggttaacccaacccgggtacccccgtaaaccgggtaaccccccctaaacccgttaccgtaccggtttcccccgtaaacccttttcccccggttaccccggttaccccccctacccccgtttaacccgtaccccttaaactttacccggtaaccgttaaccggtccggggtaacggccccgggttaccggtagggaccccgttaagggccgacccgtaagttaaccggctaacgngtagntac

SEQ ID NO: 198515 - DNA, 1011 bp, Homo sapiens
  misc_feature: GYAE6OF01C3Q3I.18.59.F04.1.454.CMB.1.raw
tcagtacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggtattttccttgctgtcttaattttaaaggtgtcagtgtgaggtgcagcgtgggtggagtcggtgggggaggtcgttagggtaaacgggccggggggtcccttaggcctccccgtgtacacgtccttcgtggtacttctactttacaaggtaacggcctaggtataggtaaccgtcgggtcccgccgacggcctaccggaagggggacggggtcgtaggggagggttcggggttacggtaccgtttaaaacgttaaaaaacccgtaaaacgttacggtaaggtacggggtaacgggaaacctaaacgtaacggtaaccgtaaccggtaccgttacggtacccggtaaaccccgggtaaggtaaaaccgggaccgtaaacggtaacctttaccccgaaacccgtaacgtttaccgtaaaccggtaaaaggtacggtaaaacgtttaacggtaaaacgtttaaaacccggaaaaaaaccggttcccggtaaaacccggttaccgtttaacggtttaaacgttacccccgggtttaaaggaaaacccgttaaaaacggttaaaccggaaacccgttaaccgggtaacccggtttaaaacggggaaaaccccgggaaaccccggggtaaaaccggggtaaccgaaaccccgggtaaacggtttaaccccgggtttagggtttaaaacccttttaccggtaaaacccggttaaccccgtaaacccgttacccggtttaaacccccgtaacgggtaaaaccggttacccgttaaacccccttaaaaccggttaaaccctttaacccggttaaaccgtttaaccggggttaaccttccggggttaacccttacccgggggg

SEQ ID NO: 198516 - DNA, 636 bp, Homo sapiens
  misc_feature: GYAE6OF01AKFCP.18.59.F04.1.454.CMB.1.raw
  modified_base (231)..(231): a, c, t, g, unknown or other
  misc_feature (231)..(231): n is a, c, g, or t
  modified_base (315)..(315): a, c, t, g, unknown or other
  misc_feature (315)..(315): n is a, c, g, or t
  modified_base (375)..(375): a, c, t, g, unknown or other
  misc_feature (375)..(375): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtagttatactatgtctcctggtaccaacagccacccgaggaccaaaccgacccccaaactcatgtatttangatgtacagtacgtccggtccctgtacgggttactaagtcgtctctcgtggctcgagtcnggacacgaccgtcctccctcgacctactctcgtcgggtacctccgacggtcgtaggaacgggacgagggtccgttgtaagtttacttacgtcgacctacgtcctaacgtaactaactaacgaacgacgaacgtactacgactaaccgtactaaccggtaccgttaaccggtaaccggtaacgggtaaccgtaaccgggttaccctacccggttaaccggtacggtacacccggtaccccgaaacgtcccccgtaaaccccg

SEQ ID NO: 198517 - DNA, 755 bp, Homo sapiens
  misc_feature: GYAE6OF01BSYO1.18.59.F04.1.454.CMB.1.raw
  modified_base (200)..(200): a, c, t, g, unknown or other
  misc_feature (200)..(200): n is a, c, g, or t
  modified_base (233)..(233): a, c, t, g, unknown or other
  misc_feature (233)..(233): n is a, c, g, or t
  modified_base (258)..(258): a, c, t, g, unknown or other
  misc_feature (258)..(258): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctcgccctgactcagcctgcctccgtgtctgggtctcctggacngtcgatcaccatcctcctgccacgtcggaaccngcagtgacgttggtagttataactntgtctcctggtaccaacagccaccgaggacaaacgcccccaaatcattgactttagtgtattgtactaacttaacgtccgggtcccttacggtacggggttttacctaacgttccgtactttccgtcgttcgggtacccttacccgtaacggtttccgtacggacctaaaccgcccggtcccctacccgtacgaacctacgtccgttcggtacgggcctaccgagggtcgttacgggaacgggtacggtacgggtacccttaaggtaacttttaacgttaccgtacggtacctaaccggtccttacgtaaattaaccgtaacgaaacgtccgaacgtaccgacgtaccctaaccgtcgtaaaccggttccggtaaccgggtaaaccggtacggggaaccccgttaaagggttccccttaaacccgggtcccgttaacgggtaccccgtaacggaccccccgaaaccggtaccccctaaaccccgtcgttaaccccgg

SEQ ID NO: 198518 - DNA, 629 bp, Homo sapiens
  misc_feature: GYAE6OF01CQBN5.18.59.F04.1.454.CMB.1.raw
  modified_base (494)..(494): a, c, t, g, unknown or other
  misc_feature (494)..(494): n is a, c, g, or t
tcagtacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcgttgggtaaaggccgggggggtcccttaggacctcccctgtacagcctctggattcactttcagtaaggcctggatgaactgggtccgccaggctccgaggggaggggctggaggtgggtggccgtaattaaaaccaaaactgatggtagggacaaacagactacgctgaccgacccggtagaaacggcaagactttaccaaccatcctacaaacggagtaatagaattaaccaaaaaagccaacgtctagtatctagaccaaaatgaaacncgacctagaacgaaaccgaggaaccacgaggcccttagttaacttacgtacgtaacccacgtactccccgtaaggaaactccgtaactaactacctaactacgttacggactcggaccctcggtcggggaacccg

SEQ ID NO: 198519 - DNA, 701 bp, Homo sapiens
  misc_feature: GYAE6OF01DLOA6.18.59.F04.1.454.CMB.1.raw
  modified_base (213)..(213): a, c, t, g, unknown or other
  misc_feature (213)..(213): n is a, c, g, or t
  modified_base (482)..(482): a, c, t, g, unknown or other
  misc_feature (482)..(482): n is a, c, g, or t
  modified_base (558)..(558): a, c, t, g, unknown or other
  misc_feature (558)..(558): n is a, c, g, or t
tcagtacgagtatgcacgaccggtgctcgatttagtacacacacttagggagttggggggggtctcaggaggcagcgctctcgggacgtctccaccatggcctgggctctgctattcctcaccctcctcactcagggcacgagggtcctgggcccagtctcgccctgactcagcctgcctcgtgtctggtctcctggacagtcgatccacctnttccgtcctgcctacgtacggaacctagactaggtcggtaggtttggtagttaactaacgtagttcgttcctccgttacggtaacccaacgacggaccaacccgaaggaaccaaaaccggaccccccctaaactctatacgtaatttacgtagtatcgtactaacgtaacgtccgtccctacggttacgggtttactaacgtcgtctttccgtcgtacggtctaccgtaagtccgtacggacctaacgtcccggtacctacccggttanaaccctcgttccgtcggtacggtccctaccgaggtaccgtgaacgggtacggacgtgtagttacttagtttaccgngtacctcggtacctagtacttaacgaacaccaccgacttcgacctaccgttcttcttacgtcgttaccggtaacggaccggtacgaacgtacggtaccctaccgggtctacggtaccacgaccctaccgaccctacccgtacg

SEQ ID NO: 198520 - DNA, 528 bp, Homo sapiens
  misc_feature: GYAE6OF01B4MJG.18.59.F04.1.454.CMB.1.raw
  modified_base (188)..(188): a, c, t, g, unknown or other
  misc_feature (188)..(188): n is a, c, g, or t
  modified_base (248)..(248): a, c, t, g, unknown or other
  misc_feature (248)..(248): n is a, c, g, or t
  modified_base (261)..(261): a, c, t, g, unknown or other
  misc_feature (261)..(261): n is a, c, g, or t
  modified_base (288)..(288): a, c, t, g, unknown or other
  misc_feature (288)..(288): n is a, c, g, or t
  modified_base (452)..(452): a, c, t, g, unknown or other
  misc_feature (452)..(452): n is a, c, g, or t
  modified_base (495)..(495): a, c, t, g, unknown or other
  misc_feature (495)..(495): n is a, c, g, or t
  modified_base (500)..(500): a, c, t, g, unknown or other
  misc_feature (500)..(500): n is a, c, g, or t
  modified_base (502)..(502): a, c, t, g, unknown or other
  misc_feature (502)..(502): n is a, c, g, or t
  modified_base (504)..(505): a, c, t, g, unknown or other
  misc_feature (504)..(505): n is a, c, g, or t
  modified_base (507)..(507): a, c, t, g, unknown or other
  misc_feature (507)..(507): n is a, c, g, or t
  modified_base (509)..(509): a, c, t, g, unknown or other
  misc_feature (509)..(509): n is a, c, g, or t
  modified_base (511)..(511): a, c, t, g, unknown or other
  misc_feature (511)..(511): n is a, c, g, or t
  modified_base (513)..(513): a, c, t, g, unknown or other
  misc_feature (513)..(513): n is a, c, g, or t
  modified_base (515)..(521): a, c, t, g, unknown or other
  misc_feature (515)..(521): n is a, c, g, or t
  modified_base (523)..(528): a, c, t, g, unknown or other
  misc_feature (523)..(528): n is a, c, g, or t
tcagtacgagtatgcacgaccggtgctcgatttagtacacacacttagggattgggggctttgtctaggtctcctggacagtcgatcaccatctcctgcactggaaccagcagtgacgttggtggttataactatgtctcctggtaccaacagcacccaggcaaacgccccccaaactcatgatttangatgtcagtaatcggccctcgaggggtttctaatcgcttctcgtgctcagtctggcaacncgcctcctgaccntctcgtgggctccgaggctgaggacgngctgattatactgcagctacatatacaagcagcagcactacaagtcttacggaacgtcgggaacaacggtccaaccgttctacgggcacgaccccgaacggccccaacccactcgtacctaccgtcctttccgtcccccaccctcctcctactacctccgtacnggacggcggtcgtcggacgtaaccgggccgagtaactaggctnactcncncnncncncncncnnnnnnncnnnnnn

SEQ ID NO: 198521 - DNA, 570 bp, Homo sapiens
  misc_feature: GYAE6OF01APAK1.18.59.F04.1.454.CMB.1.raw
  modified_base (228)..(228): a, c, t, g, unknown or other
  misc_feature (228)..(228): n is a, c, g, or t
  modified_base (421)..(421): a, c, t, g, unknown or other
  misc_feature (421)..(421): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataatatgtctcctggtaccaacagcaccaggacaaacgcccccaaactcatgattatgatgtcactaactccggccctctaggggtttctaatcgtcttctctcggctccaagtctggcaacgaccgggccctccctcgacccatccgtcgtcgggctccgaggctggaggacgnggcctagtatttacgttactggccaggtcctctaataactaacaacgcctaaccagccactctcttagtcgttcttcggaacgtcgggtaccaagggtccacccgttccgtacgtacaccgaccccgaacggcccccaaaccctaccgg

SEQ ID NO: 198522 - DNA, 606 bp, Homo sapiens
  misc_feature: GYAE6OF01BVGFY.18.59.F04.1.454.CMB.1.raw
  modified_base (228)..(228): a, c, t, g, unknown or other
  misc_feature (228)..(228): n is a, c, g, or t
  modified_base (252)..(252): a, c, t, g, unknown or other
  misc_feature (252)..(252): n is a, c, g, or t
  modified_base (364)..(364): a, c, t, g, unknown or other
  misc_feature (364)..(364): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataactntgtctctgtaccaacagcaccagacaaacgcccccaactcatgtatttatgatgtacactaactcgccctcgtagggttactaatcgtcttctctggctctagtctgcaacncgccctctcgcatctcgtggcctcgaggtctggaggacggagtcgtagtacttacgttcgtacgtcgagtctacgaattactaaccgtacgacaccacgtacctacttaccgtacttacgttcgttaccgttaccgggaaccggttaccgggtaacccgtaacggttcccgaaccccggtttaccgtaccgggttaccaaccgggtaccccgaaacggtaccccgtaaacccccgtaacccg

SEQ ID NO: 198523 - DNA, 662 bp, Homo sapiens
  misc_feature: GYAE6OF01C68KL.18.59.F04.1.454.CMB.1.raw
  modified_base (172)..(172): a, c, t, g, unknown or other
  misc_feature (172)..(172): n is a, c, g, or t
  modified_base (461)..(461): a, c, t, g, unknown or other
  misc_feature (461)..(461): n is a, c, g, or t
  modified_base (479)..(479): a, c, t, g, unknown or other
  misc_feature (479)..(479): n is a, c, g, or t
  modified_base (485)..(485): a, c, t, g, unknown or other
  misc_feature (485)..(485): n is a, c, g, or t
  modified_base (513)..(513): a, c, t, g, unknown or other
  misc_feature (513)..(513): n is a, c, g, or t
tcagtacgagtatgcacgaccggtgctcgatttagtacacacacttagggagttgggggggggtctcaggaggcagcgctctcgggacgtctccaccatggcctgggctctgctattcctcaccctcctcactcagggcacgagggtcctgggcccagtctcgccctgactnagcctgcctcgtgtctgggtctcctaggacagtcatcaccatctcctgcactggaaaccgctagtgtaggttggtagttaactaactagttcgtcctaccgtacggaaccaacacgaccaaccgaacgaaccaaaacccgtaaccccaactactaacgttagttaatttagtacgtactacgtactaacgtaacgtccgtaccgttacggttaacggttactacgttccgtcttcgtacgtcgtacctaccgtagtacgacgaacctaaccgcgtccctaccagacctntccgtcgtcgccgtacgngtacgnggaacgacgagtcgtagtattacgtacnacgatactagtaataactaacgacgacctaacgactacccttacgtacttacgttacgttaccggttacggttaacggaacggtaaccggaacgtacggtaccctaccgtaccgtacgtaccgaaccgaccaaacccgccctaccgtac

SEQ ID NO: 198524 - DNA, 717 bp, Homo sapiens
  misc_feature: GYAE6OF01CTC0D.18.59.F04.1.454.CMB.1.raw
  modified_base (220)..(220): a, c, t, g, unknown or other
  misc_feature (220)..(220): n is a, c, g, or t
  modified_base (232)..(232): a, c, t, g, unknown or other
  misc_feature (232)..(232): n is a, c, g, or t
  modified_base (256)..(256): a, c, t, g, unknown or other
  misc_feature (256)..(256): n is a, c, g, or t
  modified_base (315)..(315): a, c, t, g, unknown or other
  misc_feature (315)..(315): n is a, c, g, or t
tcagtacgagtatgcacgaccggtgctcgatttagtacacacacttagggagttggggggggtctcaggaggcagcgctctcgggacgtctccaccatggcctgggctctgctattcctcaccctcctcactcagggcacgagggtcctgggcccagtctgccctgactcagcctgcctccgtgtcgtcgggtctcctggacagtcgatccacatctccngcactcgaaccngcagtgtacgttggagttatactntgtctcgtcggtaacaacagaccaccgaggaccaaacgccccaaactcatagtatttangtatcgtactactaacgtccggccctcgtaacgggtttactaacgttccggtctttctcgtcggtcttaccgaagttccgtgggacctaaaccgacccgggtccccttacccgtcggtaaacctcgttccgtccggttcgggccccttaccggtacgggtacttagggacgggtaacggagggtccgttagtaattttaaccgttacgtcgtacgtacgtcccgttataactaactaaacgacgtacccgacgtaaccacttacctccttacgttagtttcgttacccgttacgggaaccggttaacgggtaacccgaacggttacccctaaccggttcccgttaacggttacccgaaacccggtacccgaaacccggtccccccaaaccccgttaacccgg

SEQ ID NO: 198525 - DNA, 637 bp, Homo sapiens
  misc_feature: GYAE6OF01CS15L.18.59.F04.1.454.CMB.1.raw
  modified_base (353)..(353): a, c, t, g, unknown or other
  misc_feature (353)..(353): n is a, c, g, or t
tcagtacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgctattttaaaggtgtccagtgtgaggtgcagctggtggagtcgtgggggaggcgttagggtaaacggcccgggggggttcccttaggacctccccgtgtaccacgcctcgtggacttcacttttcagtaaggcctggatgaacgtggtccgcaggctccgagggagggctggagtgggtgccaanataatgacaagataggaactgagaaagaactagtgtaggactcgtggtaggaacgggtccaatttccaaccgtattccgtacccgtaagacgtaaccaaacgactaaaagtaacctttactagtactcgtagacaaagtgaaccagtccctagaagacgaccggaaggacctacggtctaggttattacttaacgtggtacgacggaagtcggaccgagggttcggcgtagggaactaggttacgggacggttcgggacgggggtacccaagggggtacccccg

SEQ ID NO: 198526 - DNA, 643 bp, Homo sapiens
  misc_feature: GYAE6OF01D9JY1.18.59.F04.1.454.CMB.1.raw
  modified_base (228)..(228): a, c, t, g, unknown or other
  misc_feature (228)..(228): n is a, c, g, or t
  modified_base (267)..(267): a, c, t, g, unknown or other
  misc_feature (267)..(267): n is a, c, g, or t
  modified_base (299)..(299): a, c, t, g, unknown or other
  misc_feature (299)..(299): n is a, c, g, or t
  modified_base (391)..(391): a, c, t, g, unknown or other
  misc_feature (391)..(391): n is a, c, g, or t
  modified_base (432)..(432): a, c, t, g, unknown or other
  misc_feature (432)..(432): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcgtggacagtcgatcaccatctcctgcactggaaccngcagtgacgttggtgtatactatgtctctggtaccaacngcaccaggcaacgccccaaatcatgactttangtatcgtactactaacgtccgaccgtacgtagggttctaactcgtcttcgtcgtcgacttccaagtctacgcaactacggcctcctcgaccnctcgtacgtcggtctaccgtaggacgttcggaaggtaccgnggtaccttgtaacttagtaccgtgaccagtctacgtataaacgtacaacgtactacccgagtacctaaccgtctacgttaccgttcgggttaccttaaccgggaaaccggttcggggtaaaccccgttaacgggtccccttaacccgggttacccttaacgggtcctaaacccgggaccccaaacccggggacccctaaacccgtaacccg

SEQ ID NO: 198527 - DNA, 720 bp, Homo sapiens
  misc_feature: GYAE6OF01CUGZP.18.59.F04.1.454.CMB.1.raw
  modified_base (234)..(234): a, c, t, g, unknown or other
  misc_feature (234)..(234): n is a, c, g, or t
  modified_base (259)..(259): a, c, t, g, unknown or other
  misc_feature (259)..(259): n is a, c, g, or t
tcagtacgagtatgcacgaccggtgctcgatttagtacacacacttagggattggggggggtctcaggaggcagcgctctcgggacgtctccaccatggcctggctctgctattcctcaccctcctcactcagggcacgagggtcctgggcccagtctgccctgactcagcctgcctccgtgtcgtgggtctccgtggactagtcgatcacctatcctctgcacgtcggaaccngcagtgacgttggtagttataactntcgtctccgtgtaccaacagccaaccgaggaccaaaaccgaccccctaaagtacctaagtcgtaatttacagtactcggtaactaacgtaacgtccggtacccgttaggtaacggggttttactaacgtcgtcgtttcgtccgtggtacccgtacgtaacgttccgtacggaccaaaccgtcccggtccccttacccgtacgtaccgtacgttccgtacggtccggtcctaccggaacgggtccgtagggtaacggaacggtacggtattacggtaatttaccgtacgtcgacgtacgtacttaacaacttaacgaacacgaccctaaccgactacctaccttacgtacgttacgtccgttacggtaaccggaacggtaccgggtaaccgtaacggtccgtaaccccgttacggtacgtaccaacccgggaacccaaaccgggtccccaaccccgttacgg

SEQ ID NO: 198528 - DNA, 842 bp, Homo sapiens
  misc_feature: GYAE6OF01B7JEN.18.59.F04.1.454.CMB.1.raw
  modified_base (231)..(231): a, c, t, g, unknown or other
  misc_feature (231)..(231): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataactatgtctcctggtaccaacacgcacccaggaccaaacgcccccaaactccaatgtacttttatgatgtacaacttaaacgtccggtaccccttcgtaacggggttttcctaaacgttccgtctttcctcgtacggtccttacccgtaaacggttccgttacgggaccctaaacccggtaacccgggtccccctttacccccgttacggtaacccctaacgtttcccgttcccgggttacggggtccccttacccgggaacgggttccggttacgggaaccggggaaccggtacggggttacctttaaggtaaacgttttacgtttaaccgttcggtacctaaccgggtaccttacctaacgtttaaccgtaaaccgtaaaccggtacccaaacccggacgtaccccgtaaaccttcccgtttaaccgttaagtttaccgggtttacccgtttaaccggggtaaaccggttaacccgggggtaaacccgttaaaccggggttaccccgttaacccgggttaacccggttaacggggtttaacccgaaccccgggaaacccccggtaaaccggggttaaaacccccccccg

SEQ ID NO: 198529 - DNA, 775 bp, Homo sapiens
  misc_feature: GYAE6OF01CIWVZ.18.59.F04.1.454.CMB.1.raw
  modified_base (236)..(236): a, c, t, g, unknown or other
  misc_feature (236)..(236): n is a, c, g, or t
  modified_base (260)..(260): a, c, t, g, unknown or other
  misc_feature (260)..(260): n is a, c, g, or t
  modified_base (554)..(554): a, c, t, g, unknown or other
  misc_feature (554)..(554): n is a, c, g, or t
tcagtacgagtatgcacgaccggtgctcgatttagtacacacacttagggagttgggggggggtctcaggaggcagcgctctcgggacgtctccaccatggcctgggctctgctattcctcaccctcctcactcagggcacagggtcctgggcccagtctgccctgactcagcctgcctccgtgtctgggtcctccgtggacagtcgatcaccatcctcctgcaactcgggaaccngcagtggtacgttggtaggtttanaacgtatcgttctaccgtcggtaaccaaacacggaccaacccgaggaacctaaaccgacccccaaaatccaatgtaatttatgtatgtactacttaacgtccgtcccgtagttacgggttactaacgtcgtctttcgtcgtcggtacctacgtaacgtctacgggacctaaaccgccggtaccctaccccgttagaaccctacgttccgttaccggtcggggtcccttccccggaaggtccggtagggtaacggaacggtaacggtccttaaggttaactttaacgttaaccgngtaaccgtacgtacccttaagtaacttaaacgaaccgaaccgtaaccccgaacggaaccgttaccgtaaccctttacgtaccgtttacgttaccggtaccggtttaaccgggaaacggtttacccgggaaaccgtaacggggttcccccaaaccgggtttacccgtaacgggttaccgaacccggtaccccgaaaacccggtccccctaaaccccgttacg

SEQ ID NO: 198530 - DNA, 662 bp, Homo sapiens
  misc_feature: GYAE6OF01BHROP.18.59.F04.1.454.CMB.1.raw
  modified_base (231)..(231): a, c, t, g, unknown or other
  misc_feature (231)..(231): n is a, c, g, or t
  modified_base (268)..(268): a, c, t, g, unknown or other
  misc_feature (268)..(268): n is a, c, g, or t
tcagtacgagtatgcacgaccggtgctcgatttagtacacacacttagggattgggggctgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccngcagtgacgttggtgttatactatgtctctgtaccanagcaccaggacaaacgccccaaactcatgtattatgatgtacactagtccgcctcgtacgggttataaccccgtgtccttctcgtcggtcctaccgtaaacgttcgtacggtaccaaaccgtacccggtccccttaccccgtacggtaacccctagttcccgttaccggttccggggtaccccttaccggaacggtccgttacgggaaccggggtacggaccgggttacttacggttaattttaaccgttaccgtacgtccaaggtccttaactaactaaacgtaaccaacgaccgtaccgacgtacctacctcgttacctagttcgttaccgttacggacgtacggtaccgtacgtccgaccgttacgtacgaccgcacccgacggaaccccc

SEQ ID NO: 198531 - DNA, 676 bp, Homo sapiens
  misc_feature: GYAE6OF01D7Q06.18.59.F04.1.454.CMB.1.raw
  modified_base (653)..(654): a, c, t, g, unknown or other
  misc_feature (653)..(654): n is a, c, g, or t
  modified_base (656)..(658): a, c, t, g, unknown or other
  misc_feature (656)..(658): n is a, c, g, or t
  modified_base (660)..(676): a, c, t, g, unknown or other
  misc_feature (660)..(676): n is a, c, g, or t
tcagtacgagtatgcacgaccggtgctcgatttagtacacacacttagggattgggggctttgtctgggtctcctggacagtcgatcaccatctcctgcactggaaccagcagtgacgttggtggttataactatgtctcctggtaccaacagcacccaggacaaacgccccccaaactcatgtatttatgatgtacactaactccggccctcgaggggttttactaatcgtcttctcgtcggctaccaagtcgtcggacacaccggtccctccctacgaccatctcgtcgggcctaccgaggctgggaacggacggacggtctaggtaactttagtttacgtcgactacgtcctacaacttaactaacgaacgtacccaaacgacgtacctaaccttcctacttaacgttcgttaccggttacccggaacggtcgggaaaccgtaacgggttacccgaacccgttccggtaacgggtccaacccggtaacccccgtaacgggaaccccctaaccccgtcgttaccgtaccgttaccctttaccctttccccgttacccccctaacccttccccttaccaacgtttacccgttcccgttaacgtcggacgggtccgggtacgtagggcccggaacggcgtaccagtacgctcnncnnncnnnnnnnnnnnnnnnnn

SEQ ID NO: 198532 - DNA, 739 bp, Homo sapiens
  misc_feature: GYAE6OF01BFZ76.18.59.F04.1.454.CMB.1.raw
  modified_base (197)..(197): a, c, t, g, unknown or other
  misc_feature (197)..(197): n is a, c, g, or t
  modified_base (207)..(207): a, c, t, g, unknown or other
  misc_feature (207)..(207): n is a, c, g, or t
  modified_base (224)..(224): a, c, t, g, unknown or other
  misc_feature (224)..(224): n is a, c, g, or t
  modified_base (252)..(252): a, c, t, g, unknown or other
  misc_feature (252)..(252): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctcgtgtctggtctctggacngtcgatcacntctctgcactggaaccngctagtgtacgttggtagttaataactntcttctccgtagtaccaacacgccaaccgagaccaaaccgacccccaaactacatacgtatttactgtatcgtactactaacgtccggtcccttacggttacgggtttacttaagtccgtcctttcgtcgtcggtcctaccgtaacgtcgtacgacctaaccgtaccggtcccttacccgtacgtacctacgttccgtcggtcgggtccgttaccgacggtcgttagggaacggtaacggtacggtaccgttagttaactttaagttaccgtacggctaacggtcttactaagtaacgttaacgaacgaccctaacccgacgtacctaacctttaccgttaccgttaagttccggttaccggttaacccggggtaaacggttaccgggtaaacctaccgggttaccccgtacccggttaaccgtaaccgggttacccaaacccgggtaaccccgtaaacccggtacccccgtaaaccccggttaccg

SEQ ID NO: 198533 - DNA, 698 bp, Homo sapiens
  misc_feature: GYAE6OF01CERD8.18.59.F04.1.454.CMB.1.raw
  modified_base (233)..(233): a, c, t, g, unknown or other
  misc_feature (233)..(233): n is a, c, g, or t
  modified_base (275)..(275): a, c, t, g, unknown or other
  misc_feature (275)..(275): n is a, c, g, or t
tcagtacgagtatgcacgaccggtgctcgatttagtacacacacttagggagttggggggggtctcaggaggcagcgctctcgggacgtctccaccatggcctgggctctgctattcctcaccctcctcactcagggcacagggtcctgggcccagtctgccctgactcagcctgcctccgtgtcgtgggtctcctggacagtcgatcaccatctcctgcacgtacggaaccngcagtgtacgttggtagttataactatgtctcgtagtacaanagaccaccacggacaaccgaccccaaactcagtgtattatgatacgactaactaacgtccggtcctacggtacgggtttactaacgtcgtcttcgtacgtcggtacctacgaacgttcgtacgaccgaaacgtaccggtccccttccgacgtacctacgttccgttcggtacggtccttaccgagggtccttaagggaacggtaccgggtacggtaccttaggttaaacgtttacgtaacgtcgtacgacgtctaactaacttaacgaacgaacgtaccgaagtaccacgtaacctacgtaacgtaacgtttaccggtaaccggtaacggtacggtaaacccggtagtacccggtaccgttaccggtacggtacccgaaccggaaccccgtaaacccggacccctaacccgtcgttaaccccg

SEQ ID NO: 198534 - DNA, 545 bp, Homo sapiens
  misc_feature: GYAE6OF01COQF4.18.59.F04.1.454.CMB.1.raw
  modified_base (253)..(253): a, c, t, g, unknown or other
  misc_feature (253)..(253): n is a, c, g, or t
  modified_base (270)..(271): a, c, t, g, unknown or other
  misc_feature (270)..(271): n is a, c, g, or t
  modified_base (415)..(415): a, c, t, g, unknown or other
  misc_feature (415)..(415): n is a, c, g, or t
  modified_base (446)..(446): a, c, t, g, unknown or other
  misc_feature (446)..(446): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactntgtctctggtaccaacnncaccaggacaaacgcccccaaatcatgtatttatgatgtacactaactccggccctcgtaggggtttctaagtcgtcttctctggctaccaagtctggacaaccgcggtccctcccgtcgaccattccgtcgtcgggcctccgnggctggacggacgagctagtattacgttacngcagtctacatacaacacgccacagctactctactgtcgtccgtacggacgtcgggaccaggtcccaccgtctacgtcacgaccaacgcccacctaccg

SEQ ID NO: 198535 - DNA, 663 bp, Homo sapiens
  misc_feature: GYAE6OF01CCB01.18.59.F04.1.454.CMB.1.raw
  modified_base (233)..(233): a, c, t, g, unknown or other
  misc_feature (233)..(233): n is a, c, g, or t
tcagtacgagtatgcacgaccggtgctcgatttagtacacacacttagggagttgggggggggtctcaggaggcagcgctctcgggacgtctccaccatggcctgggctctgctattcctcaccctcctcactcagggcacgagggtcctgggcccagtctgccctgactcagcctgcctcgtgtctgggtctcctggacagtcgatcacatctctgcacgtggaaccaacgngtcgtacgtttggtaggttataactagtgtctcctaggtaccaacagccaccaggacaaacgaccccaaactcatagtatttatagtatagtactactaacgtccgtacccgttacggttagggtttacctaagtccgtctttacctccgttacgaccttaccgtaacgttccgtacggaccaaccgtacccgggtccccttacccgtacgaccctacttccgtaccggtcgggtacctacccggtaggtaccgtagggacggacggtacggtacgtagtaatttacgttacgacgtcgagtcctactataactaacgaacgacctaccgagtcctacttacctgtacgttcgtcgtacggtaacgtaccggacgtaacgtccgaccgttacgaggtaccaccggacccaacgcccctaaccgtcgtccg

SEQ ID NO: 198536 - DNA, 726 bp, Homo sapiens
  misc_feature: GYAE6OF01DRV3N.18.59.F04.1.454.CMB.1.raw
  modified_base (325)..(325): a, c, t, g, unknown or other
  misc_feature (325)..(325): n is a, c, g, or t
  modified_base (457)..(457): a, c, t, g, unknown or other
  misc_feature (457)..(457): n is a, c, g, or t
tcagtacgagtatgcacgaccggtgctcgatttagtacacacacttagggattgggggggagaggagccccagccttgggattcccaagtgttttcattcagtgatcaggactgaacacagaggactcaccatggagtttgggctgagcgtggagtttcctagctgacttagtttaaaggtgtccagtgtgaggtgcagctggtggagtcgtgggggagtcgttgggtaaaggccggggggttcccttaggacctccccgtgtacacgcctctggattcactttcaagttaacggccgtggatgaacgtgggtccgccgaggtcnccgaggggagggctgggaggtgggttggaccgttaaataaaacccgaaagtgaagttggacggacaacgagactacgctacgccacccggtagaaaggcaaggtacttaccaccgtatcgtacgaagaagtntaagtaacttaacgaaaaagcacgtctagtaacttcgtagaaccgtaaatacgaaacgacgtaccgaacggaaccggaaccgaacgggaacaccgtaaggtacccgttagttaccgtttaacgtacgttaaccctactaacccgttaccccgtaaggtaaaccgtacccgtaaacttaaacccgttacttaaacccggttaaaccgttaaccggttaccgtacgggtaccccgttagggtacccggggaccgttaacccggggaacccg

SEQ ID NO: 198537 - DNA, 752 bp, Homo sapiens
  misc_feature: GYAE6OF01BOZ1U.18.59.F04.1.454.CMB.1.raw
  modified_base (295)..(295): a, c, t, g, unknown or other
  misc_feature (295)..(295): n is a, c, g, or t
  modified_base (305)..(305): a, c, t, g, unknown or other
  misc_feature (305)..(305): n is a, c, g, or t
tcagtacgagtatgcacgaccggtgctcgatttagtacacacacttagggagttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttaatactatgtctctggtaccaacagcaccaggacaaacgcccccaaacncatgatttangatgtactagtaactccggtccctcgtacggggtttactaatccggtcttctccgtggctaccgaatcgtacggaccaacgaccggtccctcccgtacgaccctaacgttcttccgtcggggtccctaccgacgggtaccttgggaaaccggtacggacgggtcttaggtaattttaacgttaactcggaactacggtacctacgtaacttaaataaccgaacgaccgaacccgtaacggtcctaacccttccttaacctttaacggttaccgtttaccggtttaaccccgggaaaacccggtttaccgggggtaaaaccccggtaaaccggggtttacccccgaaacccccgtttaccccgggtaaaacggggtttacccccaaacggggtaaaccccccccggaaaacggggtaccccccctaaaaaccccccggttaaccccgg

SEQ ID NO: 198538 - DNA, 686 bp, Homo sapiens
  misc_feature: GYAE6OF01C7VRW.18.59.F04.1.454.CMB.1.raw
  modified_base (199)..(199): a, c, t, g, unknown or other
  misc_feature (199)..(199): n is a, c, g, or t
  modified_base (542)..(542): a, c, t, g, unknown or other
  misc_feature (542)..(542): n is a, c, g, or t
tcagtacgagtatgcacgaccggtgctcgatttagtacacacacttagggagttggggggggtctcaggaggcagcgctctcgggacgtctccaccatggcctgggctctgctattcctcaccctctcactcagggcacagggtcctggcccagtctgccctgactcagcctgcctccgtgtctgggtcctcctggacngtcgatccaccatctcctgcactggaaccagcagtgacgttggagttatactatcgttcttcgtcggtaccaacacgacacccaggaccaaaacgcccccaaatcaacgttcgtatttagcggaattcggtacaaccgttaatccggtcccctacgtaggggttttaccctaaagttcggccttttcgtccgtgggtcctaccgtaagtcgtcggactaaccgacccggtccctcccgtgaacctattccgtcgtacgggtcttcccgaggccttagggagggacaggtcctagtaacgtttactacgtggactacggctacagtaactaacaagtccaaccnggtacccagttcctagttaacgttcgtacccgtttacgggaaaccgtttacggggaacttaaaccgggttccgaccccgttttacggtaacgggtcccttaacccggaccccgaaaccgggtaccccaaaccccgttaacccgg

SEQ ID NO: 198539 - DNA, 831 bp, Homo sapiens
  misc_feature: GYAE6OF01CH8OA.18.59.F04.1.454.CMB.1.raw
tcagtacgagtatgcacgaccggtgctcgatttagtacacacacttagggagttggggggggtctcaggaggcagcgctctcgggacgtctccaccatggcctgggctctgctattcctcaccctcctcactcagggcacgagggtcctgggcccagtctcgccctgactcagcctgcctcgtgtctgggtctcgtggactagtcgatccacctactcctccgtcgcctacgtcggaaccagtcgaagtcggtacggtttgggttacgtttataaacttattcggttactccgttacggtaaccaacacgaccaacccgagaccaaaccgtacccccaaactcacgttagtactttatacggtatcgtacctaacgttacgtcccggtccgttacggttagggtttacctaacgttccgtactttccgtcgtcgtcctaccgtagtcgtcgaccaacgtcccgtaccctccgtacgacctacttcgtcgttaccgggtcctaccggtaacggtcggttaacggacgggtaccggaaggttccgttagtaacgttttacgttaaccgtcgtaccgtacgtacgttaaccgtaaactttaacgtaaccgaaacgtacccgtaaccgaacggttaccctaaccggtttacctttacgtttacggttaccgtttaccggttaaaccccggggttaccgggtttaaccgggggaaacccctttaacggggtttacccccggtaaaccccggttttaaccgggacccggtttaaaccccggaaacccggttacccccgggaaaccccggtacccccgtaaaccccgttaacccccgg

SEQ ID NO: 198540 - DNA, 840 bp, Homo sapiens
  misc_feature: GYAE6OF01DZL5D.18.59.F04.1.454.CMB.1.raw
tcagtacgagtatgcacgaccggtgctcgatttagtacacacacttagggattggggggggagaggagccccagccttgggattcccaagtgttttcattcagtgatcaggactgaacacagaggactcaccatggagtttgggctgagctggtattttccttgctgcttattttaaaaggtgtcagtgtgagtgcagctggtggagtcgtgggggaggcgttagggtaaacggcccggggggttacccttagacctccccgtgtacacgcctcgtggtacttctactttcaggtaacggccgtaggataggaaccgtcgggtccgccgacggcctaccggaagggggaacggggtcgtaggggtagggttcgggggtttacgggaacccggtttaaaactttaaaaaacccgaaaacgtgggtaaacggttagggggtaacggggaaacctaaaaccggaacggtaaaccgttaaccggtccgtaccgggacccgtaaacccccggttaaggggaaaacggtaccgaaaggtaacctttacccaaacccgtacttacctaacgaaaaggtaacggtaattaacggtaaactttaaaccgaaaaaacggtcccgtaaccggtacgtttacggttaaacttccgtaacgtaaaccgtaaaacgtacgaaaccgtacgacccgttaaagggaaccggaaacccggacggaaaccacgtacggtacgttagttaacttacgtacctaacccactaccgtaccccgtaaggaaccgtccgtaactaacttaacctactacgtacggtactcggtaccctggtaccgggaccgacggtaacccgg

SEQ ID NO: 198541 - DNA, 635 bp, Homo sapiens
  misc_feature: GYAE6OF01BP2N0.18.59.F04.1.454.CMB.1.raw
  modified_base (253)..(253): a, c, t, g, unknown or other
  misc_feature (253)..(253): n is a, c, g, or t
tcagtacgagtatgcacgaccggtgctcgatttagtacacacacttagggattggggggggtctcaggaggcagcgctctcgggacgtctccaccatggcctgggctctgctattccctcaccctcctcactcagggcacagggtcctgggcccagtctgccctgactcagcctgcctccgtgtctggtctcctggacagtcgatcaccatctcctgctactggaaccagcagtgacgttggtgttataactntgtctcctggtaccaacagccaccaggcaaacgcccccaaactcatgatttactgatcgtcactaatcgccctacgtagggtttactaagtctcttactcgtgcctacagtcgtgcacacggtcctccgtgacctatctcgtcgggtcctccgaaggtccgtaggtaacgggacgtaagggccttaggtaactttacgttaccgtcgactacggtcctacaacttaacgtaaccaacggtcgtaacgccgaacggtacaacccttacgaacgttacccggttaccggaaacgttaccgggaacccttaaccgggtcctaccccgggttaccttacgggtacccacggaccccgaaaggccccaaaccccgtcgttaacccgg

SEQ ID NO: 198542 - DNA, 600 bp, Homo sapiens
  misc_feature: GYAE6OF01D386P.18.59.F04.1.454.CMB.1.raw
  modified_base (251)..(251): a, c, t, g, unknown or other
  misc_feature (251)..(251): n is a, c, g, or t
  modified_base (481)..(481): a, c, t, g, unknown or other
  misc_feature (481)..(481): n is a, c, g, or t
  modified_base (594)..(594): a, c, t, g, unknown or other
  misc_feature (594)..(594): n is a, c, g, or t
  modified_base (596)..(597): a, c, t, g, unknown or other
  misc_feature (596)..(597): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctnaggggtttctaatcgcttctctggctccaagtctggcaacgaccggcctccctgaccatctcgtcgggctccgaggctaggaggacgaggcctagtatttattactgcagctacatatacaacgcaaccgagccacttctcttatcgttacgttacggaacgtacggaaccgaaggtccctaacccgttcgtaacggtccaaccggtaccccgaacggacccccaacccncgttacgtccaccttccgttccgttcccccgccccttcccgtaccctacttacccgtaccttacgtcgtacgggcccgggtcgtacgggacgaacggccgagacgttagcagngnngac

SEQ ID NO: 198543 - DNA, 732 bp, Homo sapiens
  misc_feature: GYAE6OF01CKTMH.18.59.F04.1.454.CMB.1.raw
  modified_base (208)..(208): a, c, t, g, unknown or other
  misc_feature (208)..(208): n is a, c, g, or t
  modified_base (228)..(228): a, c, t, g, unknown or other
  misc_feature (228)..(228): n is a, c, g, or t
  modified_base (365)..(365): a, c, t, g, unknown or other
  misc_feature (365)..(365): n is a, c, g, or t
tcagtacgagtatgcacgaccggtgctcgatttagtacacacacttagggagttcggggggggtctcgaggaggcagcgctctcgggacgtctccaccagtcggccgtgggctctgctattcctcaccctcctcactcgaggcacgaggtcctgggcccagtctcgccctgactcagcctgccctccgtgtcgtggtctccgaggacnggtcatccaccatcctccgngacctacgtacggaaaccagcctaaggtggtacggtttgggtagttttaataaccttgttcgttccgttccgtacggtaaccaacgacgacccacccgaggaaccaacccgtaccccaaatctaagtattaatttangtaacttcgttacaacgttaacgtcccggtacctaggtacgggtttactaacgtcgttccgttctcgtcggttaccacctaaggttcgacggaacctaaaccgccggtccctacccgtagaacctcgttccgtaccggtcgggtcctaaccgggcggtaccgttaagggaaccgggttaccggacgttacggttacttaacggttttacacggtaacgccgtagtttaccataacgttaaccaacgacgtaccaccgtcgaccttctactacgttgttcctacggttacggaaacgccggtaacgtaaccggtccttaacccggtacgtaccgacctacggaaccccgtacccgacctaaccccgtg

SEQ ID NO: 198544 - DNA, 343 bp, Homo sapiens
  misc_feature: GYAE6OF01DDUQE.18.59.F04.1.454.CMB.1.raw
  modified_base (171)..(171): a, c, t, g, unknown or other
  misc_feature (171)..(171): n is a, c, g, or t
  modified_base (312)..(312): a, c, t, g, unknown or other
  misc_feature (312)..(312): n is a, c, g, or t
  modified_base (331)..(343): a, c, t, g, unknown or other
  misc_feature (331)..(343): n is a, c, g, or t
tcagtacgagtatgcacgaccggtgctcgatttagtacacacacttagggattggggagagaagacaggattcaggacaatctccagcatggccggcttccctctcctcctcaccctcctcactcactgtgcagggtcctgggcccagtctgtgctgactcagccaccctnagcgtctcgggaccccgggcagagggtcaccatctcttgttctggaagcagcctaccaacagtcggaagtcacgcccgaaggcctcgccccctggtcactctacgttccccaccctcctcactactcgtactgacggcggntggcgaaggccgcagtagnnnnnnnnnnnnn

SEQ ID NO: 198545 - DNA, 603 bp, Homo sapiens
  misc_feature: GYAE6OF01EB6HV.18.59.F04.1.454.CMB.1.raw
  modified_base (499)..(499): a, c, t, g, unknown or other
  misc_feature (499)..(499): n is a, c, g, or t
  modified_base (599)..(599): a, c, t, g, unknown or other
  misc_feature (599)..(599): n is a, c, g, or t
  modified_base (602)..(603): a, c, t, g, unknown or other
  misc_feature (602)..(603): n is a, c, g, or t
tcagtacgagtatgcacgaccggtgctcgatttagtacacacacttagggattgggggcgtttgcctgggtcctgggcccagtctgccctgactcagcctgcctccgtgtctgggtctcctggacagtcgatcaccatctcctgcactggaaccagcagtgacgttggtggttataactatgtctcctggtaccaacagcaccaggacaaacgcccccaaactcatgtatttatgatgtcactaatcgcctcgtaggggtttctaatcgtcttctctggtctccaagtctggaccaacgaccggtcctcccgtacgaccacttcctcgtcgggctccgaggtctaggacggacggaggtctagtatttacttacgtgacacgtctacgtaactaactaacaacgcaaccagcctactactcttatcgttacgtcggaacgtcggaccgaacggtccaccgtcgtacggtcacgaccgaccggcccaacccgctcgtacncttccgtaccgttccccgtcccttcctcctacgttaccgtcgtacgtcggacggtccgggtcgtacggaccggtaacggaccgtcgaagttacggctagntcnn

SEQ ID NO: 198546 - DNA, 773 bp, Homo sapiens
  misc_feature: GYAE6OF01AKQ8R.18.59.F04.1.454.CMB.1.raw
  modified_base (737)..(737): a, c, t, g, unknown or other
  misc_feature (737)..(737): n is a, c, g, or t
  modified_base (742)..(742): a, c, t, g, unknown or other
  misc_feature (742)..(742): n is a, c, g, or t
  modified_base (744)..(744): a, c, t, g, unknown or other
  misc_feature (744)..(744): n is a, c, g, or t
  modified_base (746)..(746): a, c, t, g, unknown or other
  misc_feature (746)..(746): n is a, c, g, or t
  modified_base (748)..(748): a, c, t, g, unknown or other
  misc_feature (748)..(748): n is a, c, g, or t
  modified_base (750)..(750): a, c, t, g, unknown or other
  misc_feature (750)..(750): n is a, c, g, or t
  modified_base (752)..(753): a, c, t, g, unknown or other
  misc_feature (752)..(753): n is a, c, g, or t
  modified_base (755)..(755): a, c, t, g, unknown or other
  misc_feature (755)..(755): n is a, c, g, or t
  modified_base (759)..(759): a, c, t, g, unknown or other
  misc_feature (759)..(759): n is a, c, g, or t
  modified_base (761)..(761): a, c, t, g, unknown or other
  misc_feature (761)..(761): n is a, c, g, or t
  modified_base (763)..(763): a, c, t, g, unknown or other
  misc_feature (763)..(763): n is a, c, g, or t
  modified_base (765)..(765): a, c, t, g, unknown or other
  misc_feature (765)..(765): n is a, c, g, or t
  modified_base (767)..(768): a, c, t, g, unknown or other
  misc_feature (767)..(768): n is a, c, g, or t
  modified_base (770)..(772): a, c, t, g, unknown or other
  misc_feature (770)..(772): n is a, c, g, or t
tcagtacgagtatgcacgaccggtgctcgatttagtacacacacttagggattggggctttgtctgggtctcctggacagtcgatcaccatctcctgcactggaaccagcagtgacgttggtggttataactatgtctcctggtaccaacagcaccaggcaaacgccccaaatcatgatttatgatgtcactaagtccggcctacgtagggtttacctaatccgtctttcgtcttggaccttaccgtaagttccgtacgggaccaaaaccgtaccccgggtccctttacccccgtcggaaccccttactttcccgttcccggtcgggggtaccccttacccggaacggggtccttaaggggaaccggggaaccggtacgggtcccttaggttaacttttaaccgtttactcgggaccgaacttcctaacttataaaccgtaaccgaaacgcccgaaaccgtactaccttaccttactaccttagttacgtttacccggttaacggggaaaccgttaccggggaaacccctttaaaggtcccctaacccggggttacctagggtaccccaaccggtaacccccgaacggaacccccctacccgtaacgttaccgtacctacccgtactttaccccgtacccctacccctaccctaccacgttaccctacgtacccgtacggaccggtaccgggtactaccgggacgtaaccggacctacgacgttacgcacgtacgcngtacncncncncncnncncgcncncncncnncnnnc

SEQ ID NO: 198547 - DNA, 665 bp, Homo sapiens
  misc_feature: GYAE6OF01BAF2Z.18.59.F04.1.454.CMB.1.raw
  modified_base (276)..(276): a, c, t, g, unknown or other
  misc_feature (276)..(276): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctcgtgtcgtgggtctcctggacagtcatcaccatcctcctgcacgtggaaccagcagtgtacgttggtagttaataactatgtctcctggtaccacngccaccgagaccaaaccgccccaaactcatgtatttatgatgtactactacgtccggtcccgttaccgggttactactcgtcttctcgtggtcctcgtagttctcgacaaccgaccgtccctaccctagtacctactccgttcgtcggccttacgcggtcgtacggacgggtaacgacggtccttaggtactttacgttacgtcgacgtacgcttaacgtaacttaacgtaaacctaacggccaaaccgtaccgacctaccgttaccttaccgttacgtttacggttaccggttaccggtaaccggtaccgggaacggtaccggttaacccgtaccggtaccggttacggacccgtaaccggaccctaacccgggacccctaaaccccg

SEQ ID NO: 198548 - DNA, 550 bp, Homo sapiens
  misc_feature: GYAE6OF01ELXG8.18.59.F04.1.454.CMB.1.raw
  modified_base (209)..(209): a, c, t, g, unknown or other
  misc_feature (209)..(209): n is a, c, g, or t
  modified_base (227)..(227): a, c, t, g, unknown or other
  misc_feature (227)..(227): n is a, c, g, or t
  modified_base (247)..(247): a, c, t, g, unknown or other
  misc_feature (247)..(247): n is a, c, g, or t
  modified_base (307)..(307): a, c, t, g, unknown or other
  misc_feature (307)..(307): n is a, c, g, or t
  modified_base (378)..(378): a, c, t, g, unknown or other
  misc_feature (378)..(378): n is a, c, g, or t
  modified_base (381)..(381): a, c, t, g, unknown or other
  misc_feature (381)..(381): n is a, c, g, or t
  modified_base (391)..(391): a, c, t, g, unknown or other
  misc_feature (391)..(391): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacntctcctgcactggaaccngcagtgacgttggtggttanaactatgtctcctggtaccaacagcaccaggacaaacgcccccaaaactcactgatttangtatgtacactaatcggccctcgtagggtttctaatcgcttctctgctcagtctgcacacgctcctgctanctntcggctccgnggctgaggacgagctgtattattactgcagtcctcataactaacgaacactaccagacactcttcctagttcgtccgttacggaacgttcgggaacctaaggtcctaccggttcccgacggtacaccgaaccccgaacggacccccaacccgtaacccg

SEQ ID NO: 198549 - DNA, 695 bp, Homo sapiens
  misc_feature: GYAE6OF01D8Q72.18.59.F04.1.454.CMB.1.raw
  modified_base (258)..(258): a, c, t, g, unknown or other
  misc_feature (258)..(258): n is a, c, g, or t
  modified_base (264)..(264): a, c, t, g, unknown or other
  misc_feature (264)..(264): n is a, c, g, or t
  modified_base (329)..(329): a, c, t, g, unknown or other
  misc_feature (329)..(329): n is a, c, g, or t
  modified_base (462)..(462): a, c, t, g, unknown or other
  misc_feature (462)..(462): n is a, c, g, or t
tcagtacgagtatgcacgaccggtgctcgatttagtacacacacttagggagttggggggggtctcaggaggcagcgctctcgggacgtctccaccatggcctgggctctgctattcctcaccctcctcactcagggcacgagggtcctgggcccagtctgccctgactcagcctgcctcgtgtctgggtctcctggacagtcgatccaccattcctcctagcacgtaggaaccagctagtgtacgttggtagttaanaacgtntcgtctccgtggtaccaacacgaccaccgaggaccaaacgaccccaaactcatacgtatttaagngtatgtacaactacgtccggccttacgtacgggtttactactcgtacttctcgtacggctcgtaagtcgtggaccaacgacccggtccctacccgtacgaccctacttccgttccggtcgggtccttaccggnggtacgttacgggaacggtaacgggacggtacgttaggttaacttttaacgtaccgtggacctacgttaccgtactaacgttaactaaccgaaacgacccgtaaccgtacgtaccctacgttcctacgttacgttacggttaccgttacgggaacgttacgggtaacccgtaacggtccgtaaccgttccgtaacggtccgaaccggacccaaccggacccctacctaaccgg

SEQ ID NO: 198550 - DNA, 655 bp, Homo sapiens
  misc_feature: GYAE6OF01BFVTC.18.59.F04.1.454.CMB.1.raw
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcactggaaccagcagtgtacgttggtgttataactatgtctctggtaccaacagcaccaggccaaacgacccccaaatcatgtatttatgatcgtacactaatccgccctgtacgggttctacgtacgtcttctctcgtctctacgtacgtcgtacgactaacgtcgtccgtccctacgtaccgtacctcgtccgtcggtccgtccgtacggtcgtacggtaagggaccggtaacgggtacggttacgtagttactttaacgttacgtaccgtacgacgttacctacgtaacgttaacctaaacgtaccgaacctaccgaacctacctacctttaccttaacgttacgttccgttacggtaaccggtaacggtaacccggtaggtaacccgtacccggtaccgttaccgtaccggtcgaccccggtaaaccccg

SEQ ID NO: 198551 - DNA, 670 bp, Homo sapiens
  misc_feature: GYAE6OF01B7UVD.18.59.F04.1.454.CMB.1.raw
  modified_base (255)..(255): a, c, t, g, unknown or other
  misc_feature (255)..(255): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcactggaaccagcagtgacgttggtagttataactntgtctctgtaccaacagcaccagacaaacgcccccaaatcatgtatttatgatgtacactaactccgtccctacgtagggttactaagtcgtcttctctggctacgagtcgtcgactaacgccgcctcctcgaccattctcgtcgggtacctccgacggtcgtacggaacggtaccggacggtacgtagtaactttaagttaccgtgaccgtaacggtccttacgtaattaacttaacgaacgaccgtaaccgacgtacctaccttcctaacttacgttacgttcccggttaaaccggtaacggttaccgggtaaacccgtaacgggttaccctaaccccgggttacccgtaacgggttaacccgacccggtaaccccgtaaacccgggtaccccctaaacccccgttaacccgg

SEQ ID NO: 198552 - DNA, 746 bp, Homo sapiens
  misc_feature: GYAE6OF01DTX57.18.59.F04.1.454.CMB.1.raw
  modified_base (250)..(250): a, c, t, g, unknown or other
  misc_feature (250)..(250): n is a, c, g, or t
tcagtacgagtatgcacgaccggtgctcgatttagtacacacacttagggagttggggggggtctcaggaggcagcgctcgtcgggacgtctccaccatggcctggctctgctattcctcaccctcctcactcagggcacgagggtccgtcgggccctaggtctcgcccgtgaacctcagtcctgcctcgtgtcgtcgggtctccgtgacacgtcatcgacctatcctccgtcgactacgtacggaaacngcgagttcggtacggtttggtagttaataactgttacgttcctcgtacggtacctaacgacgccgaaccgtacggaccaaaccgtacccccaataccgaatcgtatttaagacgtacttacgactaacgtacgtacccggtccttacgggtacgttacgtaacgttcgtaccgtttcgtcgtacggtactaccgtaacgtcgtacgtaaccgtacgtaccgtacccgttccgtacgtaccgtagtccgtacggttccgacgttacccggaggtaccgtaaggtaccggaggtaccggtattacgttacgtttaacgactaggtacctaggtaactaacgtaacttaaacgtaccgtaaccgacgtaaccgacctataccttacggtactacgttacgggttaccgtaacggtaaccggttaccggaacttaacggtcccgacggttacccgtaggtaactaccccgggaaacccaaccgtcccgtaaaccgtaccg

SEQ ID NO: 198553 - DNA, 978 bp, Homo sapiens
  misc_feature: GYAE6OF01BEJI4.18.59.F04.1.454.CMB.1.raw
tcagtacgagtatgcacgaccggtgctcgatttagtacacacacttagggattggggagctctgggagaggagccccagccttgggattcccaagtgttttcattcagtgatcaggactgaacacagaggactcaccatggagtttggctgagctggtatttcctgctgcttagttttaaaggtgtcagtgtgaggtgcagtctgggtggaggtcggtggggggagtcgttagggtaaacgggtcccgggggggttacccttacggacccttccccgtagtacgacgtcccttcgtggtatttcctaaccgtttttcgacggttaaaggccccgttagggtaacttacggtaaaccggttcgggggttccccggacccgaagggtccccgttacccgggaaggggggaacggggggtccgttagggggtaaggggttcgggggtttacgggtaaccccggtttaaaaacgttttaaaaaaacccccggaaaaacgttttagggaaacggtttagggggtaacggggtaaaccctaaacggaaaccggtaaccgtaaacccggtccgttaccggaacccccgtaaaccccgggttaagggaaaaaccggccgttaaacgggtaaactttacccgaaaccccttaacgttacccgttaaccgtaaaaggtaacggtaacgtttaacgttaaaacgtttaaacccgaaaaaaacggtacccgtaaaccgttacgttacgtttacttaccggttactaaaccgtaaagttaacgaaaccgaacgtaaccgtaacggaaacggaacccggaacggaacgaccgtaacggtcccgttaagtaaccgtttaccgtaacccgtaaccgtaacccttaacccgtaccccgtaaggtaaacccggtcccgttaaactaaaccccgtttaaccttaaacgttacccggtttaaaccgtacggttacccgggttacccgtaacccggggg

SEQ ID NO: 198554 - DNA, 649 bp, Homo sapiens
  misc_feature: GYAE6OF01A8A1A.18.59.F04.1.454.CMB.1.raw
  modified_base (249)..(249): a, c, t, g, unknown or other
  misc_feature (249)..(249): n is a, c, g, or t
  modified_base (306)..(306): a, c, t, g, unknown or other
  misc_feature (306)..(306): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtaggttanaactatgtctcctggtaccaacagcaccgaggcaaacgcccccaaatcatgatttangatgtacactaactcggccctcgtagggtttactaattcgcttctctcggtctaccaagtctggcaacgacggccctccctagacctatcctcgtcgggcctccgaggtctggaagggacgtaacggtcttagtaactttacgttaacgtcgaccgagtccttaacaattaacaaccgaacgtaccaccgaacgtacccaaccttcgttactacgttcggttacctttaccgggaaacgttccggggtaaccctaaacggggttccccgtaacccggttaccgttaacgggtacccaacccggtacccccgaaaccgggtcccccctaaaacccccgtaaccg

SEQ ID NO: 198555 - DNA, 612 bp, Homo sapiens
  misc_feature: GYAE6OF01AO55E.18.59.F04.1.454.CMB.1.raw
  modified_base (309)..(309): a, c, t, g, unknown or other
  misc_feature (309)..(309): n is a, c, g, or t
  modified_base (463)..(463): a, c, t, g, unknown or other
  misc_feature (463)..(463): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtagttataactatgtctcctggtaccaacagcaccaggacaaacgcccccaaactcatgatttangatgtcactagtcggccctgtagggtttctaagtcgtcttctcgtcggtctaccgaagtcgtcggaccaaccgtacccggtccctccctacgacctacttcctcgtcgggcctccgaggtcgtggacggacggacggctagtactttagttacngtacagtactctaatactaacgaacgcctaaccacgtacctacttcctacttagttcggttaccgtttacggaacggttccgggaaacctacgggtaccttacccggtaccgtacggtaccgacccgacccggtaacggtaaccccccg

SEQ ID NO: 198556 - DNA, 592 bp, Homo sapiens
  misc_feature: GYAE6OF01BCS71.18.59.F04.1.454.CMB.1.raw
  modified_base (199)..(199): a, c, t, g, unknown or other
  misc_feature (199)..(199): n is a, c, g, or t
  modified_base (228)..(228): a, c, t, g, unknown or other
  misc_feature (228)..(228): n is a, c, g, or t
  modified_base (247)..(247): a, c, t, g, unknown or other
  misc_feature (247)..(247): n is a, c, g, or t
  modified_base (252)..(252): a, c, t, g, unknown or other
  misc_feature (252)..(252): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacngtcgatcaccatctcctgcactggaaccngcagtgacgttggtgttanaactntgtctcctggtaccaacagccacccaggcaaacgcccccaaactcatgatttatgatgtacactaatcggccctacgtagggtttactaatccgtcttctctgctccaagtctcgacaacaccggcctccctgaccactctcgtgggcctccgaggtctaggacggacggaggtctgtaacgtttacttacgtgcacgtacctcaattactaacgaacgccaccagactactcttcctagttcgtccgttacgggaaccgtcgggtaacccgtacggttacccacccggttaccgtacggtcaaccggaccccaaccggaccccgtaaacccccgtaccg

SEQ ID NO: 198557 - DNA, 751 bp, Homo sapiens
  misc_feature: GYAE6OF01BKBBC.18.59.F04.1.454.CMB.1.raw
  modified_base (188)..(188): a, c, t, g, unknown or other
  misc_feature (188)..(188): n is a, c, g, or t
  modified_base (704)..(704): a, c, t, g, unknown or other
  misc_feature (704)..(704): n is a, c, g, or t
  modified_base (717)..(717): a, c, t, g, unknown or other
  misc_feature (717)..(717): n is a, c, g, or t
  modified_base (730)..(731): a, c, t, g, unknown or other
  misc_feature (730)..(731): n is a, c, g, or t
  modified_base (735)..(735): a, c, t, g, unknown or other
  misc_feature (735)..(735): n is a, c, g, or t
  modified_base (739)..(739): a, c, t, g, unknown or other
  misc_feature (739)..(739): n is a, c, g, or t
  modified_base (741)..(741): a, c, t, g, unknown or other
  misc_feature (741)..(741): n is a, c, g, or t
  modified_base (743)..(743): a, c, t, g, unknown or other
  misc_feature (743)..(743): n is a, c, g, or t
  modified_base (745)..(746): a, c, t, g, unknown or other
  misc_feature (745)..(746): n is a, c, g, or t
  modified_base (748)..(749): a, c, t, g, unknown or other
  misc_feature (748)..(749): n is a, c, g, or t
  modified_base (751)..(751): a, c, t, g, unknown or other
  misc_feature (751)..(751): n is a, c, g, or t
tcagtacgagtatgcacgaccggtgctcgatttagtacacacacttagggattgggggctttgtctgggtctcctggacagtcgatcaccatctcctgcactggaaccagcagtgacgttggtggttataactatgtctcctggtaccaacagcacccaggcaaacgcccccaaactcatgtatttangatgtacactaacgtccggccctcgtaggggtttctaatcgtctttctcgtggtcctccgaagttcctaggaccaaccgaccggtcccttaccccgtcgaaccctacgttccgttccgttcggggcccttacccggaagggtccgttaggggaacgggaccggtacgggtccttaaggtaattttaacgtttaccgtcggaccgtaacgtccttacaattaacgtaacgaaacgaccacgaccgacgacctactacgttaacggttaccgtttaacgggaaaccggttccgggaaaccgtaaccgggttccctaaccccggttccgtaaacgggtcccaaccggtaccccgaaaccgggtacccccaaacccgtcgttccgtacccgtacgttccccttacccgttacccccctacccttccctaccttaaccgtttaccgttccggttaaccgtcgggaccggtccggggtaccgtaccgggacccggtaacgtcccggtagtaaccggtgtacncgtacgcgtcgcnctacgcgcgcgcnnctcncgcncncncnncnngn

SEQ ID NO: 198558 - DNA, 733 bp, Homo sapiens
  misc_feature: GYAE6OF01DM1NL.18.59.F04.1.454.CMB.1.raw
tcagtacgagtatgcacgaccggtgctcgatttagtacacacacttagggattggggggggtctcaggaggcagcgctctcggggacgtctccaccatggcctgggctctgctattcctccaccctcctcactcgagggcacgacgggtcctcgggcccagtctcgccctgactcacgcctcgcctcgtgtcgtggtctccgtggactagtcgactcgaccactcctcctcgacctacgtacggaaccacgctacggtacggtacggttggtacggttactaactgttcgtccttccgtacggtaaccaacgacgccaccgacggaccaaaccgaccccctaactcgagtacgtagtttatacgtactcgtactaactaacgtccggtcctacggttacgggttactaacgtccgtcgtttccgtcgtcggtacctacgtacgtcgtacggaccaacgtaccggtccctaccgtacgacctacgttccgtcggtcggcctacggacgtacgtggaacgggtacgtcggtctagttaacgtttacgttacgtcgtaccgtaacgtcctaacgtaattaacctaacgaacggaccctaacggctaacctccgttccttagttaccgttcgtaccggttacggaacggtaccggtaaacggtacccggttaccgacccgttaccggttacggtaccctacccggacccaacccgggtaacccccaacccgttaccg

SEQ ID NO: 198559 - DNA, 771 bp, Homo sapiens
  misc_feature: GYAE6OF01DNTTB.18.59.F04.1.454.CMB.1.raw
  modified_base (145)..(145): a, c, t, g, unknown or other
  misc_feature (145)..(145): n is a, c, g, or t
  modified_base (298)..(298): a, c, t, g, unknown or other
  misc_feature (298)..(298): n is a, c, g, or t
  modified_base (348)..(348): a, c, t, g, unknown or other
  misc_feature (348)..(348): n is a, c, g, or t
  modified_base (397)..(397): a, c, t, g, unknown or other
  misc_feature (397)..(397): n is a, c, g, or t
  modified_base (404)..(404): a, c, t, g, unknown or other
  misc_feature (404)..(404): n is a, c, g, or t
  modified_base (479)..(479): a, c, t, g, unknown or other
  misc_feature (479)..(479): n is a, c, g, or t
tcagtacgagtatgcacgaccggtgctcgatttagtacacacacttagggattgggggctggggtctcagggaggcagcgctactcgggacgtctccaccatggcctgggctctgctattcctcaccctctcactcagggcacgngggtcctgggcccagtctgccctgactcgagcctgcctccgtgtcgtgggtctccgtaggacaggtccgatccgacctatccgtcctgacacgtcggaacctaggctagtcgtacggtttggtagttaataacgtagtctctcgtcgtaccancgccaaccgtaggaccaaaccgacccctaaatcctatcgttaatttacgngacttcgactaacgtaactccggtcctacggtacgggttactactcgtnttcgtcncggtcctacgtagtccggtacgaccgtaaccgtcggtccctccgtacgaccgtctaccgtcggtaccgggtaccncggtaggttcgtacgggacgggtaaccggtagtaccgttaggtaaacttttacggttaccggtacgtacggtaccgtacgtaacttacggtaaaccgttacgaaccggtacctaacccggtaccgtaccttaaccgttacccggtttacgttaaccggttaccgtttaacccgggtaacccgggtaaccggtttaacccggggaaacccggtttaacccgttccccgtaaaacccggtttccgggtaaacccgttacccggaacccggaaaccccggtaaccgtaacccccg

SEQ ID NO: 198560 - DNA, 637 bp, Homo sapiens
  misc_feature: GYAE6OF01ELJE7.18.59.F04.1.454.CMB.1.raw
  modified_base (252)..(252): a, c, t, g, unknown or other
  misc_feature (252)..(252): n is a, c, g, or t
tcagtacgagtatgcacgaccggtgctcgatttagtacacacacttagggagttggggggggtctcaggaggcagcgctctcgggacgtctccaccatggcctgggctctgctattcctcaccctcctcactcagggcacagggtcctgggcccagtctgccctgactcagcctgcctcgtgtctgggtctccgtggacagtcgatcaccatctcctgcactggaaccagcagtgacgttggtgttatactntgtctctggtaccacagcaccagtacaaacgccccaaactcatcgtatttatgatcgtactactacgtccggccctcgtacgggtttactaagtccgtactttctcgtcggctaccgtagtcgtcggacaacgaccggtccctcccgtcgacctacttcgtcgtcgggcctcgacggtcgtagacgggacgaggtctagtatttacgtacgtgcgtacgtactacaagtactaacaacgacctaaccgacgtacctaccttcgttactacgttcggttaccgttacggtaaccggtaccggggtaacctaacggttccgtacccggttacgtaaccgggtccaacccggaaccccgaaccccggtacccgtaacccccgtaacgg

SEQ ID NO: 198561 - DNA, 649 bp, Homo sapiens
  misc_feature: GYAE6OF01BX1AV.18.59.F04.1.454.CMB.1.raw
  modified_base (210)..(210): a, c, t, g, unknown or other
  misc_feature (210)..(210): n is a, c, g, or t
  modified_base (216)..(216): a, c, t, g, unknown or other
  misc_feature (216)..(216): n is a, c, g, or t
  modified_base (228)..(228): a, c, t, g, unknown or other
  misc_feature (228)..(228): n is a, c, g, or t
  modified_base (305)..(305): a, c, t, g, unknown or other
  misc_feature (305)..(305): n is a, c, g, or t
  modified_base (319)..(319): a, c, t, g, unknown or other
  misc_feature (319)..(319): n is a, c, g, or t
  modified_base (467)..(467): a, c, t, g, unknown or other
  misc_feature (467)..(467): n is a, c, g, or t
tcagtacgagtatgcacgaccggtgctcgatttagtacacacacttagggagttggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccntctccngcactggaaccngcagtgacgttggtgttatactatgtctcctggtaccaacagcaccgaggacaaacgcccccaaatcatgtatttangtatgtacagtacnccgccgtggtaggttactacgtcgtcttctgtcgctacgtagtcgtacgacaccgccggtccctccacgtacctactcgttcggtccggtcctaccgtacggtcgtacggacggtacggacggtcgtattagtttaactcgtggaccncgtaccgtataataacgtaacgaacgacgacgacctacgacctacgtaccgttaacggttcccggttaaaccggaacggtaccgggaaaccggttacggtacccggttacccgttaccggtaacgggtacccgaaccggtaacccccggtaacccggaaccccctaaacccgtcgtaacccg

SEQ ID NO: 198562 - DNA, 699 bp, Homo sapiens
  misc_feature: GYAE6OF01B8CAQ.18.59.F04.1.454.CMB.1.raw
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatccaccatctcctgcacgtggaaccagcagtgacgttggtagttatatatctctccgtggtaccaacagccaccgagaccaaaccgccccaaactcatagtactttatgtatcgtactactaacgtccgtccctacgtacgggtttactaactcgtctttcgtcgtcggtaccttccgtaaggttccgacggacctaacccggtacccggtaccccttacccgtacgaaccgttacgttcccgtcggttccgggtacctcccggtaaggtcgtacgggaacgggtaccgggagggtccgtttaggtaagttttaaccttaaccggtcggactacgttctaataacttaacgtaacaaccgtacccgaacctcgaaccttacgtcctttacttcggtaccgtttacgtaccgggtaacgtacccggggtaacaccggttaccccgtaccgttacggtacggtaccccgacggtaccccgaacccgtacccccg

SEQ ID NO: 198563 - DNA, 509 bp, Homo sapiens
  misc_feature: GYAE6OF01DHLLX.18.59.F04.1.454.CMB.1.raw
  modified_base (305)..(305): a, c, t, g, unknown or other
  misc_feature (305)..(305): n is a, c, g, or t
  modified_base (325)..(325): a, c, t, g, unknown or other
  misc_feature (325)..(325): n is a, c, g, or t
  modified_base (397)..(397): a, c, t, g, unknown or other
  misc_feature (397)..(397): n is a, c, g, or t
  modified_base (482)..(482): a, c, t, g, unknown or other
  misc_feature (482)..(482): n is a, c, g, or t
  modified_base (486)..(486): a, c, t, g, unknown or other
  misc_feature (486)..(486): n is a, c, g, or t
  modified_base (488)..(489): a, c, t, g, unknown or other
  misc_feature (488)..(489): n is a, c, g, or t
  modified_base (491)..(494): a, c, t, g, unknown or other
  misc_feature (491)..(494): n is a, c, g, or t
  modified_base (496)..(502): a, c, t, g, unknown or other
  misc_feature (496)..(502): n is a, c, g, or t
  modified_base (504)..(509): a, c, t, g, unknown or other
  misc_feature (504)..(509): n is a, c, g, or t
tcagtacgagtatgcacgaccggtgctcgatttagtacacacacttagggattgggggctttgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcgaggggtttctaatcgtcttctctcggctccaagtctggccaacaccggcctccctgacctatctctggctccaggctgaggacgagctgtattattcngcagctcatatacaagcacngcactctctagtcgtcttacggacgtggaacccaaggtccaccgtctagtcaacgcccaacggcccaacccnctctccacctcttcgttacccaccctcctccacttactccgtacgtcgcggtaccggctacgggcgaacggcgaccgtagtagcncgtncnncnnnngnnnnnnncnnnnnn

SEQ ID NO: 198564 - DNA, 643 bp, Homo sapiens
  misc_feature: GYAE6OF01AYUVL.18.59.F04.1.454.CMB.1.raw
  modified_base (141)..(141): a, c, t, g, unknown or other
  misc_feature (141)..(141): n is a, c, g, or t
  modified_base (259)..(259): a, c, t, g, unknown or other
  misc_feature (259)..(259): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacngggtcctgggcccagtctgccctgactcagcctgcctccgtgtctgggtctccgtggacagtcgatccaccatcctcctgcactggaaccagcagtggacggttggtagttataactntcgtctcctaggtaccaacagccaccgaggaccaaaccgacccccaaactcatcgtatttatgattcgtactactaacgtccggcccgtacggtacggggtttactaatccgtcttctcgtcggtacctaccgtagtcctacggacctaaccgaccggtccctacccgtacgacctactccgtcgtacgggccttacggacgtcgtaggaacggacggtaggtcgtagttaactttacgtactacggctaacgtccctaagtaactaactaacaaccgccctaaaccgctacctactactactagttcgttaccgtaacggacggtacggaccgtacggccgtacccgtcgtacgtacgacgacccgacgcccctaccgtaccg

SEQ ID NO: 198565 - DNA, 663 bp, Homo sapiens
  misc_feature: GYAE6OF01D4MO5.18.59.F04.1.454.CMB.1.raw
  modified_base (229)..(229): a, c, t, g, unknown or other
  misc_feature (229)..(229): n is a, c, g, or t
  modified_base (270)..(270): a, c, t, g, unknown or other
  misc_feature (270)..(270): n is a, c, g, or t
  modified_base (304)..(304): a, c, t, g, unknown or other
  misc_feature (304)..(304): n is a, c, g, or t
tcagtacgagtatgcacgaccggtgctcgatttagtacacacacttagggattggggggggtctcaggaggcagcgctctcgggacgtctccaccatggcctgggctctgctattccctcaccctcctcactcagggcacagggtcctgggcccagtctgccctgactcagcctgcctccgtgtctgggtctcctggacagtcgatcaccatctcctgcactggaaccngcagtgacgttggtgttaatactatgtctcctgtaccaacngccaccaggccaaacgccccaaatcatgatttangatgtactagtaactcggccctcgtacgggtttactaactcgcttctcgtcggtactaccgtaagtcgtacggacctaaccgaccggtcccttacccctagaaccctacgttaccttcgtacgggcccttaccgagggtaccgtacggtaacgggaacgtaacgggtccttagggtaacttttaacgtttaacgtggtcctaagtccttacgtaataacgtaacgacgtaccaccgtacgacctacttctacttaagttcgttaccgttaacgggaacgtacgggaaccgtaacggtcccgtaacccggttctaacgggtctaaacccggacccgtaaacggcccctaacccgttaccg

SEQ ID NO: 198566 - DNA, 648 bp, Homo sapiens
  misc_feature: GYAE6OF01BG92O.18.59.F04.1.454.CMB.1.raw
  modified_base (201)..(201): a, c, t, g, unknown or other
  misc_feature (201)..(201): n is a, c, g, or t
  modified_base (211)..(211): a, c, t, g, unknown or other
  misc_feature (211)..(211): n is a, c, g, or t
  modified_base (307)..(307): a, c, t, g, unknown or other
  misc_feature (307)..(307): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctggtctcctggacngtcgatcacntctcctgcactggaaccagcagtgacgttggtgttataactatgtctcctggtaccaacacgcaccaggccaaacgcccccaaatcatgatttacngatgtcactaactccggccctcgtagggtttctaacgtcgtcttactctcggctaccgaacgttcgtcggaccaaccgtaccggcccttcccctacggaccctactccgtcgtacgggtcctacccgacggtcgtcggaaggaccggtacggtcgtaggtaactttacgttacgtcggctacggtctactaatacgttaaccaacggtaccaaccgacgtacctaacgtcctacttacgtaccgtttccggtacccggtaacgttcggggtaaccctaacgggtcccgtaacccgttaccgttacggtaccacccggtacccgtaaaccggtaaccccccg

SEQ ID NO: 198567 - DNA, 767 bp, Homo sapiens
  misc_feature: GYAE6OF01B4LZV.18.59.F04.1.454.CMB.1.raw
  modified_base (237)..(237): a, c, t, g, unknown or other
  misc_feature (237)..(237): n is a, c, g, or t
tcagtacgagtatgcacgaccggtgctcgatttagtacacacacttagggagttgggggggggtctcaggaggcagcgctctcgggacgtctccaccatggcctgggctctgctattcctcaccctcctcactcagggcacagggtcctgggcccagtctcgccctgactcagcctgcctccgtgtcgtgggtcctcgtggacagtcgactcaccatcctcctgcacgtaggaaccngcagtgacgttggtagttaataactagtgtcttaccgtacggtaaccaacgtacgaccaaccgaggaaccaaaccgaccccaaactcaattagtaactttagagtatcgtactaacgtacgtccgtccgtacggttacgggtttacaacgttcgtacttcgtcgtacggtacctaccgtaaggttccgtacggtaaccaacgtacccggtaccccttacccgtacggtaaacccttcgttaccggttcggtccgggtacccttacgggacggtacggtaggaaacgggacggtaggtacgttaggttaacgtttaacgttacgtacggacctaacggtaccttaactaagttaaactaaccgaaccgacccgtaaaccgtacgtaaccttacctttacttacgttaacggttccgttaaccggttaacgggaaaccgggttacgggaaacccttacgggtaccctacccggttaacgtaccggtaccaacccggtaaaccccgaccggtaaacccccgtaaccgttaccg

SEQ ID NO: 198568 - DNA, 609 bp, Homo sapiens
  misc_feature: GYAE6OF01BTJL1.18.59.F04.1.454.CMB.1.raw
  modified_base (222)..(222): a, c, t, g, unknown or other
  misc_feature (222)..(222): n is a, c, g, or t
  modified_base (248)..(248): a, c, t, g, unknown or other
  misc_feature (248)..(248): n is a, c, g, or t
  modified_base (265)..(265): a, c, t, g, unknown or other
  misc_feature (265)..(265): n is a, c, g, or t
  modified_base (302)..(302): a, c, t, g, unknown or other
  misc_feature (302)..(302): n is a, c, g, or t
tcagtacgagtatgcacgaccggtgctcgatttagtacacacacttagggattggggggggtctcaggaggcagcgctctcgggacgtctccaccatggcctgggctctgctattcctcaccctctcactcagggcacgagggtcctgggccagtctgcctgactcagcctgcctcgtgtctgggtctctggacagtcgatcacatctctgcactggaaccngcagtgtacgttggtagttataactntcgtctctggtaccaangcctaccagaccaaacgccccaaagtcatgtacttangtatgtactacgtaacgtccgtcctacgtacgggtttactaacgttcgtacttacgtcgtggtacctacgtaagtcgtcgactaaccgaccgtaccttaccgcgactagtcctgtacggcctaccgaggtcgtacggacggtacgaggtaccttaggtaactttacttacgtaggtcctaggtcctataacgttactaaccgaacgcctaacgacttctactacgttctagtccgttacgtacggtacgacggtaccgacggtccgaccgttacggtacgtacgacgtaccgacgccctacctacgg

SEQ ID NO: 198569 - DNA, 731 bp, Homo sapiens
  misc_feature: GYAE6OF01D0TT9.18.59.F04.1.454.CMB.1.raw
  modified_base (499)..(499): a, c, t, g, unknown or other
  misc_feature (499)..(499): n is a, c, g, or t
  modified_base (709)..(709): a, c, t, g, unknown or other
  misc_feature (709)..(709): n is a, c, g, or t
tcagtacgagtatgcacgaccggtgctcgatttagtacacacacttagggattggggagctctgggagaggagccccagccttgggattcccaagtgttttcattcagtgatcaggactgaacacagaggactcaccatggagtttgggctgagcgtgtagtttcctaggctgacttaagttttaaaggtgtccagtgtgaggtgcagcgtgggtggagtcggtggggagtcgttagggtaaacggccggggggttcccttaggaccctccccgtgtacacgtcctctggtattcctactttcaaggtaacggtcctggatcgaaccgtgggtccgaccgacggcgtaccggaagggggacggggtctgggagggttcggggttcggaaccgttaaagttaaaaacccgaaagtggaagtagggtacgggaacaacgagtaacctacgtctgacccgtaccggtaggaaacgcagacttcgaactatacgtacgaaagnagttacgtaactaaaacaaaacgcacgttactagtaactcaacgaacgtaaactcggaaactcggaacttaacggaaccggaaaccgagaaccacggtacgttcgttatactaaccgtacgtaacccaaccgttacccgtaacccgtaaggtaacgtacccgttaaccctaaacttaccctaacccgtttaacggtaaccggtttaaccncgggtaacccgttaaccggggg

SEQ ID NO: 198570 - DNA, 513 bp, Homo sapiens
  misc_feature: GYAE6OF01EDM8L.18.59.F04.1.454.CMB.1.raw
  modified_base (433)..(433): a, c, t, g, unknown or other
  misc_feature (433)..(433): n is a, c, g, or t
  modified_base (508)..(508): a, c, t, g, unknown or other
  misc_feature (508)..(508): n is a, c, g, or t
  modified_base (510)..(513): a, c, t, g, unknown or other
  misc_feature (510)..(513): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaaactcatgatttatgatgtcactaatccggccctcaggggtttctaatcgcttctctggctcaagtctggcaacacggcctccctgaccatctctgggctccaggctgaggacgaggctgattattactgcagctcaatatacaagcaccagcactctctatgtcttcggactggacaaggtcaccgtctaggtcacgcccaacgcccaaccccnctgtccactctcgttccccgcccttcctccactacctcgtactcgacgccgggctggccaagggccgacagtagnannnn

SEQ ID NO: 198571 - DNA, 642 bp, Homo sapiens
  misc_feature: GYAE6OF01CLW0F.18.59.F04.1.454.CMB.1.raw
  modified_base (156)..(156): a, c, t, g, unknown or other
  misc_feature (156)..(156): n is a, c, g, or t
  modified_base (233)..(233): a, c, t, g, unknown or other
  misc_feature (233)..(233): n is a, c, g, or t
  modified_base (635)..(636): a, c, t, g, unknown or other
  misc_feature (635)..(636): n is a, c, g, or t
  modified_base (638)..(638): a, c, t, g, unknown or other
  misc_feature (638)..(638): n is a, c, g, or t
  modified_base (642)..(642): a, c, t, g, unknown or other
  misc_feature (642)..(642): n is a, c, g, or t
tcagtacgagtatgcacgaccggtgctcgatttagtacacacactttagggagttgggggctttgcctgggtcctgggcccagtctgccctgactcagcctgcctccgtgtctgggtctcctggacagtcgatcactatctcctgcactggaaccngcagtgacgttggtgttataactatgtctctgtaccaacagccaccaggacaaacgccccaaactcaatgtatttancgatcgtactaacttaatccgggccctcgtacggggtttactaactcgtcttctcgtcggcttacgaagtcgacggactaaccgccggtccctcctacgtacctctaccgtcgtcggccttccgacggtctacgggaacgggtacgaacggtcttagtaactttacgtacgtggactacgtctactaatactaacacgctaaccagcctacttctactacgttcgtcgtacgaacgtacggactaacggtccgtaccgtcgtacgtaccacgtcccgaacgaccctaacctactacgtacctaccttccgttacccgtccctacccgttaccctacgtacctacgtaccgtacgtacgaccgggtacggtccgtaagggcgtaaacgggctaacacgtcatnntncgtn

SEQ ID NO: 198572 - DNA, 708 bp, Homo sapiens
  misc_feature: GYAE6OF01BB8VF.18.59.F04.1.454.CMB.1.raw
  modified_base (242)..(242): a, c, t, g, unknown or other
  misc_feature (242)..(242): n is a, c, g, or t
  modified_base (354)..(354): a, c, t, g, unknown or other
  misc_feature (354)..(354): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctcgccctgactcagcctgcctccgtgtcgtgggtctccgtggactagtccgatccacctatcctcctgcctacgtacggaaccnggcaggtcggtacggtttggtagtttaactaacttattcgtcctccgtacggtaaccaacacgaccacccgaggaacctaaaccgaccccccaaatccaagtacgtatttanagtacttcgtactaacctaacgtcccggtacccttaggttacgggtttactaacgtccgtctttcctcgtcggccttaccgtagtccgacggaacctaccgtacccggcccttcccgtacgaccctacgtccgttccggtcgggtccctaccggtacggtacgtacgggaacgggtacggagttacgtagttactttacgtacctgacgtcgtactactaattaactaacgaacctccgaaccgtcgtaccctacttcgttacgtcgttacgtccggttaacggtaacgtccgggtaacctacggtccctaccggtcgtacgtccgaccgacccgacccgaccctaccgtaccg

SEQ ID NO: 198573 - DNA, 839 bp, Homo sapiens
  misc_feature: GYAE6OF01ESQA3.18.59.F04.1.454.CMB.1.raw
tcagtacgagtatgcacgaccggtgctcgatttagtacacacacttagggagttgggggggggtctcaggaggcagcgcgtctcgggacgtctccaccatggcctgggctctgctattcctcaccctcctcactcaggccacagggtcctgggcccagtctgccctgactcagcctgcctccgtgtctgggtctccgtggacagtcgactccaccatctcctggccacgtggaaccagcagtcgtacggtttggtaggttaactaaacgttgtcgttcctccgtaggtaacccaacgagcctaacccgaggaccgaaaaccgacccccctaaaatccgaattcggtaattttagtacgaagttaccgtacctaaccttaaaccgtcccggtaccctttacgggttaacggggtttttacttaaaacggttcctaccgtttaccgtccgttacggtacccgttaacccggtaacggtttccgttaacgggaccctaaacgtacccgggtcccctaccccgttacggacccttacgtccttacgtccgggtacccttacccggagttccgtagaacgggaccgtagggtcctacgttaacgttacgttacgcgggtactaacggtacctaactaacgttaagttaaacctaccggaaccctaccggtaacgtaaccctacgtttacccgtaacgttaacttacggttacccggttaacccggtaacgggttaaccgggtaaaccccggtacgggtttacccgacccgggtttacccgtaacgggttaccccggaacggtaacccccgtaaaacccgggtccccccaaacccggttaacccg

SEQ ID NO: 198574 - DNA, 844 bp, Homo sapiens
  misc_feature: GYAE6OF01EOMZC.18.59.F04.1.454.CMB.1.raw
tcagtacgagtatgcacgaccggtgctcgatttagtacacacacttagggattggggtctgggagaggagccccagccttgggattcccaagttgttttcattcagtgatcaggactgaacacagaggactacaccatggagtttgggctgagctggtattttccttgctgtcttaattttaaaggtgtccagtgtgaggtgcagcgtgggtggagtcggtgggggagtcgtttagggtaaacgggtcccgggggggttcccttaggacccttcccccgttagtaccacgtcctcgtggatttccacttttacgaggttaacggtccgtggtatacgtaacgttcgggtaccccgccgtacggccgtaccggaaggggggaacgggggcgttaggggtacggggttgggggtttacgggacccgtttaaacgtttaaaaaacccgaaaacgttcggtaaaggttggggtaacggggaaccaaacggtacggtaacccgttacggaccgtacggacccgaacccggttaaggaaaacggtcgaacgttacgttccaacctacgtacctaacgaaagagtaacttagtaacttaacgaaaacgctaacggtctagttactacgtagtaactaaagtacgaacacgtacccgtaagaaaccggaaccggtaaggaaccacgtaacggttaccgttacggttaattaccggttacctaaccctaccgtaaccttacccggtaaacgtaaccgttcccgttaaacctaaacctttaaccctaacccgttaaacggttaccgttaacggtacccggttacccggttaccgggtaccggggtaaaccccgg

SEQ ID NO: 198575 - DNA, 593 bp, Homo sapiens
  misc_feature: GYAE6OF01BMPBR.18.59.F04.1.454.CMB.1.raw
  modified_base (258)..(258): a, c, t, g, unknown or other
  misc_feature (258)..(258): n is a, c, g, or t
  modified_base (322)..(322): a, c, t, g, unknown or other
  misc_feature (322)..(322): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctcgccctgactcagcctgcctccgtgtctgggtctcctggacagtcgatccacatctctgcacgtcggaaccagctagtgtacgttggtagttataactntgtctccgtgtaccaacacgccaccacggaccaaaccgacccccaaactcatgtatttatgatntacactatccggcctgtacggtttactatcgtcttctcgtcgtctaccagtcgtacggacaaccgaccggtcctccctacgacctacttccgtcgtcgggtcctccgaggtcgtaggacggacgcggctagtactttatctgactcgtctatatactaacacgacacacgactaccttctacgtacgttcgttcgttacggtacggtacggtaaccgtaccggtccgtacccgtacgacgtaccacggacccgaaccgacccgaccctacg

SEQ ID NO: 198576 - DNA, 736 bp, Homo sapiens
  misc_feature: GYAE6OF01BK4CF.18.59.F04.1.454.CMB.1.raw
  modified_base (733)..(733): a, c, t, g, unknown or other
  misc_feature (733)..(733): n is a, c, g, or t
tcagtacgagtatgcacgaccggtgctcgatttagtacacacacttagggattggggagagagacccctcccctgggatcctgggcccagtctgccctgactcagcctgcctccgtgtctgggtctcctggacagtcgatcaccatctcctgcactggaaccagcagtgacgttggtgttataactatgtctcctggtaccaacagcacccaggacaaacgcccccaaatcatgtatttatgatgtacactaactccggccctcgtagggtttctaatccgtctttctcgtggtctccgaagtcctgggaccaaccgaccggtccccttcccgtacgaccctattccgtccgtcgggtacctccgaggtcctagggagggacgacggtctagtaatttacgttactgacgtacgacttacgaactaacgtaaccgaaacgacccaaacccgagtaccctaccttcccttaacttacgttcggtttacccgttaaccgggaacggttaccgggaaaccgttaaccgggtacctaaccccggttacccgtaacgggtacccaaccgggaccccgaaaccggtaccccccaaaccccgtacgttaccgtacccgttaccctttacccggttcccgttcccccccgtcccccttaacttcccccgtaacgttacccgttacccgttacgacgggtaccgggtccgggtacgtcggaaccgacgggtccaacgtatgntgc

SEQ ID NO: 198577 - DNA, 707 bp, Homo sapiens
  misc_feature: GYAE6OF01BVHG2.18.59.F04.1.454.CMB.1.raw
  modified_base (254)..(254): a, c, t, g, unknown or other
  misc_feature (254)..(254): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtcctcctggacagtcgatcaccatctcctgcactggaaccagcagtgacgttggtggtataactntgtctctgtaccaacagccaccagacaaacgcccccaaactcatcgtatttatcgatcgtactactaactccggtccctacgtacggggtttacctaacgtccgtcttctcgtcgggtccctaccgaacgtcgtcggactaaaccgacccgggtaccccttcccgtaccgaccctacttccgttaccgtcgggtccctaccgacggtcgtacgggaaggaccggtaagggtcttagtaagtttactacgtacgacacgtactacctaagttaactaacaaccgacctaacccgtacgtacctacctttcctacgttacgttacgttacccggtttaccgggaaaccggttccgggtaaccgtaaaccggttcccgtaaccccggtttaccgtaacgggtacccaccgggtaacccccgtaacccgggaaacccccgtaacccccgttaacccg

SEQ ID NO: 198578 - DNA, 652 bp, Homo sapiens
  misc_feature: GYAE6OF01AHQFF.18.59.F04.1.454.CMB.1.raw
  modified_base (231)..(231): a, c, t, g, unknown or other
  misc_feature (231)..(231): n is a, c, g, or t
  modified_base (250)..(250): a, c, t, g, unknown or other
  misc_feature (250)..(250): n is a, c, g, or t
  modified_base (255)..(255): a, c, t, g, unknown or other
  misc_feature (255)..(255): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgccatacggaaccngcagtgacgttggtgttanaactntgtctctggtaccacagccaccagacaacgaccccaaactcatgtattatgatcgtactactaacgtccggccctcgtacgggtttactaagtccgtcttctcgtcggtcctaccgaagtcgtcggacaaccgaccgtccctccctacgtacctagtccgtcgtggcctccgagcgtacggacgggacggtaggtactaggtaatttaccgttagtcgacgtacgtacctacgtaattaacaaccgtaacgacctaacccgagtaccctaccgtccttactacgttccttaccggttaacggtaccggtacgggtaacccgaacgggttaccctacccggttaccgtacggtaccgacccggaacccccgaaccggtacccccgtaaccccgtaccg

SEQ ID NO: 198579 - DNA, 696 bp, Homo sapiens
  misc_feature: GYAE6OF01CJ292.18.59.F04.1.454.CMB.1.raw
  modified_base (531)..(531): a, c, t, g, unknown or other
  misc_feature (531)..(531): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacgagggtcctgggcccagtctgccctgactcagcctgcctcgtgtctgggtctccgtggacagtcgatccaccattcctcctgacctacgtcgggaaaccaggaccgaggttcggtacgggttttggggtaggtttattaaaccttagtcgttccttccgtacggtaacccaaacgacgacccaacccgaaggaaccaaaccgaccccctaaatcatagtatttagtgtatgtactaagtacgtccggtacccgtggttacgggttactacgtcgtcttctcgtcgtcctacgagttcgtacggacctaacgccgtccctccgtacgacctgtcgtacgtggcctcggacgcgtaggacggacgtagctacgtattacgtcgtacgcgtacnctactacttacaacgacgacgaagaccacgtactaccgtaagtacgttcggttaacgggacgttaccgggaaccgtaaccggtcccgtaaacccggttccgtaacgggtacccaacccgggaaccccgtaaaccggtaaccccccgtaaccgtaaccggttcccg

SEQ ID NO: 198580 - DNA, 740 bp, Homo sapiens
  misc_feature: GYAE6OF01CQBPF.18.59.F04.1.454.CMB.1.raw
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgccctccgtgtctgggtctcctggacagtcgatccaccatctcctgcactggaaccagcagtgacggttggtaggttataactatgtctccgtggtaccaacagccaccgaggaccaaaccgacccccaaactcagtgtatttatgatgtacaactaactccgccctacgtagggttctaactcgtcttctctcggctaccgaagtcgtacggacaaaccgccgggtacccctcccgtacgaaccctattcccgtagtccgggtccttccggaagggtccgtaggaaccgggtacggaacgggtccgttaggtaacttttacgttaccgtacggacctaacgtccctaactaacttaaaccgtaaaccgaaccgtaccctaacccgtacgtaccccttaacttacccgttaaccgtttaaggttccggttaacccgtttaaacggggtaaacccggttcggggtaaacccgtaaaccgggttaccccgtaaccccggttaaccggttaccggtaacctaaccccgggaaccccgtaaaaccccgggccccctaaacccccgtacgg

SEQ ID NO: 198581 - DNA, 720 bp, Homo sapiens
  misc_feature: GYAE6OF01B0VBF.18.59.F04.1.454.CMB.1.raw
  modified_base (228)..(228): a, c, t, g, unknown or other
  misc_feature (228)..(228): n is a, c, g, or t
  modified_base (252)..(252): a, c, t, g, unknown or other
  misc_feature (252)..(252): n is a, c, g, or t
  modified_base (305)..(305): a, c, t, g, unknown or other
  misc_feature (305)..(305): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataactntgtctcctggtaccaacagcacccaggcaaacgcccccaaactcatgatttangatgtacactaactcgccctcgtagggtttctaatcgtacttctcgtgctacaagtctggacaaccgaccggccctccctcgacctatcctcgtcgggtcctccgacggtcgtaggacggaccggtaggccttagtaactttaacttacgtcgtaccgtaggtaccttacgtaattaaccgtaaaccaaacggtacccgaacccgtaccggtaccctaacccgttaccgttaccttaacgtttaccggttacccggtttaacccggggtaaacccggttacccgggggtaaacccgttaaaccggggttacccccgtaacccccggtttacccggttaaccggggttacccgaaacccgggaaccccccggtaaaacccggggtacccccccgtaaaccccccggttaaccccgg

SEQ ID NO: 198582 - DNA, 657 bp, Homo sapiens
  misc_feature: GYAE6OF01D2M91.18.59.F04.1.454.CMB.1.raw
  modified_base (442)..(442): a, c, t, g, unknown or other
  misc_feature (442)..(442): n is a, c, g, or t
  modified_base (469)..(469): a, c, t, g, unknown or other
  misc_feature (469)..(469): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcaacctgcctcgtgtcgtgggtcctcgtggactaggtcgatcacctatcctcgtgcacgtacggaaccagactaggtgtacggttggtaggttaataactatcgtctccgtaggtaccaacagaccaccgagacaaccgaccccaactcatgtattagatatagtactaagtacgtccgtacccgtagtacgggtttctaacgtcgtacttcgtcgtcgctacagtcgtacgaacacgacgtccctccgtagacctactcgtacgtcggtaccncgtcggacgtcggaggacggtacggtntagtacttacgttcgtcgtaccgacgttacgtagtacgacgtagtacggaggtacgttacggttagggttcgttacgttaggttggttaccgttacggttcgtacggttacgggaaccgtaacgggtccgttaaccggacgttaaggacccaccgggaacccaaccgtaccccgtacgtccgttaccg

SEQ ID NO: 198583 - DNA, 646 bp, Homo sapiens
  misc_feature: GYAE6OF01A5XLA.18.59.F04.1.454.CMB.1.raw
  modified_base (434)..(434): a, c, t, g, unknown or other
  misc_feature (434)..(434): n is a, c, g, or t
tcagtacgagtatgcacgaccggtgctcgatttagtacacacacttagggattgggggagctctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcgttgggtaaacggcccgggggggttcccttagaccttcccctgtacagcctcgtggattcactttcagtaaggcctggatgaacgtgggtccgccgaggctccgagggagggcgtggaggtgggtgcgtaataaaaccgaaagtgagtggtaggacaacgagactacgctgaccaccgtaggaaacgcagtactccacctatacctanaagatatagaacttaacaaaagccaacgtactagtactcgtagtaacaaatcgaaaccacgtccgtaagaaccggaaacccggaacggaaccaacgtacgaccggttattaacgtttactacgtaacccaacctaccgtcccctaggaaaccgtccgtaactaaaccgtacttaaccgtaaccgttaaggtacgtcggtacccgtaccgggg

SEQ ID NO: 198584 - DNA, 760 bp, Homo sapiens
  misc_feature: GYAE6OF01CZULC.18.59.F04.1.454.CMB.1.raw
  modified_base (236)..(236): a, c, t, g, unknown or other
  misc_feature (236)..(236): n is a, c, g, or t
  modified_base (268)..(268): a, c, t, g, unknown or other
  misc_feature (268)..(268): n is a, c, g, or t
tcagtacgagtatgcacgaccggtgctcgatttagtacacacacttagggagttggggggggtctcaggaggcagcgctctcgggacgtctccaccatggcctgggctctgctattcctcacccctcctcactcagggcacgagggtcctggcccagtctgccctgactcagcctgcctccgtgtctgggtctccgtggacagtcgatcacctatcctctgacacgtacggaaccngacaggttgtacgtttggtagttaataacgtntcgtcctccgtaggtaaccaacacgccaaccgaggaccaaaaccgccccaaaatcaatcgtaatttatgtattcgtactaactaacgtccggtcctaggttacgggtttaactaagtcgtcctttcgtcgtcggtctaccgtaagtcgtacggacctaaccggccggtaccctacccgtagaccctacgttccgtccggtacgggaccttaccgacgggtccgtaggggaacggtaacgggtacgtacgtttagttaacttttaacggttaccgtcgtaccgtaaacgtccttaacttaagttaaaccgtaaccgtaaaccgcccgaaacccgtactacccttaccttacgttaccgtaacgttttccggtacccgttaaacggggtacccggtaaccgggtaaacccgttaccggttaccctaccccgggttacccgttacgaacccgtaaccggtaacccccggaaaccgtccccccaacccgtttaccg

SEQ ID NO: 198585 - DNA, 645 bp, Homo sapiens
  misc_feature: GYAE6OF01AENEV.18.59.F04.1.454.CMB.1.raw
tcagtacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcgttaggtaaaggccgggggggtccttagactccccgtgtacacgcctctggattcactttcgagtaaggccgtggatgaactgggtccgccaggctccgaggggagggctgggagtgggttggaccgtaattaaaacccgaaatgagtggtgggacaacgagactacgctgccacccggtagaaacggcaagtacttccgaaccatcctacgaacgagacttaggaattacaaaaagcctaacggtcttggtaatccgttacgacctaaagttacgaactacggccgtaggaacggaaccggacggacacgtacgtcgttagtacttaccgtcgtaaccaccgtacctaccccgtaggaaccgtctaacgtaacctaccgttaacgtaccgtacgtacgtcggacctcggacgggtaacccgg

SEQ ID NO: 198586 - DNA, 532 bp, Homo sapiens
  misc_feature: GYAE6OF01BODWJ.18.59.F04.1.454.CMB.1.raw
  modified_base (273)..(273): a, c, t, g, unknown or other
  misc_feature (273)..(273): n is a, c, g, or t
  modified_base (299)..(299): a, c, t, g, unknown or other
  misc_feature (299)..(299): n is a, c, g, or t
  modified_base (309)..(309): a, c, t, g, unknown or other
  misc_feature (309)..(309): n is a, c, g, or t
  modified_base (428)..(428): a, c, t, g, unknown or other
  misc_feature (428)..(428): n is a, c, g, or t
  modified_base (476)..(476): a, c, t, g, unknown or other
  misc_feature (476)..(476): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctctggacagtcgatcaccatctcctgcactggaaccagcagtgacgttggtgttataactatgtctcctggtaccaacanccaccaggaccaaacgacccccaaancatgatttangatgtacagtaactccggaccctcgtagggtttctaatcgtcttctctggctacaagtctaggacacgacggccctcctcgacctatctcgtgggcctcgacggctacggacggacggngtctagtactttacttactgcagtctcatacacagcaccagcactctntagtcgtcgttcgacgtcggacacgtcaccgtcacggtacacgccgaacggacccc

SEQ ID NO: 198587 - DNA, 705 bp, Homo sapiens
  misc_feature: GYAE6OF01D1TPJ.18.59.F04.1.454.CMB.1.raw
  modified_base (215)..(215): a, c, t, g, unknown or other
  misc_feature (215)..(215): n is a, c, g, or t
  modified_base (235)..(235): a, c, t, g, unknown or other
  misc_feature (235)..(235): n is a, c, g, or t
  modified_base (264)..(264): a, c, t, g, unknown or other
  misc_feature (264)..(264): n is a, c, g, or t
tcagtacgagtatgcacgaccggtgctcgatttagtacacacacttagggagttggggggggtctcaggaggcagccgctcgtcgggtacgtctccacctatggtccgtggctctgctattcctacaccctctcactcagggcacgaggtcctggcccagtcttgcctgactctagctgcctccgtgtctggtctccgtggactgtcgatcaccngtctcgtgcactaggaaccngtctagtgtacgttggttagttataactntcgtcctcgtcgtaccaactacgacaccgaggaccaaacggcccccaaactcaactcggtaagtttactaggtacgttacgtaccgtacgtaaccgtccgtacccgttacggtaacgggttttacctaatccggttactttctacgttcgtactaccgtacgtcggtacgacccgaacgtaccgggtccttcctacgtacctactcgtcgtacggtcctacgacgtacgtaacgacggactacgtcttacgtaactttacgtacgctacgacgttacacgtaagtaacctaactaacggtaccctacgtactacttacgttccgttaagtttcggttacggttaccgtaccgtaacggtacggtaacccgttaggttacccgtaccggttaccgtacggtacccgaaccggtaccccgaaacggtccccaacccgttaccg

SEQ ID NO: 198588 - DNA, 806 bp, Homo sapiens
  misc_feature: GYAE6OF01BGHEW.18.59.F04.1.454.CMB.1.raw
  modified_base (801)..(801): a, c, t, g, unknown or other
  misc_feature (801)..(801): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggacaaacgcccccaaactcatgatttatgatgtccactaacgtccggcccttcgtaggggttttactaatcgtccttcgtctggccttaccgaagtcgtaggaccaacgaccggtccctccctgacctatcctcgtcgggcctccgaggtctaggaggaccgaggctagtaatttaacttacgtcgacgtacgtcctacgtaacttaacgtaaccaaaccggtacccaacccgtagtaccctaacctttcccttacctttaagtttccggtttaaccgttacccggggtaaacgttaccgggaaaccccgtaacgggtcccctaacccgggttacccgttaacgggtaaccccgaacccggtaaccccccgaaaccgggaccccccctaaacccccggtactttcccggaacccttaccccgtttaccccgttttccccgggttaccccccccgttccccctttaacccctacccgttaaccgttaaccccgtttacccgtaccgggttaaccgggaaccggggttccccggggtaccggttaacgggggaacccgtaaccggggacccttaccgtaaacggttaccgcaatccgngcacg

SEQ ID NO: 198589 - DNA, 573 bp, Homo sapiens
  misc_feature: GYAE6OF01BQ634.18.59.F04.1.454.CMB.1.raw
  modified_base (379)..(379): a, c, t, g, unknown or other
  misc_feature (379)..(379): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcctggtaccaacagccaccaggacaaacgcccccaaactcatcgtatttatgatgtacactaatccgccctcgtagggtttctaatcgtcttctctgctccagtctggacacgcgtcctccncgaccactctcgtcgggctccgaggctggaggacgaggctagtattattactgcacgtctacatactacaacgccaaccacgtcactcttacttatcgttaccgttacgggtaacgtcgggtaacccgtaacggtcccaacccggttccggtaacggtccaccggaccccaacggccccctaacccccgtaccg

SEQ ID NO: 198590 - DNA, 855 bp, Homo sapiens
  misc_feature: GYAE6OF01EXS99.18.59.F04.1.454.CMB.1.raw
  modified_base (643)..(643): a, c, t, g, unknown or other
  misc_feature (643)..(643): n is a, c, g, or t
  modified_base (716)..(716): a, c, t, g, unknown or other
  misc_feature (716)..(716): n is a, c, g, or t
  modified_base (725)..(725): a, c, t, g, unknown or other
  misc_feature (725)..(725): n is a, c, g, or t
  modified_base (748)..(748): a, c, t, g, unknown or other
  misc_feature (748)..(748): n is a, c, g, or t
tcagtacgagtatgcacgaccggtgctcgatttagtacacacacttagggattggggagctctgggagaggagccccagccttgggattcccaagtgtttcattcagtgatcaggactgaacacagagactcaccatggagtttggctgagctggtatttcctgctgacttagtttaaaggtgtcctagtgtgaggtgacgagtcgtggtggagtcggtgggggaggtcgttagggtaaacgggtcccggggggttacctacggtacctccccgtagtaccgacgtcctcgtaggtacttcctacgtttacgaaggtaacggccgtaggaactacggtaacgttccgggacccgtaccggtacggtccgtaccgggaagggggtaacggggtccgtaggggtaacggggttcggggttaaccgggtaaccgtttaaaacgttaaaaaccccggtaaaaaggtttcggtaaaggtttacggggggaacggtaaaccggaaacggtaacggtaaacccgtacggtcccgtttacggaaccccggtaacccgggtaaggaaacggtccgtaaacggtacttacccgaacttaacgtacgtaacccggtaaggtaacgtactaacggtaactaaaaccggtaaaacnccgtaacgtcgtaacgtaaggtacctacggaaactaatacgtaacgcgtaacgtagaacccgtaacccggaanaccgtaacnccggttaacgtatacgttaaccnccggttaaaccaacttaccccggtaacctaagggtaccggtacctaaacccgttaaccgtaccgttaaaccctcggttaaacccgtggttacccggcggtaaccggg

SEQ ID NO: 198591 - DNA, 888 bp, Homo sapiens
  misc_feature: GYAE6OF01D3VVP.18.59.F04.1.454.CMB.1.raw
  modified_base (198)..(198): a, c, t, g, unknown or other
  misc_feature (198)..(198): n is a, c, g, or t
  modified_base (237)..(237): a, c, t, g, unknown or other
  misc_feature (237)..(237): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacgagggtcctgggcccagtctgccctgactcagcctgcctccgtgtcgtgggtctccgnggacagtcgatccacctatctcctgctacgtcggaaccngctagtcgtacggtttggtagtttaactaacgttattcgtcctccgtacggtaaccaacgtacgaccaaccgaaggaaccaaaccgaccccctaaaactcgaatcgtaattttagagtacttcgtacgaacttaacgtcccgtccgttacggtacgggtttactaacgtcgtcttctcgtcggtctaccgtaagtcgtacggacctaaccgaccggtccccttacccgtacgtaacccttacgttccgttacccggtaccgggtaacccgtacccgggtacgggtacccggttacggggaaccggggaaccgggtacgggttaacccgttacggtttaaacgttttaaaccgttaacggttacggtacccgtacgttaacccgtttaacaaaccggtttaaaccttaaaaccggacgtaaacccccgtaaccgaaccgtaaccccgttaacccttaacgggtaaacccggttttacccggttaacgggtaacccggttaaaccgggggtaaaccccgttaaaccgggttaccccgtttaacccggggttaacccgttaaccccgggtaaacccggacccccggttaaaccccggaaacccccggtaaaccccggtttaaacccccccttgggttaaccccgttaaccccgg

SEQ ID NO: 198592 - DNA, 520 bp, Homo sapiens
  misc_feature: GYAE6OF01ANCZN.18.59.F04.1.454.CMB.1.raw
  modified_base (188)..(188): a, c, t, g, unknown or other
  misc_feature (188)..(188): n is a, c, g, or t
  modified_base (252)..(252): a, c, t, g, unknown or other
  misc_feature (252)..(252): n is a, c, g, or t
  modified_base (502)..(520): a, c, t, g, unknown or other
  misc_feature (502)..(520): n is a, c, g, or t
tcagtacgagtatgcacgaccggtgctcgatttagtacacacacttagggattgggggctttgtctgggtctcctggacagtcgatcaccatctcctgcactggaaccagcagtgacgttggtggttataactatgtctcctggtaccaacagcacccaggcaaaacgcccccaaactcatgatttangatgtcactaatccggccctcgaggggttttctaatcgcttctctggctccagtctggacaacnccggccctcctgaccatctcgtgggcctccaggcctgacggacgaggctgattattacctgcacgctcatactacaagccaccagccacctctacgtattcgtcttacggaacgtgggaaccaggtccacccgtccgtaggccacgaccccaacgccccaaccccatcgaccacttctcccgttccccgcccttcctacctactcctacgtacctcggacggtccggctcgggacacgggctcgaatcgnnnnnnnnnnnnnnnnnnn

SEQ ID NO: 198593 - DNA, 626 bp, Homo sapiens
  misc_feature: GYAE6OF01EHVSH.18.59.F04.1.454.CMB.1.raw
  modified_base (199)..(199): a, c, t, g, unknown or other
  misc_feature (199)..(199): n is a, c, g, or t
  modified_base (228)..(228): a, c, t, g, unknown or other
  misc_feature (228)..(228): n is a, c, g, or t
  modified_base (253)..(253): a, c, t, g, unknown or other
  misc_feature (253)..(253): n is a, c, g, or t
  modified_base (470)..(470): a, c, t, g, unknown or other
  misc_feature (470)..(470): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcgtggacngtcgatcaccatctcctgcactggaaccngcagtgacgttggtagttataactntgtctcctggtacaacagcaccaggacaacgccccaaactcatgatttatgatcgtacactaagtccgcctcgtagggtttactaatcgcttctacgtcggtactccgaagttcgtggaccaaccgaccggtacccttcccgtacgaccctacttcctacgtcggtcctaccgaggtcctaggacggacggacggtacgtagtatttattacgtcgnactctactataataacgtaacgacctacgacgacctacgttacctacttacgtcgttaccgttacggtaacgtacgggtaaccctaacgggttcccaaccgttcccgttaacggtccgaaccgaccccgtaacgggaccccctaaaccccgtaccg

SEQ ID NO: 198594 - DNA, 726 bp, Homo sapiens
  misc_feature: GYAE6OF01EXI6S.18.59.F04.1.454.CMB.1.raw
  modified_base (210)..(210): a, c, t, g, unknown or other
  misc_feature (210)..(210): n is a, c, g, or t
  modified_base (227)..(227): a, c, t, g, unknown or other
  misc_feature (227)..(227): n is a, c, g, or t
  modified_base (248)..(248): a, c, t, g, unknown or other
  misc_feature (248)..(248): n is a, c, g, or t
  modified_base (267)..(267): a, c, t, g, unknown or other
  misc_feature (267)..(267): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacgagggtcctgggcccagtctgccctgactcagcctgcctcgtgtctggtctcgtggacagtcgatcaccntctctgcactggaaccngcagtgtacgttggtagttanactatgtctctgtacaacngcaccaggacaaccgccccaaactcgtaatgtatttatacgtatcgtacaactaacgtcccggacccttacggttacgggttttactaagtcgtactttcgtcgttcggccttacgacgttcgcggtaccaacgaccggtccctcccgtacgaccctacgtccgttcgtacgggtccctacggaggtccgtaggacggaacggtacgggtaccttagggttaatttaacgttaccgtacgtaccgtacggtacttacctaagtaaccttaacgaaacccgaccgttaaccgaaccgttacctaacttaccgttaacctttaggtttaccggtttacccggttaaaccggggttactacccgggggtaaacccgttaccggttacccgtaacccgggttaccgtaccgggtacctacccgggaacccctaaacccccggtaccccgaacccctaacccgg

SEQ ID NO: 198595 - DNA, 594 bp, Homo sapiens
  misc_feature: GYAE6OF01AMWU9.18.59.F04.1.454.CMB.1.raw
  modified_base (591)..(591): a, c, t, g, unknown or other
  misc_feature (591)..(591): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagccaccaggcaaacgcccccaaactcatgatttatgatgtcactaatcggcctctaggggttctaatcgcttctctcggctccaagtctggcaacacggccctaccctgaccatctcgtcgggcctccgaggctggacgggtacggaggctagtatttaacttcaggcagctacatatacaagccaacagccactcctctagtcgtacgttcggaacgtacggaccaaggtccaccgttccgacggtaccaccggacccaacggtaccccaacccgtactaccgtcctaccgttaccttccgttccccggaccccttcccgtaccgtactaaccgttccgttacgcggtaacggccgggcgttcgggaacgtacggccgtacaagttcgcagcntgc

SEQ ID NO: 198596 - DNA, 750 bp, Homo sapiens
  misc_feature: GYAE6OF01DMK9E.18.59.F04.1.454.CMB.1.raw
  modified_base (281)..(281): a, c, t, g, unknown or other
  misc_feature (281)..(281): n is a, c, g, or t
  modified_base (467)..(467): a, c, t, g, unknown or other
  misc_feature (467)..(467): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcgagggcacgagggtcctgggcccagtctcgccctgactcagcctgcctcgtgtcgtggtctcgtagacaggtcatccaacctctccgtacctgaccacgtacggaaccaggacctaggtggtacggtttgggttacgttaataacttntcgtctcgttacgaacaacacggaccaccgaggaacaaccgacccctaaactactagttagtatttagtgaattcgtactaacgtaacgtcccgtaccgtacgttaacgggttactaacgtcgtcctttccttcgtacggttacctaacgtacgtcgtcggaacaccggtaccgtcctaccgtacncctattcgtcgtccgcgttcgacggtcgtacgggacgaacggtacggttacgttacggtatttaaacgtcgtcacggttacacttactaagttacaaaccgcaccacgaacgtcctaacgtttcctatttaccggtttagtaccggttaacccggtaaacgggttacccggttaaaccggtaacggttaacccgttaccccgggtaaccgtttaacccggggtaacccgtaaccccgggttaaacccccaacccgggtaaacccctaacccccgttaaccggg

SEQ ID NO: 198597 - DNA, 741 bp, Homo sapiens
  misc_feature: GYAE6OF01DZ1P8.18.59.F04.1.454.CMB.1.raw
  modified_base (232)..(232): a, c, t, g, unknown or other
  misc_feature (232)..(232): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtcctcctggacagtcgatcaccatctcctgcactggaaccngcagtgacgttggtagttataactatgtctcctggtaccaacagacacccgaggacaaaccgacccccaaactccatgtaatttatgtattacgtctaactaacgtccggtcccttacggtaggggttttactaagtccgtacctttcgtacgtcggtccttaccgtaaacgttccggtacgacccaaaccgtacccggtccccttaccccgtacggaacccctacgtttccgttaccggttccgggggccttacccgggaacggtccgttaacggggacgggaccggtacgggtccttaaggttaatttacgttaccgtggcgaacgtctacttaactaacgtaaactaacgaccgaacctaccgacctaaccctttctaccttaggttccgtttaacccggttaccgggtaaacgttacccggggtaaccggtaaccgttacccgtaccccggttaccggttaaacgggtacccgaaccccggacccgaacccgggtaaaccccccc

SEQ ID NO: 198598 - DNA, 724 bp, Homo sapiens
  misc_feature: GYAE6OF01BFUJF.18.59.F04.1.454.CMB.1.raw
  modified_base (714)..(714): a, c, t, g, unknown or other
  misc_feature (714)..(714): n is a, c, g, or t
tcagtacgagtatgcacgaccggtgctcgatttagtacacacacttagggattggggggggtctcaggaggcagcgctctcgggacgtctccaccatggcctggctctgctattcctcaccctcctcactcagggcacgagggtcctgggcccagtctcgccctgactcagcctgcctcgtgtctgggtctcctggacagtcatcaccatcctcctgcacgtacggaaccagcaggtgtacggttgggttagttaataactattcgtctccgtacggtaacccaacacgaccaaccgacggaccaaaacccggacccccaaaactcaacgtagttaactttagtacgattcgtaacctaacgttaaccgtcccggtacccgttacgggtttacgggttttaccttaacgttccgtaccgtttaccgtccgtacggtaccctaccgtaacgttccgtacggaaccaacccgtacccggtcccctccgtacaccctcttaccgtccgtcgggaccctccgtaggtccggtagggacggtaacggcggtacgttagtaactttacgtaccgtgtaccacgttactactaactactaacgacggtaccaacccgtagccttactcttacttgttaccgttccggtaacggtacgtacgggacgttaccggtcccgtaaccgtcgtacgtacccgaccgtaacccgaacccgtaacccncccgtaaccg

SEQ ID NO: 198599 - DNA, 931 bp, Homo sapiens
  misc_feature: GYAE6OF01BLY78.18.59.F04.1.454.CMB.1.raw
tcagtacgagtatgcacgaccggtgctcgatttagtacacacacttagggattgggggggagaggagccccagccttgggattcccaagtgttttcattcagtgatcaggactgaacacagaggactcaccatggagtttgggctgagctggtattttccttgctgtcttaagttttaaaaggtgtccagtgtggaggtgcagtcgtgggtgggagggtccgggggaggtcgttcggtccaggtccggtcgggggtccctacgtaaactccgtccgtgtcgcgacgccttcggttcgggttcctaccgttcgtacggttcggtccttcgttcgtcttaagtcggtaccgtacggtttccgggtccccggaccggtacgggtacccggggttaaccgggggaaacgggtcggtagggggtagggttcggggttacggtaccggttaagttaacgggaaacgtacggaaaacgtaccgttaaacgtacggttaccgacggtaacgagtacgtaagttacgtcggtcgtacgggtacggtacgggtaacggaaacggtccggttaaccgttccgtaacccgttacgtaaccgtaaagtaacgtaagtaaccgttaaacgaaacgtaaccggaccggttacgtaacgttacgtaacgaaaccgttaagtaacggtaacgaccgtaaccgtaaaccggtaaaccgggacccggtaaaccggttaccggtaccggtttaaagtttaccggtttaacgaacccggttaacgtaaacgggtaacgggttaagggttaacggtttaaaccggtttaagggtttaacgggggtttaacgggggttaaccgtttaaacgggggtacccgggggttaaaccgggggggttaaaacccgggggtttacgtttaaccggtaaccgggttaaaccggttacggggg

SEQ ID NO: 198600 - DNA, 829 bp, Homo sapiens
  misc_feature: GYAE6OF01AJFU9.18.59.F04.1.454.CMB.1.raw
  modified_base (154)..(154): a, c, t, g, unknown or other
  misc_feature (154)..(154): n is a, c, g, or t
tcagtacgagtatgcacgaccggtgctcgatttagtacacacacttagggattggggagctctgggagaggagccccagccttgggattcccaagtgttttcattcagtgatcaggactgaacacagaggactcaccatggagtttgggctganctggtattttccttgctgcttatttaaaggtgtccagtgtagaggtgcgtagtcgtgggtagggtagtcggtaggggggtaggtacgttaggggtaaacgggtcccggggggggttacccttaggtaccctccccgtaggtaccgtacggtccgtgttcggtaaccttctaccttttacgaacggttaacggccgttagggaactacggttaaccgtcggggtccccgtaccggtacggtccgtaaccgggacgggggtaaacggggtccggttaggggtacggggttcggggttacgggtaacccgttaaaacgtaaaaacccgtaaagtaccggtagggtagggtacgggaccaaacggtacgtactaccggcgtacgacccgtaccgggtaaggaacggtacaacggtactaccgaaccttagtaccaacgtaaggagtaatcgtaaataagaaaaccgtcacggtattagtactagtacgaaaccttaagacgaaaccgttggaaccgttacgaacgggtaacccgacgtaaaccgaacgtcccggtacggttaattaacccgtactaccgtaaacctcccgtaaaccgttaccgagtaaacccgcttaacccgtaaaccttaccggtaaaccttaacggttaccgtaacggttaccgtcgtaacccgggg

SEQ ID NO: 198601 - DNA, 702 bp, Homo sapiens
  misc_feature: GYAE6OF01AQN2D.18.59.F04.1.454.CMB.1.raw
  modified_base (234)..(234): a, c, t, g, unknown or other
  misc_feature (234)..(234): n is a, c, g, or t
  modified_base (260)..(260): a, c, t, g, unknown or other
  misc_feature (260)..(260): n is a, c, g, or t
  modified_base (551)..(551): a, c, t, g, unknown or other
  misc_feature (551)..(551): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctcgccctgactcagcctgcctccgtgtcgtgggtctccgtggacagtcgatccaccatcctcctgcactggaaccngcagtgtacgttggtgttaataactntgtctctcggtaccaacagcaccagacaacgacccccaaactcatgtatttatagatgtacaactaacgtccggtccctacggttacggggtttactaacgttcgtctttcgtcgtcggccttaccgtaacgttcgtcggaccaaccgacccggtcccttaccccgtacgaccctacgttccttcggtcgggtcctaccgacggtcgttaggaacgggacggtaggtctaggttaatttaacttacgttcgacgtacgtcctacaagttaacaacgtaaacgcctaaaccncgtacctaccttaccttacttacgttaccgttccgttaaccgggtaaccgtaccggggtaaaccgaaacgggttccccgtaacccggttccggttaccggttaaccgaacccggacccgaaacccggtacccccgaaaccccgttaacccg

SEQ ID NO: 198602 - DNA, 543 bp, Homo sapiens
  misc_feature: GYAE6OF01EK4G8.18.59.F04.1.454.CMB.1.raw
  modified_base (228)..(228): a, c, t, g, unknown or other
  misc_feature (228)..(228): n is a, c, g, or t
  modified_base (252)..(252): a, c, t, g, unknown or other
  misc_feature (252)..(252): n is a, c, g, or t
  modified_base (301)..(301): a, c, t, g, unknown or other
  misc_feature (301)..(301): n is a, c, g, or t
  modified_base (473)..(473): a, c, t, g, unknown or other
  misc_feature (473)..(473): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataactntgtctctggtaccacagcaccaggcaaacgccccaaactcatgatttangatgtacactaatcgccctgagggtttctaatcgtcttctcgtggctacaagtcgtgacaacgacggcctccgcaccattctcgtcggtcctccgaggtcgtggacggacgaggctagtatttaattacgtgactacgtctacgtataactaacgacgcaccagcctatctntatcgtctacggaacgtcggaacgacgtccgtaccgtcgtacgtcgacgacccgaacgcccaaccctacg

SEQ ID NO: 198603 - DNA, 528 bp, Homo sapiens
  misc_feature: GYAE6OF01AU060.18.59.F04.1.454.CMB.1.raw
  modified_base (479)..(479): a, c, t, g, unknown or other
  misc_feature (479)..(479): n is a, c, g, or t
  modified_base (522)..(522): a, c, t, g, unknown or other
  misc_feature (522)..(522): n is a, c, g, or t
  modified_base (525)..(528): a, c, t, g, unknown or other
  misc_feature (525)..(528): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaaacgcccccaaaactcatgatttatgatgtcactaatcggccctcgtaggggtttctaatcgcttctctggctccaagtctggcaacacggcctccctgaccatcctcgtggcctccgaggctgaaggcgaggctgtattattactgcagtctcaattactacaaagccaccacgcactctctattcgtcgttacggaacgtagggaaccgtaggtcctaccgtctacggcacgacccacggacccaacccatcgcacctctccgtcccnccctcctcactcgtctcgcgcggcggctggcaggcctcgatcngannnn

SEQ ID NO: 198604 - DNA, 780 bp, Homo sapiens
  misc_feature: GYAE6OF01DU99U.18.59.F04.1.454.CMB.1.raw
  modified_base (208)..(208): a, c, t, g, unknown or other
  misc_feature (208)..(208): n is a, c, g, or t
  modified_base (245)..(245): a, c, t, g, unknown or other
  misc_feature (245)..(245): n is a, c, g, or t
tcagtacgagtatgcacgaccggtgctcgatttagtacacacacttagggagttggggggggggtctcaggaggcagcgctctcgggacgtctccaccatggcctgggctctgctattcctcaccctcctcactcagggcacgacgggtcctcgggcccagtctcgccctgactcacgcctgcctcgtgtcgtgggtctccgtggacngtcgactcaccacttcctcctgctacgtacggaaccngcgaggttcggtacggttgggttagttaactaactacgttcgttccttccgtacggtaaaccaacgacgaccaaccgaacgaaccaaaccgtacccccaaactctacgtagttaactttagagtattcgtacgtaacgttacgtccggtaccgttacgggttaggttactacgttcgtcttacgtcgtcggacctacgtacgtcgtaccgggtaaccaacccggtcccggtacccttaccgtaccgtacccgtacttccggtaccgttcgggtacccgtacggacgggtcggtacgggaacggtaccggtaggtacttacgttaactttacgtacgcgtacgtaacgtctaactaacgtaccgtaaagacgtcgtaacgactaacgtacgttaacgtaccgttacgttccgggtaaaccgtaaacgggtaccggtaacccggtaaccggttacccggttaaccgtacccgggtaaacgcccgtaaaaccccgggacccggtaaaaccccggtcccctaaacgtcccgggttaacc

SEQ ID NO: 198605 - DNA, 903 bp, Homo sapiens
  misc_feature: GYAE6OF01CT73L.18.59.F04.1.454.CMB.1.raw
tcagtacgagtatgcacgaccggtgctcgatttagtacacacacttagggattggggagctctgggagaggagccccagccttgggattcccaagttgttttcattcagtgatcaggactgaacacagaggactcaccagtggagtttgggctgagctggtattttcctgctgtcttaagttttaaaggtgtcctagtgtggtaggtgctgcgtgggtggacgtcgggtgggggaggtcggttaggggtaaacggggtcccgggggggttacccttaacggtacccgttccccgtgtaccgacgtccgtcgtggtacttctactttacgagtaacggcgtaggatcggtaacgtccgggtccgccgacggtccgtaccggaagggggacggggtcgtagggtacgggttcgggggtacggtaaccggtttaaaacgttaaaaacccgtaaaggtacggaagggttacggggtacggaaaccaaacggtaacggtaaccctacggtaccgttccgggaacccgtaacccgggttaacggaaacggtccgtaaaggttacccttacgaacccctagtccgtaaacaagggtaacttacgtaacggtaaacttaaaccgaaaaggtcctaacgtacgttacgttaactacccgggttaataaaccgaaagtttacccggaaagccgggttaacccgaagggaaaaccccgaacccgggaaacggacccgaaaccggttacggttaacccgtttagtaaaccgtttacccccggtaaactaccccctaaaacccgcccgtttaaacccggaaagttacccggaacccgttaaacccctaaaccgtttaccgttaaacccgttaacgtaagggtttaaccgtaccggttccgggtaaacccccggggg

SEQ ID NO: 198606 - DNA, 787 bp, Homo sapiens
  misc_feature: GYAE6OF01E3KKZ.18.59.F04.1.454.CMB.1.raw
  modified_base (240)..(240): a, c, t, g, unknown or other
  misc_feature (240)..(240): n is a, c, g, or t
  modified_base (781)..(781): a, c, t, g, unknown or other
  misc_feature (781)..(781): n is a, c, g, or t
  modified_base (784)..(785): a, c, t, g, unknown or other
  misc_feature (784)..(785): n is a, c, g, or t
tcagtacgagtatgcacgaccggtgctcgatttagtacacacacttagggattggggagagagacccctcccctgggatcctgggcccagtctgccctgactcagcctgcctccgtgtctgggtctcctggacagtcgatcaccatctcctgcactggaaccagcagtgacgttggtgttataactatgtctctggtaccacagccaccaggaccaaacgccccaaatcatagtatttangactcgtactacttaacgtccggtccccttacgtaaggggttttacctaaacgttccggtcctttaccgtcgtacggtaccttaccgtaacgttccgtacggacccaaaccggtacccggtccctacccggtaccaacctcgttaccgttccgggtcggtaccccgttaccggacggttacggtaacgggaaccggttaacgggaccgttacgttacgttaacttttaaaccgtacgtacgacgtaacgtaccctacgtaaactaaacgtaaccgaaccgtaacccaccgtaacgtaccctacttaccgttaacgttacgttaccgtttaccggttaaccggtaaccggaaccggttaaccgtaaccgtaccgtacccgtacgtaccgtacccgaacccgaccgtaccccgaaccctacccgtacgtccgtacccgtacccttccgttcccccgtccccttaccctaccgttacctaccgtaccgtaccggtaacgtcgggtaccggtccgggtcgtacggaacgtccgggtacaacgtancgnngc

SEQ ID NO: 198607 - DNA, 606 bp, Homo sapiens
  misc_feature: GYAE6OF01CNI5L.18.59.F04.1.454.CMB.1.raw
  modified_base (252)..(252): a, c, t, g, unknown or other
  misc_feature (252)..(252): n is a, c, g, or t
  modified_base (308)..(308): a, c, t, g, unknown or other
  misc_feature (308)..(308): n is a, c, g, or t
  modified_base (489)..(489): a, c, t, g, unknown or other
  misc_feature (489)..(489): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactntgtctcctggtaccaacagccaccaggacaaacgacccccaaactcatgtatttangtatgtcaactaatccggccctacgtaggggttttctaactcgtcttctcgtggctaccaagtctggacaacgtacggccctccctcgaccatcgtctcgggcctccgacggtcgtaggacggtacggaggcttagtatttaattacgtgcacgctcaattaacaacaacgccaaccgacncacctctcttactcggttaccttacgggtaacgtacgggacccgtaaacggtccgtaccccgttaccgtacggttaccaacggtacccccgaacgggacccccaaaccccgtacccg

SEQ ID NO: 198608 - DNA, 704 bp, Homo sapiens
  misc_feature: GYAE6OF01AJBEL.18.59.F04.1.454.CMB.1.raw
  modified_base (277)..(277): a, c, t, g, unknown or other
  misc_feature (277)..(277): n is a, c, g, or t
  modified_base (314)..(314): a, c, t, g, unknown or other
  misc_feature (314)..(314): n is a, c, g, or t
  modified_base (696)..(696): a, c, t, g, unknown or other
  misc_feature (696)..(696): n is a, c, g, or t
  modified_base (699)..(699): a, c, t, g, unknown or other
  misc_feature (699)..(699): n is a, c, g, or t
  modified_base (703)..(703): a, c, t, g, unknown or other
  misc_feature (703)..(703): n is a, c, g, or t
tcagtacgagtatgcacgaccggtgctcgatttagtacacacacttagggattgggggctttgcctgggtcctgggcccagtctgccctgactcagcctcgccctccgtgtctgggtctcctggacagtcgatcaccatctcctgcactggaaccagcagtgacggttggtggttataactatgtctcctggtaccaacagcacccaggacaaacgacccccaaactcatgatttatgatgtcactaatcggccctgtagggtttctaatcgcttcnctggctcagtctggacaacgcggccctccctgacccntctcgtcgggcctccagggtctggaacgggacgagggtcctagtactttattacgtcgcgagtcctataagtaactaaccgaaacgccctaacccgacgtacctacctttacctacttaacgttcggtttacccgtttaaccgggtaaacccgggttaccggggtaaacccgtaacggggtcccgtaaccccggtacccgttacgggtaccgacccgtaacccccgaaacccggtaccccccaaccccgtacctccgttacctacccgttacccgttcccggttcccccccgtaccccttccccgtaccctaccttacccggtaccgtaccgtcgggacgggtcccgggtccgtacgggaccggacggccgactacgtacgntanctgnc

SEQ ID NO: 198609 - DNA, 621 bp, Homo sapiens
  misc_feature: GYAE6OF01BLNGI.18.59.F04.1.454.CMB.1.raw
  modified_base (483)..(483): a, c, t, g, unknown or other
  misc_feature (483)..(483): n is a, c, g, or t
  modified_base (495)..(495): a, c, t, g, unknown or other
  misc_feature (495)..(495): n is a, c, g, or t
tcagtacgagtatgcacgaccggtgctcgatttagtacacacacttagggagttggggggggtctcaggaggcagcgctctcgggacgtctccaccatggcctggctctgctattcctcacctctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggacaaacgcccccaaaactcactagtatttatcggatgtacactaaactcggacccttcgtaggggtttacctaagttcgacttcgtactcggctccgtaagtcgtcggaccaacgacggcccttaccctacgacctacttcctacgtcgggtacctccgaacgggtctaggaacggacgaacggtcgtagtaactttattaaccngccgagccttanaagttaatacaaacggcaaccagacctactctacgtagttcgttacgttcggaacgtcgggaacctaacgggtccaaccggttccgtaggtaccgacggtaccccaacggccctaaaccccgtacg

SEQ ID NO: 198610 - DNA, 521 bp, Homo sapiens
  misc_feature: GYAE6OF01BHCE4.18.59.F04.1.454.CMB.1.raw
  modified_base (226)..(226): a, c, t, g, unknown or other
  misc_feature (226)..(226): n is a, c, g, or t
  modified_base (352)..(352): a, c, t, g, unknown or other
  misc_feature (352)..(352): n is a, c, g, or t
  modified_base (441)..(441): a, c, t, g, unknown or other
  misc_feature (441)..(441): n is a, c, g, or t
  modified_base (487)..(487): a, c, t, g, unknown or other
  misc_feature (487)..(487): n is a, c, g, or t
  modified_base (507)..(507): a, c, t, g, unknown or other
  misc_feature (507)..(507): n is a, c, g, or t
  modified_base (511)..(511): a, c, t, g, unknown or other
  misc_feature (511)..(511): n is a, c, g, or t
  modified_base (514)..(521): a, c, t, g, unknown or other
  misc_feature (514)..(521): n is a, c, g, or t
tcagtacgagtatgcacgaccggtgctcgatttagtacacacacttagggattgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaacgcccccaaaactcatgatttangatgtcagtaatccggccctgtagggtttctaatcgcttctctggctccaagtctggcaacacggccctcctcgacctatctcgtcgggcctccgaggctggaggacggaggctgtattattacgngcagctcatatacaagcagcagcactcgatcgtcggaacgtcggaaccgaagtccaccgtctacggtcacgacccaacggcccaacccnctcgtcaccttcctccgttccccacctaccctctactcctcgtacncgcgcggctcggacacggcnatgncgnnnnnnnn

SEQ ID NO: 198611 - DNA, 760 bp, Homo sapiens
  misc_feature: GYAE6OF01CQNIL.18.59.F04.1.454.CMB.1.raw
  modified_base (294)..(294): a, c, t, g, unknown or other
  misc_feature (294)..(294): n is a, c, g, or t
  modified_base (326)..(326): a, c, t, g, unknown or other
  misc_feature (326)..(326): n is a, c, g, or t
tcagtacgagtatgcacgaccggtgctcgatttagtacacacacttagggagttgggggggagaggagccccagccttgggattcccaagtgttttcattcagtgatcaggactgaacacagaggactcaccatggagtttgggctgagctggattttccttgctgtctattttaaaaggtgtccagtgtgaggtgcagctgggtggagtcgtggggggaggtcgttagggtaaaggcccggggggggttacccttaggaccttccccgtgtaccagcctgtggattcactttnagtaacggcctaggataggaacgttcgggccncacggctccggaggggaaggggctagggaggttggggttacggaccgtaaattaaaacccgaaactggacgttgggtacggacaacgacgaactacggcctcgaccgtaacccggtaggaaaacggctaaagacgtttacccaactacttaccgaacgtaaagaacggtataacgtaaactttaacgaaaaacgtaccgaacgtactacgttaacttatacggtaacaaacgttacgaaacgtacgtaccgtaacggaacgaaacccggaaggaaccacggtaacgtaccggttacgttactttaacgttaccgtaacctacctaaccgtaccccgaaagtaaccgtaccgtaacctaacttaaccttaccgttaaccgtaacggttaacgtcggtaaccgtccggtacgggacccggtaacgggtaaccccgg

SEQ ID NO: 198612 - DNA, 595 bp, Homo sapiens
  misc_feature: GYAE6OF01BXSFU.18.59.F04.1.454.CMB.1.raw
  modified_base (231)..(231): a, c, t, g, unknown or other
  misc_feature (231)..(231): n is a, c, g, or t
  modified_base (337)..(337): a, c, t, g, unknown or other
  misc_feature (337)..(337): n is a, c, g, or t
  modified_base (587)..(587): a, c, t, g, unknown or other
  misc_feature (587)..(587): n is a, c, g, or t
  modified_base (592)..(592): a, c, t, g, unknown or other
  misc_feature (592)..(592): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggccaaagcccccaaatcatgatttangactgtcactatcggcctgagggtttcaatcgcttctctggcctcaagtctggacaacgacgcctcctgaccatctcgtgggccttccgaggctaggacgggacgngtactgtacttattactgcacgctacgaatatacgtaagcctaaccagccacgtctactaagtcgtcgttacggaacttcggtaaccaaggtccaaccgtcgtaggtccacgacccgtaacgaccccaaccctacgttcgacctaccttccgtaccgttcccccgcccttacccgtacccacgttaccgtaccgttacgacggtcgggtaccgggtcttacgggacgaacgggtccgacttaaagtcgcngctgntcg

SEQ ID NO: 198613 - DNA, 978 bp, Homo sapiens
  misc_feature: GYAE6OF01CD4RN.18.59.F04.1.454.CMB.1.raw
tcagtacgagtatgcacgaccggtgctcgatttagtacacacacttaggggagttggggggggagaggagccccagccttgggattcccaagtgttttcattcagtgatcaggactgaacacagaggactcaccatggagtttcgggctgagctggattttccttgctgcttaattttaaaaggtgtccagttgtggaggtgcgagcgtggtggagtcgtgggggaggtcgttagggtaaacgggtcccgggggggtcccttacggacccgtcccccgttagtaaccgtacggtcccttcgtcggtacttccgtaccgttttacgaacggtaaacggtcccgtgggtaacttagggtaaaccggttcgggggttccccgacccggtaagggtcccgttaccccgggaaaggggggtaaaccggggggtcgtttagggggtaacgggtttggggggtttacgggtaaccccgggtttaaaagttttaaaaaaaccccgaaaaacggttacggtaaacgggttacggggttaacgggggaaacccgaaaaccgtaacggtaacccgttaaccgggtaccgttaccggtaccccgtaaaccccggggttaaggaaaaccgggtaccgtaaaccggtaacgtttaccccgaaacccgtattaacccgtaccgtaaaagggtaaccggtaattacggtaaaacgtttaacccgaaaaaacgggtccctaaacccggggttacttaacggttaacgtttaccgtaacggtaaccgtaaaaggttacgaaacccgtaggtacccgttaagggaaccggtaaaccggacgggtaaccaaccgggacgtaccgggttaattaacgtttaacgtaccgtaacctaccgtaccgtacccgtaagaacgtacccgtactaaccttaacgtacctaacggttacgtacgtaccgtaccgttacgggaccggtaccggtaacgggtaacccg

SEQ ID NO: 198614 - DNA, 815 bp, Homo sapiens
  misc_feature: GYAE6OF01ERG5H.18.59.F04.1.454.CMB.1.raw
  modified_base (230)..(230): a, c, t, g, unknown or other
  misc_feature (230)..(230): n is a, c, g, or t
  modified_base (273)..(273): a, c, t, g, unknown or other
  misc_feature (273)..(273): n is a, c, g, or t
  modified_base (311)..(311): a, c, t, g, unknown or other
  misc_feature (311)..(311): n is a, c, g, or t
tcagtacgagtatgcacgaccggtgctcgatttagtacacacacttagggattgggggctgggggtctcaggaggcagcgctctcgggacgtctccaccatggcctgggctctgctattcctcacctcctcactcaggcacagggtcctggccctagtctcgccctgactcagtcctgcctcgtgtcgtggtctcctggactagtcatcaccatctctagcacgtgaccngcagtgtacgttgtagtatactatgtctccgtagtaccgaacncgccaccgaggacaaccgtccccaatcatagtattacngtatgtactatactccgtccgttagtacgggttactaacggttcctctttcgtactcggtctaccgacgttcgtacgaaccgtacccgtaccggtacccctccgaaccgtactaacccgtttccgttaccggtcggtacccgtttcccgggaacgttaccgggtacgggtaacggtaccgggtacggtacgtttaacggttaactttaacgtttaacgttccgtaacggtaaccgtttcctaaccgtaaacttaaccggttaaacccgtaacgttaaccccggaaacctttaaccgggacccccttaacttaacccgtttaccgtttaaaaccgttcccccggggttttaaaccggtttacccggggtaaaaccgggggtttaccccggtaaaccccggtaacgggtttaaaaccccggtccccggtttaaacccggttaaacccggggtacccctaaaccccgggggtaaacccccttaaacccccggggtaaacccccccgg

SEQ ID NO: 198615 - DNA, 779 bp, Homo sapiens
  misc_feature: GYAE6OF01BFQBI.18.59.F04.1.454.CMB.1.raw
  modified_base (313)..(313): a, c, t, g, unknown or other
  misc_feature (313)..(313): n is a, c, g, or t
tcagtacgagtatgcacgaccggtgctcgatttagtacacacacttagggagttgggggggggtctcaggaggcagcgctctcgggacgtctccaccatggcctgggctctgctattcctcacccttcctcactcagggcacgagggtcctcgggcccaggtcctggccctgacctcacgcctgcctcggtgtcgtgggtctccgtggactagtcgataccacactccgtcctgaccgacgtacggaaaccacgcgtaggtacgtacggttggttacgttaataacttgtcgttactcgtacggtaaccaacncggaccaaccgacggaaccaaaaccggacccccctaaaagttccaagttacgttaactttagtaggtacgtcggttaacgaacgttaaccggttcggtcccttaagggttacgggtttaacctaacgttcggtacctttacggttcgacgtacccgttacaacggtttccgtacggaaccgtaaccgcccggttcctaccggtactaaacctcgtttaccgtcggtacgggtcctaccggtcggttacgacgggtaacgggtaacggacgttacgtaaggtttacgttaacggttacacggttaacacgtcgtaaacgtataacgtaaccggtactacccgaactaccgtaacctacgttcctacgtagttaccggttaccgtaacggtaaccgtacggtacccggttacgcccgttaccggttacgttccgaacgtaccggaacccgactaaacccgccgtaacg

SEQ ID NO: 198616 - DNA, 762 bp, Homo sapiens
  misc_feature: GYAE6OF01BDCW5.18.59.F04.1.454.CMB.1.raw
  modified_base (215)..(215): a, c, t, g, unknown or other
  misc_feature (215)..(215): n is a, c, g, or t
  modified_base (231)..(231): a, c, t, g, unknown or other
  misc_feature (231)..(231): n is a, c, g, or t
  modified_base (264)..(264): a, c, t, g, unknown or other
  misc_feature (264)..(264): n is a, c, g, or t
  modified_base (288)..(288): a, c, t, g, unknown or other
  misc_feature (288)..(288): n is a, c, g, or t
  modified_base (618)..(618): a, c, t, g, unknown or other
  misc_feature (618)..(618): n is a, c, g, or t
tcagtacgagtatgcacgaccggtgctcgatttagtacacacacttagggagttggggggggtctcaggaggcagcgctctcgggacgtctccaccatggcctggctctgctattcctcaccctctcactcagggcacgagggtcctgggcccagtctgccctgactcagcctgcctcgtgtctggtctcctggacagtcgatcaccatcctccngctacgtacggaaccngcgaggtgtacggtttggtaggttaataacgtntcgttcctacgtacggtaaccaanacgaccaaccgagaaccaaaccgacccccaaacgtacactagtatttataggtaactcgtacctacgtaaacggtcccgtacccgttacggttacgggtttactaacgttccgttcctttacgtccgtcggtacctaccgtaacgttccgtacggtaacccaaccggtacccgtcccgttacccgtaacgtaccctacttccggtccgtacgggtccttaaccgcggtacggtacggaacggtacggaccggttacgtacgttaacgtttacgtaccgtacggttacacggttacctaacctaacggtttaactaaacccgggttaaccnccgttaaacccgacgtaccttaccttaccgtacttagttacccggtttcctaaaccgggttaaccgggtcgggtacctaacgggttaccctacccggtacggtaccgtaccgaccgaacccgtaacgccccctaacccgttacg

SEQ ID NO: 198617 - DNA, 811 bp, Homo sapiens
  misc_feature: GYAE6OF01E4N97.18.59.F04.1.454.CMB.1.raw
  modified_base (304)..(304): a, c, t, g, unknown or other
  misc_feature (304)..(304): n is a, c, g, or t
  modified_base (424)..(424): a, c, t, g, unknown or other
  misc_feature (424)..(424): n is a, c, g, or t
tcagtacgagtatgcacgaccggtgctcgatttagtacacacacttagggattgggggctgggggtctcaggaggcagcgctctcgggacgtctccaccatggcctgggctctgctattcctcaccctcctcactcagggcacgagggtcctgggcccagtctgccctgactcagcctgcctccgtgtcgtgggtctccgtggacagtcgatccaccattcctcctgaccacgtaggaacccagcgtaggtcggtacggtttggtaggtttaactaactatcgtccttccgtacggtaccaacncgaccaccgacggaaccaaacccgaccccctaaactcgtagtacgttaatttagtgtaacgttcgtaacctacgttaacgtccggtacccttaggtacgggtttacaacgttcgtcttcncgtacggtactaccgtaacgtcgtacggtacaaccgccggtccctcccgtacgaccttacgtcctcgggtcggtacctaccgggagtaccggtagggaaccggggaacgtacggttacgttaggttaacctttaacgttaccgtcgtaacgtcggtaaccttaactaaacgtttaaccgaaacgggttaaccacccgtaaccgtaaccggtacctaccctttacgtacctttacgggttaccccgtttaaccgggttaaccggggaaacccggttaccgggtaaaaccccggttaaccgggttacccccggttaaaccccggtttacccggtaacgggttaaccccccgacccgggaaacccccgtaaaccccgggtaacccccccc

SEQ ID NO: 198618 - DNA, 1004 bp, Homo sapiens
  misc_feature: GYAE6OF01D3JEE.18.59.F04.1.454.CMB.1.raw
  modified_base (195)..(195): a, c, t, g, unknown or other
  misc_feature (195)..(195): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcacatctcctgcactggaaccagcagtgacgttggtgttataactatgtctcgtggtaccaacncgccaccgaggaccaaaccgccccaaatcatagtatttagtgattgtacctaactaacgtccggtcccttacggtagggtttactaacgtcgtcttacgtcgtcggtccttaccgaagttcgtacggaccaaacccgtaccggtccccttacccgtacgtaacccgtagtttcccgttccggtaccgggggtacccttacccgggaacgggtccggttaaaggggaaaccggggtaaccccggtaagggttacccgtttaaggttaaacttttttaaaccgtttaccggtaacggtaccgtaaccggttactttaaaccggaaactttaacccgtaaacggaaaccggtacgtaacgaacccggtaaccgaaccgttaacccgttaaccgttaaaccgggttttaacccggttaacccgggtaacccgggggtttaacccgggtaaaaccccgggttaaccgggttaacccccggttaaccccgggtttaacccggttaaacccgggggtaaccctaaccccgggtaaaccccccggtaaaaccccggaacccccgtaaacccccggttacccggttaaccggttacccctttaacccggtttaacccccgtttacccccgttaacccccccgtttaccccgttaaccccccgttaacccgttaacccggtttaccccgtaaccgggtttaacccgggttaacgggtaccccggggttaccgggttaacccggggtaccggaacccggggtaacccgggtacccgttaccggtaaacgtaccggtaacgcgtacggccttagcccggta

SEQ ID NO: 198619 - DNA, 684 bp, Homo sapiens
  misc_feature: GYAE6OF01DLARN.18.59.F04.1.454.CMB.1.raw
tcagtacgagtatgcacgaccggtgctcgatttagtacacacacttagggagttgggggggggtctcaggaggcagcgctctcgggacgtctccaccatggcctgggctctgctattcctcaccctcctcactcagggcacagggtcctgggcccagtctcgccctgactcagcctgcctccgtgtctgggtctccgtggacagtcgatcacatcctcctgcactacggaaccagcagtggtacgttggtagttataactatgtcctccgtcggtaaccaacacgaccaccaggaccaaacgccccaactcatagtattatgatcgtactactatccgcccttacgtacgggttactagtacctcttctacgtcggtctaccgtagtacgtcggacaaccgtaccgtcctccctacgacctactcgtccgtcggtcctaccgtacggaccgtaggacggaaccggaggtcgttagtacgtttattaccgtagcgtacgtcttacgacttaactaacgtaacaccgtaaccgacgtacctaccgttacgtaccttagtttacggtaccggtttaccggaaaccgtacgggtaaacccggtaccgggttacccgtacccggttaccggttaccgggaccgtaaccccggacccgaaccccgaaccccggtaaaccccttaacccgg

SEQ ID NO: 198620 - DNA, 753 bp, Homo sapiens
  misc_feature: GYAE6OF01DESZ5.18.59.F04.1.454.CMB.1.raw
  modified_base (242)..(242): a, c, t, g, unknown or other
  misc_feature (242)..(242): n is a, c, g, or t
  modified_base (748)..(748): a, c, t, g, unknown or other
  misc_feature (748)..(748): n is a, c, g, or t
tcagtacgagtatgcacgaccggtgctcgatttagtacacacacttagggattgggggagagagacccctcccctgggatcctgggcccagtctgccctgactcagcctgcctccgtgtctggtctcctggacagtcgatcaccatctcctgcacgtggaaccagcagtgacgttggtgttataactatgtctcctgtaccaacagccaccaggcaaacgcccccaaatcgatagtatttangatgtacactagtccgcctacgtagggtttactaatcgtcttctcgtcgcctacctaagtctacggacaaccgaccggccctccctacgaaccctactccgttcgtcgggtccctaccggaggcgtacggaacgggacggacggtctaggttatttaacgtacgtggctacgtactacattaacaaccgaagaccaaccgactccctaacgttccttacttacgtacggtttaccgtttaaccggaacggtaccgggtaacccgtaacggtacccgtaacccgttaccgttaccggtacccgtaacccgaacccccggtaaacccggtacccccgaaaccccccgttacgttacccggtaccttaaccccttcccgtttaccccgttacccccctaccccttccccgttaaacccctacgttaaccccgttcggttaaccgtccgggtaaccgggtcccgggttaccggtaccgggtaaccgtaccgggtcccgaacttagtaacngagtc

SEQ ID NO: 198621 - DNA, 1017 bp, Homo sapiens
  misc_feature: GYAE6OF01BGLX1.18.59.F04.1.454.CMB.1.raw
tcagtacgagtatgcacgaccggtgctcgatttagtacacacacttagggattggggtctgggagaggacgccccagccttgggattcccaagtgttttcattcagtgatcaggactgaacacagaggactcaccagtggagtttgggctgagctggtattttccttgctgtacttaagttttaaaggtgtccagtgtgaggtgcagtcgtgggtggaggtcggtggggacggtcgttagggtaaacgggtccgggggggttcccttaggtacccgtcccccgtgttaccgacgtcccgttcgttggtaacttcctaaccgtttttaccgaagggttaaacgggtcccgttagggtaacgttacggtaaaaccggttcggggggttcccccgacccggtaacggggtccccgttaacccgggaaggggggtaaacggggggtcccggttaggggggtaacgggtttcgggggtttacgggtaacccggtttaaaacgtttaaaaaaaccccggtaaaaacgttggtaaacgttacggggttaacggggtaaaccaaaacggtaacggtaaaccgtaaccggtccgttaccggacccgtaacccgggttaagggaaaaccggtacgtaaacggtaactttaaccccaacccgtagtttaaccgtaaccgtaaaggaacggttaactacgtaaagtttaaaccgaaaaaacggtcctaaacgggtacccttaaggttaaccttacgtaacgtaaactaaaacgtacggaaaacccgtcgaacccgttaagggaaacccggaaaaccggaacgggaaacgtaacccggtaacggttaacccggttaactttaacggtttaacccctacggtaaaccccctactaccccgtaaccccgttaaacggtaaacgttacccctaaacgtaaccctttaaccgttaaacccggttaacccttaaaccggggtaacgtttaacccggtaacccgggttaccgggtaacccggggggtaaaaccccg

SEQ ID NO: 198622 - DNA, 729 bp, Homo sapiens
  misc_feature: GYAE6OF01AXENY.18.59.F04.1.454.CMB.1.raw
  modified_base (337)..(337): a, c, t, g, unknown or other
  misc_feature (337)..(337): n is a, c, g, or t
  modified_base (361)..(361): a, c, t, g, unknown or other
  misc_feature (361)..(361): n is a, c, g, or t
tcagtacgagtatgcacgaccggtgctcgatttagtacacacacttagggattggggctgggagaggagccccagccttgggattcccaagtgttttcattcagtgatcaggactgaacacagaggactcaccatggagtttgggctgagctggtattttccttgctgcttaattttaaaaggtgtccagtgtgaggtgcagctggtggagtcggtgggggaggtcgttagggtaaacggggcccgggggggttacccttacgaccctccccgtaggtaccgacgtcctcgtggtacttcacttttcgaagtaacggtcctggatgacgtgggtccncgaggcctcggagggagggctggnggtgggtcgacgtaataaaacaagtgagtaggtaggaacaacgacgtacgtacgctcgaccgaccgtaggaacgacgagtactacacatactacgaagacgtagtaagtaacttaacgaaaagtccctaagtactgttaactaccgtagtaaactaaagacaaccgaacgttcggaacgtaaggaacccggaacggaaccgtaaccgcgtaaccggtttagttaacgttaccgtaacgtaacctacccgtaaccgttaccccgtaaaggaaccgttaccgaaccctttaaacgtaccccgttaaattaaccggttaacccggttacgaacccggtttcccggtaacggttcgggggaaaacccccggg

SEQ ID NO: 198623 - DNA, 671 bp, Homo sapiens
  misc_feature: GYAE6OF01EI7YH.18.59.F04.1.454.CMB.1.raw
  modified_base (252)..(252): a, c, t, g, unknown or other
  misc_feature (252)..(252): n is a, c, g, or t
  modified_base (341)..(341): a, c, t, g, unknown or other
  misc_feature (341)..(341): n is a, c, g, or t
  modified_base (539)..(539): a, c, t, g, unknown or other
  misc_feature (539)..(539): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctggtctctggacagtcatcacctatctctgcactcgaaccagcagtgtacgttggtagttaataactntcgtccttcgtacggtaaccaacacgaccaaccgaggaccaaaccgaccccaaactctatgtaactttatgagttctactaacttaacnccggtaccgttgtacggtttactacgtctcttactctgaccgtactagtcgtcggacaaccgtaccggcccttccacgtacctacgtctcgtccggtctaccgagtcgtaggaacggtacgacggtctagttaacgttacttaccgagtacctgtaaccttacgaactttaacgaaaccgtaacgacctaaccgtacnccttacgtaccttactaagttccgttacggtaaaccggttaccggtcggtaaaccggttaacggttacccaacccggttacgtaccggtaccgtacccggaaccccgttaaccggacccctaacccgttacg

SEQ ID NO: 198624 - DNA, 660 bp, Homo sapiens
  misc_feature: GYAE6OF01BMY2R.18.59.F04.1.454.CMB.1.raw
  modified_base (231)..(231): a, c, t, g, unknown or other
  misc_feature (231)..(231): n is a, c, g, or t
  modified_base (277)..(277): a, c, t, g, unknown or other
  misc_feature (277)..(277): n is a, c, g, or t
  modified_base (314)..(314): a, c, t, g, unknown or other
  misc_feature (314)..(314): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccngcagtgtacggttggtagttataactatgtctcgtagtaccaacanccaccgaggacaacgcccccaaactcatgtactttancgtatcgtacgtaacgtaacttccggtacccgttacggtacggggttttactaacgttcgtcctttcgtcgtcggtcctacgtaacgtcgtacggactaaacccgtaccggtcccctaccgtacgtaccgtacttccgttaccggtccgggtacctacccggtacggtaccgtaacgggaaccggtacggtaacggtcgttacgtttaaagtttaacgtaccgtacggtacgtacgtccgttacgtaactaacgtaacgaccgtacctacgacgtactacgtcttacgtacgtcgttacgtacgacgtacggactacgtcacgctgaccacgccaacgccctaccg

SEQ ID NO: 198625 - DNA, 348 bp, Homo sapiens
  misc_feature: GYAE6OF01A6RXH.18.59.F04.1.454.CMB.1.raw
  modified_base (337)..(348): a, c, t, g, unknown or other
  misc_feature (337)..(348): n is a, c, g, or t
tcagtacgagtatgcacgaccggtgctcgatttagtacacacacttagggattggggagagaagacaggattcaggacaatctccagcatggccggcttccctcctcctcctcaccctcctcactcactgtgcagggtcctggcccagtctgtgctgactcagcccaccctcagcgtcgtcggggacccccgggcacggagggtccaccacgtcttcttgttccgtggaagcagctccaatacgtcggaagtcacgccaaggctcgcccctcggtcactcgtcgtcccgccctcctccactctcgtctgacggcggccgtggcaaggcacgatacgnnnnnnnnnnnn

SEQ ID NO: 198626 - DNA, 647 bp, Homo sapiens
  misc_feature: GYAE6OF01BJ6R4.18.59.F04.1.454.CMB.1.raw
  modified_base (227)..(227): a, c, t, g, unknown or other
  misc_feature (227)..(227): n is a, c, g, or t
  modified_base (252)..(252): a, c, t, g, unknown or other
  misc_feature (252)..(252): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaaccngcagtgacgttggtggttataactntgtctcctggtaccacagccaccgagacaaacgcccccaaactcatgtatttagtgatgtcactaacgtccggccctcgtacgggttctaagtctctttctcgtcgtctccgtaacgtcgtcggacaaccgaccggtccctcctcgacctacttccgtcgtcggtccctccgcggcgtaggacggaacggacggcgttagtactttacgtcgtacggcacgtcctactaattaacgtaacaacgaccctaaccacgacctaacccttcttaccgttacgttcgttacccggttaccggtaaccggtaccgggtaacccgtaaccgggttccctaaccccggttccgttacgggtaccaaccggaccccgtaacggacccccgtaaccccgtaccg

SEQ ID NO: 198627 - DNA, 601 bp, Homo sapiens
  misc_feature: GYAE6OF01BAIWO.18.59.F04.1.454.CMB.1.raw
  modified_base (423)..(423): a, c, t, g, unknown or other
  misc_feature (423)..(423): n is a, c, g, or t
tcagtacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcttgggtaaaggccgggggggtcccttaggactcccctgtacagcctctggattcactttcagtaaggcctggatgaactgggtccgccaggctccgagggaaggggctgggagtgggttggccgtattaaaaccaaaactgatgggtagggacaacagactacgctgcacccgtgaaaggcagattcaccatctacaaganatgaattacaaaagcacgctagtatctgacaaatcgaacagcctaggaacgaaccggaaggaccaacgacggccgttagtaactttaccgtacgtaacccactacctccccctaagaaacgtccgtactaactacctaactaccgttacggtataccggtacctgtcggggaacccgg

SEQ ID NO: 198628 - DNA, 772 bp, Homo sapiens
  misc_feature: GYAE6OF01B21XL.18.59.F04.1.454.CMB.1.raw
  modified_base (296)..(296): a, c, t, g, unknown or other
  misc_feature (296)..(296): n is a, c, g, or t
  modified_base (764)..(764): a, c, t, g, unknown or other
  misc_feature (764)..(764): n is a, c, g, or t
tcagtacgagtatgcacgaccggtgctcgatttagtacacacacttagggattggggggctttgcctgggtcctgggcccagtctgccctgactcagcctgcctccgtgtctgggtctcctggacagtcgatcaccatctcctgcactggtaaccagcagtgtacgttggtggttataactatgtctcctggtaccaacagcaccaggcaaacgccccaaatccatgatttatgatgtcactaactcggccctcgtagggtttctaatcgtcttctctgctcaagtctaggcaacncgcctcctcgaccatctcgtggctaccgaggtccgtaggacggacggaggtcttagtatttacgttactgcagtctacgtaaattaagtaacaacgacaaccgacgtacctacttaccgttacttacgttacggttccgtttaaccgggtaaccgtacgggtaacccgtaacgggttacccgtaacccggttacccgttaaaccggtaccgtaaacccggaacccccgtaaaccgggtaaccccctaaacccccgtacgtttaccggtaaccctaccgttttaccccgttaaccccggtttaccccccgtaaccccctttaccccgttaacccgttaaccgtttaaaccccggttccgggtttaaaccccgttacggggtaacccggggtacccgggtacggttaccccggggaaccgggtaaaaccgggccgttaaccgtaaacgtttacgacctaggcgttaacgngtaaccgg

SEQ ID NO: 198629 - DNA, 683 bp, Homo sapiens
  misc_feature: GYAE6OF01B1SAJ.18.59.F04.1.454.CMB.1.raw
tcagtacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgcttaattttaaaaggtgtccagtgtgaggtgcagctggtggagtcgtgggggaggcttagggtaaaggccggggggtacccttaggacctccccgtagtaccagtcctcgtggtacttcactttcaagtaacggcctggatcgaacgtgggtccgcaggcctacgaggggaaggggctagggaggtggggttacggaccgttaaagttaaaaaaccgaaaacgtggaagttgggtacgggaacaacgaagtacgtacgctacgaccgaccggtagaaacggcaagacttaccaacctaatccgtacaagagtatacgtaattaacaaaaagctaacgcttagtaactactagaaccaaagttacgaaacgcgtaccgtaggaacggaaacccgtaggaacaccgagtaccgttatacttacacgtaacctaacctactacccgtagaaccggtactaacctaaactactaacctaacgttacggtaactcggtaaccgtcggtcgggtaacccgg

SEQ ID NO: 198630 - DNA, 782 bp, Homo sapiens
  misc_feature: GYAE6OF01ARJH5.18.59.F04.1.454.CMB.1.raw
tcagtacgagtatgcacgaccggtgctcgatttagtacacacacttagggagttggggggggtctcaggaggcagcgctctcgggacgtctccaccatggcctggctctgctattcctcaccctcctcactcagggcacgagggtcctgggcccagtctcgccctgactcacgcctgcctcgtgtcgtgggtctcctggacagtcgatccacctatcctccgtgctacgtacggaacctgctaggtcggtacggttggtagttaataactgtcgtactccgtaggtaacccaaacgtacgaccaacccgagggaaccaaaaccggccccctaaaactcgtaacgtaggttaatttacgtgtaacgttcggtaacctaaccgttaaacgtcccgggtacccttacgggttaacggggttttactaaacgttccgtctttccgtacgtcggtacctaccgtaagttccgtcgggaacctaaccggtacccgtccctacccgtacgaaccctacgttccgtacggtccggtaccgtaccggtacggtcgtacgggaacgggacggtacggtacttacggtaactttaacgttacgtcgtcgtaacgttacctacgtaaactacgtaaaccgaacgtcccgaacctacgtaccctacttccgtaacgttacggttccgttacggttaaaccgggaccggtacgggtaaacccgtaccggttaccgacccggttacgtaaccggacctacccggaaccccgtaacccgccccgtaaccgttaacccg

SEQ ID NO: 198631 - DNA, 926 bp, Homo sapiens
  misc_feature: GYAE6OF01BZINU.18.59.F04.1.454.CMB.1.raw
tcagtacgagtatgcacgaccggtgctcgatttagtacacacacttagggattggggggggagaggagccccagccttgggattcccaagtgttttcattcagtgatcaggactgaacacagaggactcaccatggagtttgggctgagctggtattttccttgctgcttaattttaaaaggtgtccagtgtgaggtgcagcgtgggtggagtcggtgggggaggcgttagggtaaacgggtccgggggggttacccttacggacctccccgtgtaccagtcctcgtggaactttcctaactttcgaaggtaaacggtccgtaggaacttacggaaaccggttcggggtaccgcccggaacgggtccctaccgggaaggggggtaacgggggccgtaggggtaacgggttgggggtttacgggtaacccggtttaaaacttaaaaaaacccgtaaaaacggtacggtaaagttacgggggtacggggtaaaccaaaaccgaacggtaaacccttaccggacgttacggacccgtaaaccccggagggtaaaacgcgaaagtacgttaccaaaccgtataccgtaacgaaagacgtacttaagtaaacttaaacgaaaaacgtacctaacggtaccgttaacgttaagtaccgttacgaacgtaaaagttaacggaaactaccggtacgtaacggaaaccggtaaaccggtaacggaaacctaacccggaaacggttcccggttaaacgtttaacgtttaaacccgttacggtaaacccctaaccgttaacccgttaaccccgttaaagggaaacccggtaccgttaaccctaaaacgttacccgttaacgtaacccggttaccggttaacgttaaccggacccgtttaccggggaccgggaacccggaaaccgggtaaaccccggg

SEQ ID NO: 198632 - DNA, 668 bp, Homo sapiens
  misc_feature: GYAE6OF01EL89H.18.59.F04.1.454.CMB.1.raw
  modified_base (200)..(200): a, c, t, g, unknown or other
  misc_feature (200)..(200): n is a, c, g, or t
  modified_base (229)..(229): a, c, t, g, unknown or other
  misc_feature (229)..(229): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacngtcgatcaccatctcctgcactggaaccngcaggtgtacggttggtgttaataactatgtctcctcggtaaccaacacgccaccaggacaaaccgacccccaaactcatagtatttatgatcgtactactaactccggcccttcggtagggttttactaacgttccgtctttctcgtcggactaccgtaagtcgtggaccaaccgtacccggcccttcccgtacgtaccctacttccgtcgtcgggtcctaccggtacggtcgtaggaacgggacggtagggtccttagtaactttaagttacgtcggacgacgtcttaacgtactaactaacaacgcccgtaaaccacgtacctacttaccttactaagttcgttaccgtacgggtaacgtacgggtaaacccgacggttcccgtaccgtaccgtaacggtaccacccggacccgaacgaccccctaacccgtaccg

SEQ ID NO: 198633 - DNA, 586 bp, Homo sapiens
  misc_feature: GYAE6OF01C9Q13.18.59.F04.1.454.CMB.1.raw
  modified_base (186)..(186): a, c, t, g, unknown or other
  misc_feature (186)..(186): n is a, c, g, or t
  modified_base (273)..(273): a, c, t, g, unknown or other
  misc_feature (273)..(273): n is a, c, g, or t
  modified_base (287)..(287): a, c, t, g, unknown or other
  misc_feature (287)..(287): n is a, c, g, or t
  modified_base (334)..(334): a, c, t, g, unknown or other
  misc_feature (334)..(334): n is a, c, g, or t
  modified_base (350)..(350): a, c, t, g, unknown or other
  misc_feature (350)..(350): n is a, c, g, or t
  modified_base (385)..(385): a, c, t, g, unknown or other
  misc_feature (385)..(385): n is a, c, g, or t
  modified_base (514)..(514): a, c, t, g, unknown or other
  misc_feature (514)..(514): n is a, c, g, or t
  modified_base (560)..(560): a, c, t, g, unknown or other
  misc_feature (560)..(560): n is a, c, g, or t
  modified_base (563)..(568): a, c, t, g, unknown or other
  misc_feature (563)..(568): n is a, c, g, or t
  modified_base (570)..(571): a, c, t, g, unknown or other
  misc_feature (570)..(571): n is a, c, g, or t
  modified_base (574)..(580): a, c, t, g, unknown or other
  misc_feature (574)..(580): n is a, c, g, or t
  modified_base (582)..(582): a, c, t, g, unknown or other
  misc_feature (582)..(582): n is a, c, g, or t
  modified_base (584)..(586): a, c, t, g, unknown or other
  misc_feature (584)..(586): n is a, c, g, or t
tcagtacgagtatgcacgaccggtgctcgatttagtacacacacttagggattgggggctttgtctgggtctcctggacagtcgatcaccatctcctgcactggaaccagcagtgacgttggtggttataactatgtctcctgaccaacagcacccaggacaaacgcccccaaatcatgtatttangatgtacaactaatccggcccctagtaggggttttcctaaagtcgtctttctccgttggcctaccgaaaggtcctgggaccaaaccnccgggcccttaccnggaacctatccgtcggtcgggcctaccgaggtcgtaggacggaacgnggctagtattatacgngcagctacattaagacaagccacacgtcacctctntaatcgtacgttacggaactaggaaccaaggtctaccgtctaggcacgaccaacgaccctaaccccatcgtacctactaccgttcgtacccccgtccctaccgaccctaacgttactaccgttaaccgnggacggtaccgggtgaccggaacgtaaacgggcctacgaaagtagnagnnnnnnanncannnnnnnanannn

SEQ ID NO: 198634 - DNA, 624 bp, Homo sapiens
  misc_feature: GYAE6OF01BG26F.18.59.F04.1.454.CMB.1.raw
  modified_base (311)..(311): a, c, t, g, unknown or other
  misc_feature (311)..(311): n is a, c, g, or t
tcagtacgagtatgcacgaccggtgctcgatttagtacacacacttagggattgggggagctctgggagaggagccccagccttgggattcccaagtgttttcattcagtgatcaggactgaacacagaggactcaccatggagtttgggctgagctggatttccttgctgctatttaaagtgtcagtgtgaggtgcagctggtggagtcgtgggggaggcgttggtaaaggccgggggggtcccttagacctcccctgtaccagcctctggattcacttttcagtaaggcctggatgaacgtcgggtccncgaggctccgagggaggggcgtggaggtgggttggaccgtattaaaaccaaagtgaagttggagggacaacgagactacgctagcaccgtagaaaggcaagattacaccatctacaagagatagacttacaaaagcaacgcgtagtatctagactaaatacgaacgtacacgtagaacgaaccggaggaacacgaacgccgtagttaacgtacgtaccgtacctaacctacctaccccgtaggaaaccgtccgtaaccctaaattaccctaaccgttacttaaccgggtactaccgggtaccttacccggggg

SEQ ID NO: 198635 - DNA, 813 bp, Homo sapiens
  misc_feature: GYAE6OF01BPWUK.18.59.F04.1.454.CMB.1.raw
tcagtacgagtatgcacgaccggtgctcgatttagtacacacacttagggattgggggctggggtctcaggaggcagcgctctcgggacgtctccaccatggcctgggctctgctattcctcaccctcctcactcagggcacgagggtcctgggcccagtctgccctgactcagcctgcctccgtgtcgtcgggtctccgtggactaggtcgatccaccattcctcctgacctacgtacggaaccagcaggtcggtacggtttgggtagttaataacttagtcgttctcgtaggtaccaacgacgaccaccgacggaaccaaaaccgaccccctaaaagtcctaattggtaacttttagacggtaacttacggtaacctaacgtaacgttcccgggtacccgttacgggtttacgggtttactaacgttccgttccttcgtccgtgtacctacgtaagtccgtacggaccaaaccgccgtaccctccgtacgtacctcgttccgttccggtcggtacctaccggacggtccggtaggggaaccggtacggtacgtacgttaacgttaactttaacgtacgtacgactaaccggttacctaacttaacgtaaaccaaccggtaacccgtaccaaaccgtacgttaccctaaccgtttaggttaacccttacggggttacccgtttacgggtaaacccgggttaacgggtaacccggttaaaacccggtaccggttaacccccggttaccggtttacccggtacccggttaacccgtaaaccccgggacccccgtaaaccgggtaaacccccccg

SEQ ID NO: 198636 - DNA, 723 bp, Homo sapiens
  misc_feature: GYAE6OF01EHE0Y.18.59.F04.1.454.CMB.1.raw
  modified_base (207)..(207): a, c, t, g, unknown or other
  misc_feature (207)..(207): n is a, c, g, or t
  modified_base (247)..(247): a, c, t, g, unknown or other
  misc_feature (247)..(247): n is a, c, g, or t
  modified_base (263)..(263): a, c, t, g, unknown or other
  misc_feature (263)..(263): n is a, c, g, or t
  modified_base (302)..(302): a, c, t, g, unknown or other
  misc_feature (302)..(302): n is a, c, g, or t
tcagtacgagtatgcacgaccggtgctcgatttagtacacacacttagggattggggggggtctcaggaggcagcgctctcgggacgtctccaccatggcctggctctgctattcctcaccctcctcactcagggcacagggtcctgggcccagtctgccctgactcagcctgcctccgtgtctggtctcctggacagtcatcaccntctctgcactggaccagcagtgacgttggtgttataactntgtctcctggtaccangccaccaggacaaaccgcccctaaactcatgtatttagngattcgtactacgtaacgtccggtccctacggttaggggttttactaacgttccggtcctttccgtcgtacggtccttaaccctaaggtttcctacgggacccaaaccgtaccccggtccccttaccccgtacgtaccctattcccgttcgtacgggtccctaccgtaggccgttacgggaacgggtaccgtagggtccttagttaacgttttaactacgtcgactaagtcctacgtaagtaactaacgaacgacccaaccgtacgaccctaaccgtaccttacgtacttacccggttaccgttaacccgggtaaccggtaccgggtaacccttaaacgggtcccctaacccggttacccgtaaccggttcccgaaacccgtaacccccgggaacggtacccccctaaccggttaaacccg

SEQ ID NO: 198637 - DNA, 779 bp, Homo sapiens
  misc_feature: GYAE6OF01CTRQR.18.59.F04.1.454.CMB.1.raw
tcagtacgagtatgcacgaccggtgctcgatttagtacacacacttagggattgggggctggggtctcaggaggcagcgctctcgggacgtctccaccatggcctgggctctgctattcctcaccctctcactcagggcacagggtcctgggcccagtctcgccctgactcagcctgcctccggtgtcgtcgggtctccgtaggacagtcgatcaccatctcctgcacgtcggaaccagcaggtgacgtttggtaggttaataactagtcgtctaccgtacggtaaccaacacgaccgaaccacggaaccaaaccgaaccccctaaatctatacgtatttacgtgtaattctaactaactaacgtccggtacccttacggttaacgggtttacctaacgttccgtcgttacgttcgtacggcctaaccgtagtcgtacggaacctaccgtacgtcccctacctacgacctacgtccgtcgtaccggctacccggagggtcgtagggaacggaacgtacggtacgtagtaacgtttaacgtctacgacgtaccgtactaacgtaaactaaccggaactaaccgaacccgtacctaacggtacccttaaccgttccgttaacgttaccgggtttaaccgttcccgggttttaaaaccgggaaacccgggtttaacccggggaaacccgtttaacccgggtaacccccgtttaaccgggttaaacccggtaccgttaaccggaaacccgggtaacccccgtaaaacccgggtaacccccccg

SEQ ID NO: 198638 - DNA, 878 bp, Homo sapiens
  misc_feature: GYAE6OF01A1JI6.18.59.F04.1.454.CMB.1.raw
tcagtacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggtattttccttgctgtcttaattttaaaaggtgtacctagtgtgtaggtgcagtcgtggtggagtcggtgggggaggtcggttagggtaaacgggtcccggggggttacccttacggaccgtccccgtgtacgacgcctcgtaggtacttcctacgtttacgaagtaacggccgtaggatacggtaacgtccgggtccgaccgtacggccgtaccggagggggtaacggggtcgttaggggtacgggttcggggttacgggtacccggttaaaacgtttaaaaaaccggtaaaacgttaggtaacgttacggggtaacgggaacctaaacgtaacgtaaacccgtacgggtacctaccgggaacccgtaacccgggttaaggaaacgggtaccgtaaacgttaacgttacccgtaaacctactaccgggtaacgaaacggtacgttaacgttaacggaaacctttaaaaacggaaaaaccggtccaaccggttacttaagtacgttaccgtaaggttaacaaacgtacgtaacgaccgtacgttaaggaaccggtaaccggaacgtaacgacgtacggaccgttagtacgttaccgtacctaaaccgtacccgaaaccgttacccggtaagaacccgttacccgtaaccgttaaaacccttaaccggttaacccttaacggtaaacccggtcgttaaccgggtaacccgttaacccggggg

SEQ ID NO: 198639 - DNA, 668 bp, Homo sapiens
  misc_feature: GYAE6OF01AJNDT.18.59.F04.1.454.CMB.1.raw
  modified_base (269)..(269): a, c, t, g, unknown or other
  misc_feature (269)..(269): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctctggacagtcgatcaccatcctcctgcacgtggaccagcagtgtacgttggtgttatactatgtctcctggtaccanacgccaccgaggaccaacgacccccaaactctatgtatttatagtatcgtactaactaacgtccggtccctacgtagggtttactaacgtcgtctttctcgtcggtctaccgtaagtcgtaggaccaaccgtaccgtccctcccgtacgacctactcctcggtcggtcccgtcgacggtcgtacggacggtacggacggtccgtagttaacgtttacgttacgtcgtaccgacgtctacgtaacttaaccgtaaccgaaccgacctaaccgaccgtacctaccttaccttacttacgttcgttaccgttaacgggacggtaccgggtaacccgtacggtccctacccggtacgttacggtcccgtaaccgacccggaaccgtacccctaaccgtacccg

SEQ ID NO: 198640 - DNA, 826 bp, Homo sapiens
  misc_feature: GYAE6OF01C276A.18.59.F04.1.454.CMB.1.raw
  modified_base (236)..(236): a, c, t, g, unknown or other
  misc_feature (236)..(236): n is a, c, g, or t
tcagtacgagtatgcacgaccggtgctcgatttagtacacacacttagggagttgggggggggtctcaggaggcagcgctctcgggacgtctccaccatggcctgggctctgctattcctcaccctctcactcagggcacgagggtcctgggcccagtctcgccctgactcagcctgcctcgtgtctgggtctcgtggacagtcgatccaccactcctcctgaccactcggaaccnggcaggttggtacggtttggtaggttactaacgtattcgtcctccgtacggtaaccaacgacgtaccgaacccgacggaccaaaacccgaccccctaaaactactaacgtagttaactttatacggaattcggtactaacgttaacgtcccggtcccttacggttacggggtttaccttaacgtaccgttccttcgttccgtacggtacctaccgtaacgtccgtacggaacctaacccgccgggtccctacccgtacgtacctacgttccggtcgttccgggtccctaccgtacggtacgtacgggaacgggacggtacggtccgttaagggttaactttacgtttaacgtcggtacgtaccggtctaacgttattaaacctaccgtaaaccggtaccctaaccggacgtaacctaccgtttaccgttaccgttaacggtttccgttaaccggttacccgggtaaccgggttacccgggtaaaccccggtaacgggtttaaccccgtaaccccgggtttcccgtaaaccggttaccggaaccccgaccccgggtaaaccccggacccccttaaacccccggtaacccgg

SEQ ID NO: 198641 - DNA, 713 bp, Homo sapiens
  misc_feature: GYAE6OF01E1NXN.18.59.F04.1.454.CMB.1.raw
  modified_base (700)..(700): a, c, t, g, unknown or other
  misc_feature (700)..(700): n is a, c, g, or t
  modified_base (708)..(708): a, c, t, g, unknown or other
  misc_feature (708)..(708): n is a, c, g, or t
tcagtacgagtatgcacgaccggtgctcgatttagtacacacacttagggagttgggggctttgcctgggtcctgggcccagtctgccctgactcagcctgcctccgtgtctgggtctcctggacagtcgatcaccatctcctgcactggaaccagcagtgacgttggtaggttataactatcgtctcctggtaccaacagccaccgaggcaaacgcccccaaagtcatgatttatgatgtacaactaactccggcctcgtaggggtttctaatcgtcttctctcggcctaccaagttctcggaccaacgtaccggtccctcccgtagaccctacgttccgtacggtcgggtcctccggaggtcgtaggaggtaccgaggtcttagtactttaacgtcgtgacgacgtactactaagttaacaactaacgccgtaaaccgacgtctaaccttcgtacttacgttcgttaccgttaccgggaaccgttacgggaaacccgtaacggttccgaacccgttccgttaacggtccgtaacccgaaccccgtaacggaccccctaaacccgtcgtaccgttcctaaccttccgttacccggttacccccttaaccccggtcccttaaccgtaccgtacccgttacggaccgtacgggtaccgtaccgggtacctagggtacgaccgggcctaagtacgtacggtnagtcgttncgtcg

SEQ ID NO: 198642 - DNA, 807 bp, Homo sapiens
  misc_feature: GYAE6OF01B026Z.18.59.F04.1.454.CMB.1.raw
tcagtacgagtatgcacgaccggtgctcgatttagtacacacacttagggattggggggggtctcaggaggcagcgctctcgggacgtctccaccatggcctggctctgctattcctcaccctcctcactcagggcacagggtcctgggcccagtctgccctgactcagcctgcctccgtgtctgggtctcctggacagtcgatcaccatctcctgcacgtgaacagcagtcgacgttggtagttataactagtgtaccttccgtcggtaaccaacgacgccaacccgaagggtaccaaaaccggaccccccctaaaacgtacctaagtttacgtaacgtttttaagtcgttaacgtcggttaccgtaacgttaaaccggttcccggtaccccgtttacggttaacggggtttttactaaacgttccggttaccgtttacgttccgttacgggtacccttaccgtaaacgtttccgtacggtaaccgtaaaccggtcccgggtaccccgttacccgttaccggaaacccttacgttcccgttaccgggttccgggtaccgttacccgacgggttacccttaggggtaaaccgggtacggtacgggtacgttacggttaacgttttaacgttaccgttacgacgtacggtaccttaacgtattaacgtaaccgaacgtacctaccgtacgtacctacttactacgttacgttcgttaccgtaacggtaccggtacggacctaacggttaccgtacccgttaccgaacgtaccacggtaaccccgtaacgtaaccctaacccggtaccg

SEQ ID NO: 198643 - DNA, 740 bp, Homo sapiens
  misc_feature: GYAE6OF01DMJMS.18.59.F04.1.454.CMB.1.raw
  modified_base (230)..(230): a, c, t, g, unknown or other
  misc_feature (230)..(230): n is a, c, g, or t
  modified_base (256)..(256): a, c, t, g, unknown or other
  misc_feature (256)..(256): n is a, c, g, or t
  modified_base (382)..(382): a, c, t, g, unknown or other
  misc_feature (382)..(382): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtcgtgggtctccgtgacagtcgatcaccatcctcctgcactaggaccngcagtgacgttggtagttatactatntctcgtgtacacacgccaccagacaacgaccccaactcatagattatgtatcgtacactacgtccgtcctacgtacgggttactagtcgtcttctcgtcggctacctaagtcgtacgacctaaccnccggtccctaccgtacgtaccctagttcccgttacggtccgggtcccttaaccggacgggtcgttagggaacgggaaccggtagggtcccgttaagttaacgtttaacgttacgtacggtaccgtacgttcctaagttaacgtaaaccgttaaccgaaaccgtaccgtaccgtaaacctacttacccgttacgttacgttacggtttaccgggtaaccggtttaccggggtaaacccgggttaaccggggtaaccccgttaaccgggtaccccggttaaccccggttaaccggttaaccgggtacccgtaaacccggacccccggtaaacccggacccccttaaaccccggtaacccg

SEQ ID NO: 198644 - DNA, 685 bp, Homo sapiens
  misc_feature: GYAE6OF01CNHDH.18.59.F04.1.454.CMB.1.raw
  modified_base (338)..(338): a, c, t, g, unknown or other
  misc_feature (338)..(338): n is a, c, g, or t
tcagtacgagtatgcacgaccggtgctcgatttagtacacacacttagggagttggggggggtctcaggaggcagcgctctcgggacgtctccaccatggcctgggctctgctattcctcaccctcctcactcagggcacagggtcctgggcccagtctcgccctgactcagcctgcctccgtgtcgtgggtcctccgtggacagtcgatcacctatcctcctgcacgtcggaaaccagcagtggtacggtttggaggttaataactatgttctccgtaggtaccaactagccaaccaggaccaaaccgcccccaaaatccgaatcgtaattttacgngtaatcgtaactaactaactcccggtacccttacggttagggttttaacctaacgtcgtcctttccgttacgtaggtacccttaacgtaacggttccttacgggaccctaaaccggaccggtaccctccccttacgaccctacttctaccgtcgggtacctaccggaggtacgtaggaacgggtacgaaaggtccgttaggtaactttacgtacgttacgcgtagaccttatactttaaacacgaacgaaccactaacgctactctactatacgtccgtagaacggtcggacgtaacggtcctacgtactcggtaacacgtacccgaaaccggccccaacgtaaccg

SEQ ID NO: 198645 - DNA, 735 bp, Homo sapiens
  misc_feature: GYAE6OF01CAW1S.18.59.F04.1.454.CMB.1.raw
  modified_base (237)..(237): a, c, t, g, unknown or other
  misc_feature (237)..(237): n is a, c, g, or t
  modified_base (265)..(265): a, c, t, g, unknown or other
  misc_feature (265)..(265): n is a, c, g, or t
  modified_base (283)..(283): a, c, t, g, unknown or other
  misc_feature (283)..(283): n is a, c, g, or t
tcagtacgagtatgcacgaccggtgctcgatttagtacacacacttagggattggggggggtctcaggaggcagcgctcgtcgggacgtctccaccatggcctgggctctgctattcctcaccctcctcactcgagggcacgagggtcctgggcccagtctcgccctgactcagcctgcctccgtgtcgtgggtctccgtggactggtcatccaccatctcctgacctatggaaccngacagtgtacggttggtagttataactntcgtctctggtaaccaanacgccaaccgaggacaaaccgacccccaaactctagtcgtaatttagtgtatacgtactaagtaacgtccggtcccgtacgtacgggttactaacggtccttacgttcctcgtcggtacctaccgtacgtacgtcggacctaaccgaaccggtccctacccgtacggtaacctactccgttcggtccgggtccctaccgtacggtcgtagggacgtaacggtaggtacgtagtaacgtttacgttaccgtacgtacgtcggtactaactaacgtaaacgtaacgaaccgaccgtaaccctacgaccttaacctccttaacgtattaccgtacgttaaccgggtaaccggtacggtaaacccggtaacggttacccgtaacccggttaccggtaaaccggttccgaaacccggtaccccgaaacccggtaacccgtaacccccgttaacccgg

SEQ ID NO: 198646 - DNA, 735 bp, Homo sapiens
  misc_feature: GYAE6OF01BS09K.18.59.F04.1.454.CMB.1.raw
  modified_base (235)..(235): a, c, t, g, unknown or other
  misc_feature (235)..(235): n is a, c, g, or t
  modified_base (713)..(713): a, c, t, g, unknown or other
  misc_feature (713)..(713): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacgagggtcctgggcccagtctgccctgactcagcctgcctccgtgtctgggtctccgtggacagtcgatcaccatctcctgcacgtcggaaccngcagtgacgttggtagttataactatcgtctccgtcggtaaccaacagccaacccgaggaccaaaccgaccccccaaaactcaacttagtaacttttatagtacttacgtaccaacgttaaacgtccgggtaccccgttcggtaacggggttttactaacgttcgtacctttcgttcgttcggtacctacccgtaacgttcgtacggacctaaaccgtacccggtccccttacccgtcgaaccctacttccgttccgtacggggtaccctccggtacggtaccgtacggtaacgggaacccggtaggtccgtttaaggtaacttttaacgttaccgacgtaccgtacgtacctaacgtaattaaccaacgtaaccgacctaaccgagtaccgtaccttcgtactttacgtcgtttaccggttacggtaacggaccgggtaacctaacgggtcctaacccgggttactacgggtacccncggaaccccgtaacggaccccc

SEQ ID NO: 198647 - DNA, 626 bp, Homo sapiens
  misc_feature: GYAE6OF01BU8VK.18.59.F04.1.454.CMB.1.raw
  modified_base (257)..(257): a, c, t, g, unknown or other
  misc_feature (257)..(257): n is a, c, g, or t
  modified_base (274)..(274): a, c, t, g, unknown or other
  misc_feature (274)..(274): n is a, c, g, or t
  modified_base (308)..(308): a, c, t, g, unknown or other
  misc_feature (308)..(308): n is a, c, g, or t
tcagtacgagtatgcacgaccggtgctcgatttagtacacacacttagggagttgggggctggggtctcaggaggcagcgctctcgggacgtctccaccatggcctgggctctgctattccttaccctcctcactcaggcacgagggtcctgggcccagtctgccctgactcagcctgcctccgtgtctgggtctcctggacagtcgagtcaccatctcctgcacgtgaaccagcagtcgacgttggtgttatactntgtctctggtaccaacngcaccaggacaacgcccccaaatcatgtatttangatcgtacagtacgtccggtcctgtacgggtttacaacgtcgcttctcgtgcctacaacgtcgacggtacaaccgcggtccctccgtacgacctacgttcctccgtcgggtcccttaccggaggtacgtaggaacgggtacggtacggtaccttaaggttaactttacgttaccgtcgacgtaaccgtctactaagtaactaacgaacgctaaggacctagacctacgtaccgtaacgttccgtaacggacgtccgggtaacgtacggtcctaccgttacgtacgtccgaccgtaccgaacgtaccccaacccgtacg

SEQ ID NO: 198648 - DNA, 802 bp, Homo sapiens
  misc_feature: GYAE6OF01C3JY0.18.59.F04.1.454.CMB.1.raw
  modified_base (347)..(347): a, c, t, g, unknown or other
  misc_feature (347)..(347): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacgagggtcctgggcccagtctgccctgactcagcctgcctcgtgtctgggtctccgtggacagtcgatccaccatctcctgcctacgtcggaaaccagctaaggtcgtacggtttggtaggtttataactatcgtcctaccgtacggtaaccaacgacgaccaaccgaggaccaaaccgaccccccaaactctaattacgttaatttanagtaattacgtacctaaagttacgtaccggttacccgttacggttacggggtttaccttaacgtcgttacctttcgttccgtcggtaccttaccgtaacgttcgtacggaacctaaacccggtcccggtaccctacccgtacgtacccacgttccgtacgtccgggccttaccgaggtaccgtacggacgggaacggtacggtacttagggttaactttaaggttacctacgtacgtacgtacgttacctaattaactaaccgtaaccgtaaccgtacccgtaacgtaccctaacccttcgtttaacctacgtttaccggttaccggtaaaccgggttaccggggtaaccggtaaacccggtaaccggttaccccggacgggtttaacccgttaccgggtaacccgtaacccggtaaccccgtaaacccggaacccccttaaacccggtaccccg

SEQ ID NO: 198649 - DNA, 885 bp, Homo sapiens
  misc_feature: GYAE6OF01BC1WA.18.59.F04.1.454.CMB.1.raw
  modified_base (149)..(149): a, c, t, g, unknown or other
  misc_feature (149)..(149): n is a, c, g, or t
tcagtacgagtatgcacgaccggtgctcgatttagtacacacacttaggagttaggggggggtcgtcaggaggcagacgctcgtcgggacgtctccaccagtcggccgtggcctctgtctaccttcctcaccctcctcactcaggcacnggtcctgggcccagtctgccctgacgtcagcctcgccctcggtgtctgggtcctcccgtggaccaggtccgactacgaccatcctcgtgacctacgtggaaccaggccgaagtcggaacgtttagggtaggtttaataacttagttcgttaccgtacccttacggtaacccgaaacgaccggaccgaaacccgacggggaccctaaaaccggtaccccccctaaaaagttcccgtaaatttacggtaaactttttaaacgacgtaattcggttaaccgaaccgtttaaaccggtccggtaccccgttacggtaaccgggggtttttacctaaaagttccggtacccgttttacgttccgtttcggggtacccttacccgtaaaggttccggttacggaaccgaaaccggtaacccgggtcccttacccgtacgtaacccgtacgtttccgttacggttcgggtacctaccggtagggtaccgttacgggaacggggtccggggtacgtacgggtaacgtttacgttaccgttaggtaccgtaaggtcccttaacggtaactaaacgtaccgtaaagacccgtaacgtacgtacgtaacctttacgtacgttacgttcgggttacccgttacgggaaccgttaccgggaaccgtaaggttacccgtacccggttaccggtacgttaccgaacccggtacccggttaaccgggacccctaaccccggtgttaccccgg

SEQ ID NO: 198650 - DNA, 811 bp, Homo sapiens
  misc_feature: GYAE6OF01DELDF.18.59.F04.1.454.CMB.1.raw
  modified_base (213)..(213): a, c, t, g, unknown or other
  misc_feature (213)..(213): n is a, c, g, or t
  modified_base (392)..(392): a, c, t, g, unknown or other
  misc_feature (392)..(392): n is a, c, g, or t
  modified_base (593)..(593): a, c, t, g, unknown or other
  misc_feature (593)..(593): n is a, c, g, or t
tcagtacgagtatgcacgaccggtgctcgatttagtacacacacttagggattgggggggggtctcaggaggcagcgctctcgggacgtctccaccatggcctgggctctgcttattccctccaccctcctcactcagggcacgacgggtcctcgggcccagtctcgtccctgacctcaacctcgcccttcgtgtcgtcggtcctcgtggacngtcgactccaccatcctcctgacctacgtacggaaccagcgtagttacggtacggtttaggttacgtttaaactaacttagtccgttccttacccgtaacggtaaccaacgaccgaccgaacccgaacggaacccaaaaccccgtaaccccctaaacgtacgtaacttagtaactttanacgtataccgtactaacgtacgtcccggtaccgtacgggtttacggtttacctacttccgtccttcgttacccgtcgtacctacctacggttccgacggaacccaccggtacccgtccctaccgtaccaccgttccgtacggttcccggtcggtacccgtaccggtacgtacgggtaggaaccgggtacggtaaccggttnttaacgttaacgtttaccgtacgtacgtacaacctacgtaactaacgtacttaaccgaactaccgaacctacgtaacctacttacgttaccttacggttacccttacgggtaaccgtaaccgggtaacgtaaccgggttaaccctacccggttacccgtaccgtaccggaacccctacccggaacccgaccccgtaacccctaaccgttcccgtaccg

SEQ ID NO: 198651 - DNA, 708 bp, Homo sapiens
  misc_feature: GYAE6OF01CMZWF.18.59.F04.1.454.CMB.1.raw
  modified_base (204)..(204): a, c, t, g, unknown or other
  misc_feature (204)..(204): n is a, c, g, or t
  modified_base (238)..(238): a, c, t, g, unknown or other
  misc_feature (238)..(238): n is a, c, g, or t
  modified_base (266)..(266): a, c, t, g, unknown or other
  misc_feature (266)..(266): n is a, c, g, or t
tcagtacgagtatgcacgaccggtgctcgatttagtacacacacttagggagttggggggggggtctcaggaggcagcgctctcgggacgtctccaccatggcctggctctgctattcctcaccctcctcactcgagggcacgagggtcctgggcccagtctcgccctgactcagcctgcctcgtgtcgtggtctccgtggacngtcgatcaccattcctcctgccacgtcggaaccngcaggtgtacggttggtagttataactntcgtcctcgtaggtaaccaacacgccaacccgaggaaccaaaccgacccccaaaactctaattagtaatttagtacgtatcgtacctaacgtaaccgtccggtacccttcgggttaagggtttactacgtccgttaccgtttcttcgtcggtacctaccgtaacggtcgtacgggtaaccaaccggtacccgtcccttaccgtaccgaacctcgttccgtcggtcggtcctaccggaggtcgaaggacggcgagtctagtacgtttacttcgcgactacgtcctaagtactaacgtaacaacgacctaacgactaccttacctctttactacgttacgttaccgtaaccgggtaccggtaaccgggtacccgtaaccggttcccgttaccgtaccgttacgtacccgaaccgtaaccccgaaccgaccccctaaacctccgg

SEQ ID NO: 198652 - DNA, 896 bp, Homo sapiens
  misc_feature: GYAE6OF01A1ANL.18.59.F04.1.454.CMB.1.raw
  modified_base (104)..(104): a, c, t, g, unknown or other
  misc_feature (104)..(104): n is a, c, g, or t
  modified_base (201)..(201): a, c, t, g, unknown or other
  misc_feature (201)..(201): n is a, c, g, or t
tcagtacgagtatgcacgaccggtgctcgatttagtacacacacttagggattgggggctttgcctgggtgctgttggtaccaggagacataggttataaaccncaacgtactccacactagctcggcgtctcgactacttctctacctacctctactcaggcacgaggtcgtcggccgacgtcgtcgtcctagtacctcncgcctcgtcctccgtcgtcgttcgggttctaccgtgtacgtacgtacggctaccactacttctccgtcgacgtacgttacggaaccacggtacgagttcggttacggttaggttacggtttaagttaaccgtaacgtttcgttaccgtaccgttacggttaacctaaaccgtaacgcccaaccggaacggaaccaaaccggaacccctaaaaccgtacaaccgttacgttaacgtttaaacgttgtaacgttacgttaaccggtaacctttaaaccggtacccggtttaccgacccgggttttaacgggggtttaaccttaaaccggtttaccgggtttaccctttcggttaccggttcgggtaaaccccttacggttaaaccgggttacctacggggttaacccaaacgggttccccgtaacccgtttccccacgttacccgacgtttccctaacggtccggtaccgtccgaacgggtcgtaacggacggacgtacggacgttaggttaacttacgtttagtacgtaccggataacttcgtaaattacaacgtacggtaaccaacgttacgaacctaccctttacggttacccttacgggtttccggttaacccgtttaaccgggtaaacgggttaacccggttaacccgggtaaccggttaacccccgttaacggggttacgtaaacccgggg

SEQ ID NO: 198653 - DNA, 812 bp, Homo sapiens
  misc_feature: GYAE6OF01DZMTG.18.59.F04.1.454.CMB.1.raw
  modified_base (185)..(185): a, c, t, g, unknown or other
  misc_feature (185)..(185): n is a, c, g, or t
  modified_base (310)..(310): a, c, t, g, unknown or other
  misc_feature (310)..(310): n is a, c, g, or t
  modified_base (325)..(325): a, c, t, g, unknown or other
  misc_feature (325)..(325): n is a, c, g, or t
tcagtacgagtatgcacgaccggtgctcgatttagtacacacacttagggattgggggctggggtctcaggaggcagcgctctcgggactctccaccatggcctggctctgctattcctcaccctctcactcgagggcacgaggtcctgggaccctagtctgccctgactcagcctgcctcggtntcgtgggtctccgtggacagtcgatccactatctcctgcactacggaaccagtcgagtacggttacggttaggtacgttaactaacgttctcggttacctaccggtacggtaacccaaaccgganacccgtaaaccccgnggaaacctaaaacccggcccctaaaactcctatttaaggtattttaacgtagtaacgttcgtaccaaggtttaaccgcccgggttaacccgttcggttaaagggtttccctacgttcccgtacgttcccgttacgtccgactttaaccggtagtaaccggtcggaacctaacccggaccggttccctacccgtacggtaaaccctccgttccgttccgggtaacgttccgtacggtcggtaaaccgtacggaacgggtaccgtacgggtacgttaacgttacgtttacgttacgtcgtaaccgtactagtaacgtaacttacggtaaactacgaccgttaccgaactcgtttaaaccctgttaccggttagttaaccgggttaccggttaccgggtaaccttacccgggtaaaagttacccggtaacgttaaccccggtccgttaaacggacccggaaaccccggttacctaacccggtaaaccccc

SEQ ID NO: 198654 - DNA, 833 bp, Homo sapiens
  misc_feature: GYAE6OF01A3LP3.18.59.F04.1.454.CMB.1.raw
tcagtacgagtatgcacgaccggtgctcgatttagtacacacacttagggattggggggggagaggagccccagccttgggattcccaagtgttttcattcagtgatcaggactgaacacagaggactcaccatggagtttgggctgagctggattttccttgctgctattttaaaggtgtccagtgtgaggtgcagtctgggtggaggtcgtggggggaggtcgttacggggtaaacggcccggggggggttcccttaggtaccctcccccgttgtaccacggtcctcgtggacttcgtactttcaggtaacggccgtaggatagaacgtcggggtcccgccgaggcctccggaaggggaagggggtcgtgggtaggttggggttcgtaccgttaagttaaaaacccaaactggtagtcgggtagggaacaacgagaacgtacgactagacccgacccggtaaggaaacgggtccaaaggtacttacccgaaccctaacgtaccgtaacgaaaacggaaggtaacttaacggtaaactttaaaccgaaaaaacgtcccgaaacggttaccgttaacggtttaactcgttaacgaacctaaacgttaacgaaaccgtaaccgacccggttaagaaaccgggaaacccggaacggaacccgaaacggaccggtacccgttaggttaacctttaccgtaacctaaccctaccgtacctaccccgtaaagaaaccggtaccttaaccaaacccttaacgttacccgttaaacccgtacgggttacgtacccggtacccgttacgggaccggggtacccgtaaaccggggtaccccg

SEQ ID NO: 198655 - DNA, 620 bp, Homo sapiens
  misc_feature: GYAE6OF01EHAK1.18.59.F04.1.454.CMB.1.raw
  modified_base (178)..(178): a, c, t, g, unknown or other
  misc_feature (178)..(178): n is a, c, g, or t
  modified_base (195)..(195): a, c, t, g, unknown or other
  misc_feature (195)..(195): n is a, c, g, or t
  modified_base (232)..(232): a, c, t, g, unknown or other
  misc_feature (232)..(232): n is a, c, g, or t
  modified_base (283)..(283): a, c, t, g, unknown or other
  misc_feature (283)..(283): n is a, c, g, or t
  modified_base (329)..(329): a, c, t, g, unknown or other
  misc_feature (329)..(329): n is a, c, g, or t
  modified_base (348)..(348): a, c, t, g, unknown or other
  misc_feature (348)..(348): n is a, c, g, or t
  modified_base (417)..(417): a, c, t, g, unknown or other
  misc_feature (417)..(417): n is a, c, g, or t
  modified_base (613)..(613): a, c, t, g, unknown or other
  misc_feature (613)..(613): n is a, c, g, or t
  modified_base (617)..(620): a, c, t, g, unknown or other
  misc_feature (617)..(620): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtgttataactntgtctcctggtaccaanagcacccaggcaaaacgccccaaaatcatgtatttangtatgtacaactaatccggcctacgtaggggttacttatacgtcttcttcngtccgtcctagtctcgacgtacaaccggtccctccgtcaccgactntccgtacggtcgcctacgngtcgaggacgaggtctacgttattattaagtttgacgagtctactataactaacgaacgaaccacctanaccgtaaccttactcgttaacttcgttcgttaacggtacgtaacgggtaacgaacgtaccgtaccgtacgtacgtacgtaccgaccgaaccgacccaacccacctctaacgtctaccgtccgtcccctcccgtaccttcccattacctacgtaccgcgtacgccgggtagtcggtaggaaccgtggacttagacgngtannnn

SEQ ID NO: 198656 - DNA, 944 bp, Homo sapiens
  misc_feature: GYAE6OF01ARR25.18.59.F04.1.454.CMB.1.raw
tcagtacgagtatgcacgaccggtgctcgatttagtacacacacttagggattggggtctgggagaggagccccagccttgggattcccaagtgttttcattcagtgatcaggactgaacacagagactcaccatggagtttggctgagctggtattttcctgtctgtacttaagttttaaaacggtgtcctagtgtgtaggtgcgagtcgtggtggtagtcggtgggggtaggtcgttagggtaaaccggggtcccggggggttacccttacggtacccgtccccgtacggtaccgtacgtcccgttgtcggtactttaccgtacgtttaccgaaggttaaccggtccgtagggtaactacggtaaacgttccggggtacccgccgtacggtccggtaccggaagggggtaacggggccgttaggggtagggttcgggggtttaacgtaccggtttaaaacgttaaaaacccgaaaaccggttggtaaaggttacggggttaacgggaaacctaaacggtacggtaacgtaaccggtccgtaacggtacccgtaacccgggtaaacggaaaacggtaccgtaacggtaaccctttaccgaaacccttaagtacccgtaacgaaacggtaagtaaccgttaagtaaaccgttaaaacgaaaacggtccgtaaaccgttcgttaacgttaacgttaacgacggttaaaacctaacggtaactaaaccgtacggacccgttaaggaaaccgggaaccgaaacggtaaccgacgtaacgtccgtttaagttaacttaccggttaaccgtacctaaacccgtcgttaaacccccgaagtttaaacccggaccttaaaccgtaacccgttaacgtaaacccgttacggttaacccgggttaaccttaacccggggttccccgtaaaggggttcccggggaaaacccggg

SEQ ID NO: 198657 - DNA, 849 bp, Homo sapiens
  misc_feature: GYAE6OF01EGM6M.18.59.F04.1.454.CMB.1.raw
tcagtacgagtatgcacgaccggtgctcgatttagtacacacacttagggattggggtctgggagaggagccccagccttgggattcccaagttgttttcattcagtgatcaggactgaacacagaggactcaccatggagtttgggctgagctggtatttttccttgctgacttaattttaaaaggtgtccagtgtgaggtgcagctggtggagtcgtgggggagcgttagggtaaacgggtcccggggggtcccttaggacctccccgtgtaccacgtcctcgtggacttctactttcgaaggtaacggtcccgtaggtataggaaccggttcggggtacccgccgtaggcccgtacccgggaagggggaacgggggcgttaggggtaggggtttcggggtttcgggaaccgtttaaaccgttaaaaaacccgtaaaacgtaggtaaggtacgggttacgggaactaaaccgaaggtaaccgttaacggaccgttacgacccgaccggtaaggaaaacggcaaggttacttaccgaacctagtacctaacgaaacgggtagtaacgttagtaaacgttaaacgaaaaaaccgggtcctaaccggtacgttaacgttaagttacctaacggaaacctaaaacgttacgaaaccgtacggtacggtaaccgaaacggtaaaccggaaccggtacaaccggtacgtacccgtttagttaaccttaccgtaaccgtaacctacgtacccgttaacccgtaagtaaaccgtacccgttactaaaccgttaccttaacccgtaaacgtttaccggaacgttaccgtaaccggttccggtaacgggtaacccgg

SEQ ID NO: 198658 - DNA, 675 bp, Homo sapiens
  misc_feature: GYAE6OF01BJ07I.18.59.F04.1.454.CMB.1.raw
  modified_base (233)..(233): a, c, t, g, unknown or other
  misc_feature (233)..(233): n is a, c, g, or t
  modified_base (259)..(259): a, c, t, g, unknown or other
  misc_feature (259)..(259): n is a, c, g, or t
  modified_base (275)..(275): a, c, t, g, unknown or other
  misc_feature (275)..(275): n is a, c, g, or t
  modified_base (368)..(368): a, c, t, g, unknown or other
  misc_feature (368)..(368): n is a, c, g, or t
  modified_base (382)..(382): a, c, t, g, unknown or other
  misc_feature (382)..(382): n is a, c, g, or t
tcagtacgagtatgcacgaccggtgctcgatttagtacacacacttagggagttggggggggtctcaggaggcagcgctctcgggacgtctccaccatggcctgggctctgctattcctcaccctcctcactcagggcacgagggtcctgggcccagtctgccctgactcagcctgcctccgtgtctgggtctccgtggacagtcgatccaccatctcctgcacgtggaaccngcaggtgacgttggtagttataactntgtctcgtgtacaacngacaccaggacaacgaccccaatcatagtattatgatcgtacactacgtccgtcctcgtagggtttactatcgtctcgtctgtctacagtcgngacacgcgtcctcncacctatcgtcgtcggctcgcggcgtaggacgggacgtacggtacttagtaacgtttacgtacgtacgacgtacgtacttaaccgtaacttaacgtaaccggtaacgaccgtaacgacgaacgtaaccaccttaaccggtaacgttacccggtttaaaccgggaacccggttaacggggaaacccgttaaccgggtaccccgttaaacccgggttacccggttaaccggtacccggtaacccggtaaccccggtaaaccccggaaccccctaaaccccgtacggttaaccccg

SEQ ID NO: 198659 - DNA, 679 bp, Homo sapiens
  misc_feature: GYAE6OF01DJZZ1.18.59.F04.1.454.CMB.1.raw
  modified_base (235)..(235): a, c, t, g, unknown or other
  misc_feature (235)..(235): n is a, c, g, or t
  modified_base (267)..(267): a, c, t, g, unknown or other
  misc_feature (267)..(267): n is a, c, g, or t
  modified_base (290)..(290): a, c, t, g, unknown or other
  misc_feature (290)..(290): n is a, c, g, or t
  modified_base (347)..(347): a, c, t, g, unknown or other
  misc_feature (347)..(347): n is a, c, g, or t
  modified_base (565)..(565): a, c, t, g, unknown or other
  misc_feature (565)..(565): n is a, c, g, or t
tcagtacgagtatgcacgaccggtgctcgatttagtacacacacttagggattggggggggtctcaggaggcagcgctctcgggacgtctccaccatggcctgggctctgctattcctcacccctcctcactcagggcacgagggtcctgggcccagtctgccctgactcagcctgcctccgtgtcgtgggtcctccgtggacagtcgatccaccatcctctgcactaggaaccngtcctaggtcgtacggtttggtagtataactntcgtctcctaggtaaccaacgcnccaaccgacggaccaaaaccgacccccaaagtcaagtgtaatttcgagtattacgtntaactaatcccgggtacccttcggtaacgggttttacctaagtccgtccgtttctggttcgaccttaccgtaaggttcgtacggaccaacccgtacccggtccctaccctagacccttacttcgtaccgtcggtacctccgtacggcgtaggaggtaccggaggtcttagtactttatccgtgactacacttgaacttaacgtaactagaccggtacnccggaacttaccgtacgtaacgtaaccgttacggtaaccgggtacgaaccgggtaacgaccgtacctaccgtacgtacggtaccacggaaccccagaacccccaccgtcgtacc

SEQ ID NO: 198660 - DNA, 708 bp, Homo sapiens
  misc_feature: GYAE6OF01ARZ1U.18.59.F04.1.454.CMB.1.raw
  modified_base (215)..(215): a, c, t, g, unknown or other
  misc_feature (215)..(215): n is a, c, g, or t
tcagtacgagtatgcacgaccggtgctcgatttagtacacacacttagggattgggggctggggtctcaggaggcagcgctctcgggacgtctccaccatggcctgggctctgctattccctcaccctcctcactcagggcacagggtcctgggcccagtctgccctgactcagcctgcctccgtgtcgtgggtctcctggacagtcgatcaccntcctcctgcacgtcggaaccagcagtgtacggttggtagtttaataactatggtctcgtggtaccaacacgccaccaggaccaaacgcccccaaactcatacgtatttatgtatcgtacctaacgtaacgtccgtcccgtagtacgggtttctaatcgtcttctcgtcgtctacgtacgtcgtacggaccaacgtaccggtccctacccgtcgaaccctcgtaccgttcggtcgggtccctaccggtagggtcgtacgggaacgggtaacggacgggtctacggttactttaacgtttacgagtcctacggtacttactaagttaacctaaacgaaccgtcctaaccgacgtacctaaccttctaccgttacgttacggttaccggttaccggttaacccgggtacgggtaaaccccgtagggtacccccgttacccggttaacccgtcgggtaaccctaacccggaaccccggtaaccggtaaacccccccg

SEQ ID NO: 198661 - DNA, 695 bp, Homo sapiens
  misc_feature: GYAE6OF01DASFX.18.59.F04.1.454.CMB.1.raw
tcagtacgagtatgcacgaccggtgctcgatttagtacacacacttagggattgggggctggggtctcaggaggcagcgctcgtcgggacgtctccaccatggcctgggctctgctattcctcaccctcctcactcagggcacaggtcctgggcccagtctcgccctgactcagcctgcctcgtgtcgtgggtctccgtggacagtcgatccaaccatcctccgtgacctacgtacggaaccagcaggttggtacggtttggttaggttaattaacgttagttcgttccgttacccgttcggtaaacccaacgacgccgaacccgaacggaaccgaaaaccccgtaccccccaaaacttccaagttacgtaacttttagtagtacttcggtacctaacgtttaaccgtccggtacccctttaacggttacggggtttacctaacttccgttcttcctacggtcgtacctacgtaacgtcgtacgaccaaccggcccgtccctaccctcgacctactccgtcgtcggcctacgacggtcgtaggacggtacggtcgtagtagttacttacgttacgcgactcgacgttacagttaactacgacgtaccctagacgcctaacgttctacgtactcgttaccgtacggagacggtacaccggtctaccgtcgtagtacccacgccgtaccgtaacccc

SEQ ID NO: 198662 - DNA, 701 bp, Homo sapiens
  misc_feature: GYAE6OF01B12O0.18.59.F04.1.454.CMB.1.raw
  modified_base (213)..(213): a, c, t, g, unknown or other
  misc_feature (213)..(213): n is a, c, g, or t
  modified_base (233)..(233): a, c, t, g, unknown or other
  misc_feature (233)..(233): n is a, c, g, or t
  modified_base (271)..(271): a, c, t, g, unknown or other
  misc_feature (271)..(271): n is a, c, g, or t
  modified_base (318)..(318): a, c, t, g, unknown or other
  misc_feature (318)..(318): n is a, c, g, or t
tcagtacgagtatgcacgaccggtgctcgatttagtacacacacttagggattggggggggtctcaggaggcagcgctctcgggacgtactcctaccatggtcctgggctctgctattcctacaccctcctcactcgacgggcacgagggtcctgggcccagtctacgccctgacctcacgcctgccttccgtgtctgggtcctccgtggacngtcgactccactactcctcngcacgtacggaacagcagtgtacggttggtgtaatatntgtctcctacggtaaccagacgccaccgaggaccaaaccgccccaancatagtacttatgtatcgtacactaacgccgtccgtacgtacggttactacgtcgtcttcgtcgtcgtactaccgtaacgtcgtacggaccaacgtcccgtaccctccgtaacgacctacgtcctcgtccgggtcctcggacggtactacgggaacggtacggtacgtaccgttattaacgttacctacgtacgtactcggtataccgtaactacaaacgtacgaccctaccgtatacccgttacctacgttactaccggtttacgttaccggttaacccggaaacggttaccggaacccgttaccggttaccccggtaacggtttcccgaaacggttacccacccggtaaccccgaccccggtaacccgtaaccccggtacg

SEQ ID NO: 198663 - DNA, 730 bp, Homo sapiens
  misc_feature: GYAE6OF01CH63N.18.59.F04.1.454.CMB.1.raw
tcagtacgagtatgcacgaccggtgctcgatttagtacacacacttagggagttggggggggtctcaggaggcagcgctctcgggacgtctccaccatggcctggctctgctattcctcaccctcctcactcagggcacgtacgggtcctcgggcccagtctcgccctgactcagcctcgcctccgtgtcgtgggtcctccgtggacaggtcaatccacctatcctcctgcacgtacggaaccagctaggtgtacggttggtagttataactattcgtctaccgtaggtaaccaaacgacgaccaacccgaggaaccaaacccggacccccaaatcaagttgtaatttatagtacgttcgtaacctaagtacgtcccggtacccgtacggttagggtttacctaacgttcccttcttcgtacgttcggtactacccgtaagtcgttcggaacaaccgtaccgtcctcccgtagacctacttccgtcgtacggccttacgacgtgacggtacggacgtcgtattaggttaactttacggttaacgtcgtaccgtagtacctacgtaactaaagaaccggtaacaccctaacgtacaccgtactcgttaacttcgttacggttaccggtaccgggaacgttaaccgggtaactaaccggttcccgtaacccggtccttaaacgggtaccctaacccggaacccgttaaacccgaccccgtaaacgttacccg

SEQ ID NO: 198664 - DNA, 760 bp, Homo sapiens
  misc_feature: GYAE6OF01C4F1Z.18.59.F04.1.454.CMB.1.raw
  modified_base (171)..(171): a, c, t, g, unknown or other
  misc_feature (171)..(171): n is a, c, g, or t
  modified_base (256)..(256): a, c, t, g, unknown or other
  misc_feature (256)..(256): n is a, c, g, or t
  modified_base (307)..(307): a, c, t, g, unknown or other
  misc_feature (307)..(307): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactnagcctgcctcgtgtctgggtctccgtggacagtcgatcaccatcgtcctgcactggaaccagcagtgacgttggtgttataactntgtctctggtacaacagccaccagcaaacgccccaaactcactgactttangtatgtcaagttaacgtccggtccctacggtacggggttttactaacgttccgttctttccgttcgtcgggtccttaccgaaaggttcgttacgggacctaaaccgaccgggtccccttacccgtacggaccctacttccgttcggtcgggtcctacccggaggtaccgttagggaacggggtaccggacgggtaccgttacggttaaacgttttactttaaccgtcggaacctaggtaccgttaactaacttaacgttaaacccgaaaggaccctaaccgtaacggtaccctacttacccgtttacgtacggtttacggttacccgtttaccggggtaaacggttaccggggtaaacccgtaaccggggtttaacccctaaccccgggtttaccggttaaaccgggttaccgaaacccccgggtcccgtaaaacccggggtaaacccccccg

SEQ ID NO: 198665 - DNA, 765 bp, Homo sapiens
  misc_feature: GYAE6OF01ADD0P.18.59.F04.1.454.CMB.1.raw
  modified_base (299)..(299): a, c, t, g, unknown or other
  misc_feature (299)..(299): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtcgtacgttggtagttaataactatcgttcctccgtggtaaccaacacgccaccgaggaccaaaccgaccccaaatcatgtactttatgactgtacaactacgtccgtccgtacggtacgggtttactatccgtactttcncgtcggcctacgtacgtcgtacggaccacgccgtccctccgtcgactcgtacttccgtacggtcggcctacgaggtcgtagggaacggacggtacgtcttaagtaactttacgtacgtcgacgtacgtacctaacgtaattaaccgtaaacgaccgaccctaaccgaccgtcctacgttaccttacgttacgttaccgttaaccggtaccgtaaccggtaccgggtaaccgtaccgggttacccgtacccggttaccgtacgtaacccggacccgtaccccgaaaccggtaccccctaaccgttacgttaccgttacccgttaccgttccccgtttacccgtacccccttacccgttcccttaacccgtccgttaccggtaccggtcgggaacccggggttcggtaccgggtacccggttaacgccggggtacctaacggttacgacggttcaggttcagtcctag

SEQ ID NO: 198666 - DNA, 609 bp, Homo sapiens
  misc_feature: GYAE6OF01DMRVZ.18.59.F04.1.454.CMB.1.raw
  modified_base (218)..(218): a, c, t, g, unknown or other
  misc_feature (218)..(218): n is a, c, g, or t
  modified_base (229)..(229): a, c, t, g, unknown or other
  misc_feature (229)..(229): n is a, c, g, or t
  modified_base (256)..(256): a, c, t, g, unknown or other
  misc_feature (256)..(256): n is a, c, g, or t
  modified_base (529)..(529): a, c, t, g, unknown or other
  misc_feature (529)..(529): n is a, c, g, or t
tcagtacgagtatgcacgaccggtgctcgatttagtacacacacttagggagttgggggggggtctcagggaggcagcgctctcgggacgtctccaccatggcctgggctctgctattcctcaccctctcactcagggcacagggtcctgggcccagtctgccctgactcagcctgcctccgtgtcgtgggtctacgtggacagtcgatcacatctcngcactggaacngcagtggacgttggtacgttataactntcgtctctcggtacaacagcacccgaggaccaaacgaccccaaactcatcgtattactgatacgtcaactaatccggccctacgtacggggtttctaagtacgtcttcgtcgtggcctacgagtctacggccgaacgaccggtccctcctcgaaccaacgttctacgtcgggcctaccgaggtccgtaggacgggaagacgggtacttaggtaatttagtaacgtcgacgtcgtactaccgaataacgaactaacgacctacaacgtacactntctactcgtcgttacgaacgtcggaaccaggtcctaaccgtcgtaggtaccacgacccgaacgacccctaacccgtaccg

SEQ ID NO: 198667 - DNA, 823 bp, Homo sapiens
  misc_feature: GYAE6OF01B7EMY.18.59.F04.1.454.CMB.1.raw
  modified_base (809)..(809): a, c, t, g, unknown or other
  misc_feature (809)..(809): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcacatctcctgcactggaaccagcagtgacgttggtggttataactatgtctcctgtaccaacagcaccaggacaaacgaccccaaactcatgatttatgatgtacactaatccggcctcgtagggttctaagtcgtcttctcgtggcctacctaagtctacggacctaaaccgaccggtccctacccgtacgaccctaacgtccttcggttacggggccttacccggaggtaccgttagggaaacgggtaccggaacgggtaccttaggtaaacttttaacgtttaacgtacgtaccgtaaacggtcctttaacgtaaacttaaacgtaaaccgaaaaggtacccgaaacggacccgaacggtaaccctaaaccgtttaaccgtaaaaccggttttacccggtttaacccggggaaaaccggtttaccggggggtaaaaccccctaaacggggtttaccccgtaaaccccgggttaacccgtttaaccgggggtaaccctaaacccgggtaacccccgtaaaccgggaaccccctaaacccccgtaacgttaccgtacctaacccgtttccgttacccgttacccctaccccgttacccttacctaacgttaccgtccgttaacgtacgggacggtacgggtccgtaacgggaccgaacgggtcgactaaggtacgngactagctagtgac

SEQ ID NO: 198668 - DNA, 734 bp, Homo sapiens
  misc_feature: GYAE6OF01E3FMI.18.59.F04.1.454.CMB.1.raw
  modified_base (526)..(526): a, c, t, g, unknown or other
  misc_feature (526)..(526): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctctcactcagggcacgacgggtcctcgggcccaggtctcgccctgactcagcctgcctcgtgtcgtcgggtctccgtggacagtcgactcacctactcctcctaggcctaacgtagggaaaccaggccgtaagggttcggtaacgggttttgggtttacggtttaaacttaaacctgttcgttcccgttacccgttaggttaacccaaacgtaccggacccaacccgaacgggaacccaaaaacccggtaccccccctaaaaacgttcctaagttacggtaattttagtacgtaagttcgtacctaactaacggttcccggcccttacgggttaacggttttactaacgttcgtcctttctacgtcggtctaccgtaaggtcgtacgaccaacgaccgtccnccgtacgacctcgtccttcggtcggtcctacgacggtacgtacggacgggaacggtcgtagttagtaactttacgttacgtcgtacgacgtacttacaattaacgaactaccgaccacacgtactactctactgttacgttcgtacgtacggtcggaacgaccgtcgtacctagtacggacaccgaacccgacgtacccacccgtacg

SEQ ID NO: 198669 - DNA, 710 bp, Homo sapiens
  misc_feature: GYAE6OF01A67WG.18.59.F04.1.454.CMB.1.raw
  modified_base (241)..(241): a, c, t, g, unknown or other
  misc_feature (241)..(241): n is a, c, g, or t
  modified_base (287)..(287): a, c, t, g, unknown or other
  misc_feature (287)..(287): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctctcactcagggcacagggtcctgggcccagtctcgccctgactcacgcctgcctccgtgtcgtgggtcctccgtaggacagtcgactccacctatctcctgcacgtggaaccanctagtcggacgttggtacgttaataactatgtctctaggtaccaanacaccaccaggaccaaccgacccccaaacgtcacgtagtaattttacgtagtactacggtactaaaccttaacgtcccgtcccgttaggtacgggtttactacgtccgtcttcgtcgtcgtcctacgtaacgtcgtacggacctaaaccgccggtcccctccgtacgtacctacgttccgtccgttacgggccctacgtaggtccgtaacggaccgggacggttaacgggtccgttagttaaaccgtttacgtaccgtcggtaactaccggttctaactaacgttaacaaccgtaaccgtaccaacacggccttaaccttctacttacggttgttaccggttaccggtaccgacgggttaacgtacccgtacccgttaaccgtccgttacggacctaaccggaccccggacgtaaaccccccg

SEQ ID NO: 198670 - DNA, 581 bp, Homo sapiens
  misc_feature: GYAE6OF01CXIY9.18.59.F04.1.454.CMB.1.raw
  modified_base (549)..(549): a, c, t, g, unknown or other
  misc_feature (549)..(549): n is a, c, g, or t
  modified_base (556)..(557): a, c, t, g, unknown or other
  misc_feature (556)..(557): n is a, c, g, or t
  modified_base (560)..(560): a, c, t, g, unknown or other
  misc_feature (560)..(560): n is a, c, g, or t
  modified_base (563)..(563): a, c, t, g, unknown or other
  misc_feature (563)..(563): n is a, c, g, or t
  modified_base (567)..(569): a, c, t, g, unknown or other
  misc_feature (567)..(569): n is a, c, g, or t
  modified_base (571)..(574): a, c, t, g, unknown or other
  misc_feature (571)..(574): n is a, c, g, or t
  modified_base (576)..(581): a, c, t, g, unknown or other
  misc_feature (576)..(581): n is a, c, g, or t
tcagtacgagtatgcacgaccggtgctcgatttagtacacacacttagggattgggggctttgcctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcgaggggtttctaatcgcttctctgctccagtctggacaacacggcctcctgaccatctctgggctccgaggctggaggacgaggctgatttattactgcagctacattaactacaagcagcagccactacgtaacgttccgttacgggaaccgtcgggaacctaacggtccaccgtccgtaggtccacgaccccgtaacggacccctaacccctacttcgtaccgtacctccgttacccgttacccccctaccccgttaccctacccgtaacgttacccgtaccgttaacgtcggacggtccggggtcgtacgggacgaacgggccgtacgtacgtacgctgntacgcanncgngcncgcnnncnnnncnnnnnn

SEQ ID NO: 198671 - DNA, 780 bp, Homo sapiens
  misc_feature: GYAE6OF01CSE0O.18.59.F04.1.454.CMB.1.raw
  modified_base (205)..(205): a, c, t, g, unknown or other
  misc_feature (205)..(205): n is a, c, g, or t
  modified_base (236)..(236): a, c, t, g, unknown or other
  misc_feature (236)..(236): n is a, c, g, or t
tcagtacgagtatgcacgaccggtgctcgatttagtacacacacttagggagttgggggctggggtctcaggaggcagcgctcgtcgggacgtctccaccatggcctgggctctgctattcctcaccctctcactcagggcacagggtcctgggccctagtctgccctgactcagcctgccctcgtgtctgggtcctcgtggacncgtcgatccacatctcctgcacgtggaaccngctagtgacgttggtagtaataactagtcgtcctctacggtaaccaacgtacgcccacccgaggaccaaaccgaccccctaaatccgtatacgtaatttagagtatacgtactaactaacgtccggtcctacggttacgggttactaacgttcggtacctttcgtccgtcggtccgtacctaacgtcggtacggacctaaccggtcccggtaccccttcccgtagtaccctacggtcctttaccgggtcgggtacctaccgggtacggtacgttacgggaacggggtaccgttaaggggtacctttagggttaacctttacgttaccggtggacctaccggtcctacttaactaaccgttaaccgaaccgtaccgaaccgtccgtacctaccgttaccttacgttaaaccttccggttacccgggttaaaccggtaccgggtaacccgggttaaacccggacccgggttaaccccgtaccccggttacccggttaaccggtacccgtaaaccccggtcccccgttaaaccgggtaacccccccc

SEQ ID NO: 198672 - DNA, 690 bp, Homo sapiens
  misc_feature: GYAE6OF01EHXJ5.18.59.F04.1.454.CMB.1.raw
  modified_base (492)..(492): a, c, t, g, unknown or other
  misc_feature (492)..(492): n is a, c, g, or t
  modified_base (511)..(511): a, c, t, g, unknown or other
  misc_feature (511)..(511): n is a, c, g, or t
  modified_base (526)..(526): a, c, t, g, unknown or other
  misc_feature (526)..(526): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctctcactcagggcacgagggtcctgggcccagtctcgccctgactcagcctgcctccgtgtctgggtctccgtggacagtcgatccaccatctcctgcactcggaaccagcagtgacgtttggtagttaataacgtatgtccttcctaggtaaccaactacgaccaaccccgaaggaccaaaaccggacccccctaaaacgtctaagttaggtaactttagtagtacttcggttacctaacttaaacgttccccggtccccgttacgggttacggggttttacctaacgttcccgttactttccgtcgtacggtcctaccgtaacgtcgtacggaccaaccgtccggtccctaccgtacgaccctnttcctcggtcggcctacgngtcgaggacggacgngtctagttacttacgtactcgactgtactacaattaacacgaaccgtaccaccgtacgcctaccgttctcttacggtacgttccggtaacggtaccgtacgggtaacctacggtaccctaccggttaccgtacgaccgacccgacccggtaaccgtaacccccg

SEQ ID NO: 198673 - DNA, 629 bp, Homo sapiens
  misc_feature: GYAE6OF01A7WCC.18.59.F04.1.454.CMB.1.raw
  modified_base (231)..(231): a, c, t, g, unknown or other
  misc_feature (231)..(231): n is a, c, g, or t
  modified_base (255)..(255): a, c, t, g, unknown or other
  misc_feature (255)..(255): n is a, c, g, or t
  modified_base (311)..(311): a, c, t, g, unknown or other
  misc_feature (311)..(311): n is a, c, g, or t
  modified_base (316)..(316): a, c, t, g, unknown or other
  misc_feature (316)..(316): n is a, c, g, or t
  modified_base (358)..(358): a, c, t, g, unknown or other
  misc_feature (358)..(358): n is a, c, g, or t
  modified_base (527)..(527): a, c, t, g, unknown or other
  misc_feature (527)..(527): n is a, c, g, or t
  modified_base (624)..(624): a, c, t, g, unknown or other
  misc_feature (624)..(624): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatcctcctgcacgtggaaccngcagtgacgtttggtgttatactntgtctccgtgtaccaatagccaccaggaccaaacgcccccaaatctatgtatttanagatntacaactacgtccgccttcgtagggtttctaatcgtcttacncgtacgtctacgaacgtctacggaccaaccgtacccggtcccttacccgtacgacctacgttccgtccggtacggggtaccctccggaacgggtcccgttaagggaccgggtaacgggtacggtaccgttagttaaactttacgtaaccgttcgaccgtacgtccttanaacgttaacaacggaacgtcgaagtcgacgtcaacgtcgtactacgtacgaacgtcggacacgtcaccgttcgacgtcacgaccagcccaacccgtntaccg

SEQ ID NO: 198674 - DNA, 963 bp, Homo sapiens
  misc_feature: GYAE6OF01D947M.18.59.F04.1.454.CMB.1.raw
  modified_base (216)..(216): a, c, t, g, unknown or other
  misc_feature (216)..(216): n is a, c, g, or t
tcagtacgagtatgcacgaccggtgctcgattttagtacacacacttagggagtttgggggggggtctcaggacggcagcgctctcgggacgtctccaccatggcctgggctctgctattcctcaccctctcactcagggcacacgggtcctgggcccagtctgccctgactcaacctgcctcgtgtctcggtctcgtggacagtcgatcgaaccntcctcctgccacgtaggaaccgtcaggtgtacggtttggtgttaactaactgtcgtcttccttacggttaaccaacgtacgccacccgaggaccaaaccgacccccaaactcaacgtcgtaactttagtggtacttgtacgtaagttaacgtccggtacccgtacggttacggggtttacttaacgttcgtacctttaccgtacgttcgggtaccttaccgtaacggtccgtacggacccgtaaacggtaacccggggtcccttaccccgttacgtaacccggttaacgtttacccgtttacgggtttacgggtccccgtttaacccggaacggggtttaccccgttaacggggaaacccgggttaaaccgggtaacgggttacccggtttaaacgggttttaaccttttaaaccgttttaccggtacgggtttaacccgtaacgggtttacctttaaccgttaaacgtttaaaccgtttaaaccgtaaacggtttacccgaaacgggttaaccgtaaaccggttaaccgttaacccggtttaaccggtttaaaccgggtttacccccgggtttaaggggttaaacccggtaaccggggtttaaaccccggggaacgggtttttaaccccggaaacccgggtttacccggttaaacgggtaaccccgtaaacccgggttaacccccggtaaaccccgggtaaacccccgtttaaccccggaaccgttttacccgggttaaacccccg

SEQ ID NO: 198675 - DNA, 821 bp, Homo sapiens
  misc_feature: GYAE6OF01BXFDP.18.59.F04.1.454.CMB.1.raw
  modified_base (234)..(234): a, c, t, g, unknown or other
  misc_feature (234)..(234): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcgctcagggcacagggtcctgggcccagtctgccctgactcagcctgcctccgtgtcgtgggtctccgtggacagtcgatcacatctcctgcacgtcggaaccngcgagtggacggtttggtagttaataacttagtctctcctacggtaaccaacacgccaacccgacggaccaaaaccgaccccccaaaactccagttacgttattttaagtagtacgttacgtacctaaccttacggtccccgtcccgttacggttaacggggttttaacctaacgttccgtccttttacgtccgttagggcccttaaccggttaacgtccgttacgggacccgtaaaccgtccccgggttacccccttaccccgttaccgaacccgttaacgttcccgtcccggttcggggtacccttacccgggtacggtacccggtacgggaacggggtaaccggtaggtaccggtttaacgttaaacgtttttacgtaaccggtcgtactaacgtaaccgttactaaagtttaaccgaacgaaccgtaccctaacccgacttaaccgtcccttacttacgtttacgcccggtttaaccgttacgggtaaccggtaaccgggtaaccgtaacccgggttccccgaaccgtttaccggtaccggtaaacccgacccggtaaaccccggtacccgtaaaccccccgg

SEQ ID NO: 198676 - DNA, 730 bp, Homo sapiens
  misc_feature: GYAE6OF01CTXL3.18.59.F04.1.454.CMB.1.raw
  modified_base (180)..(180): a, c, t, g, unknown or other
  misc_feature (180)..(180): n is a, c, g, or t
  modified_base (214)..(214): a, c, t, g, unknown or other
  misc_feature (214)..(214): n is a, c, g, or t
  modified_base (251)..(251): a, c, t, g, unknown or other
  misc_feature (251)..(251): n is a, c, g, or t
  modified_base (254)..(254): a, c, t, g, unknown or other
  misc_feature (254)..(254): n is a, c, g, or t
tcagtacgagtatgcacgaccggtgctcgatttagtacacacacttagggattgggggctggggtctcaggaggcagcgctcgtcgggacgtctccaccatggccgtgggctctgctattccctcaccctcctcactcgagggcacgacgggtcctcgggcccagtctcgccctgactcncgcctcgcctcgtgtcgtcgggtctccgtggacngtcgactcaacctctcctcctgcctacgtcggaaccncgngacgttggacgtttgggttagttaactaacgttgtcgttccgtaccggtaggtaacccaacgtaccgacccgtaacccgaggaaccccaaaaccccgtaccccctaaaagttccaaagtttcgttaatttggtataacgtttcgtaacctaacgtaacccggtcccggtccttacggggttaacggtttacctacgttccgtctttccgtacggtccgtcctacggtacgtcgtacggaactaacccggtacccgtcccttaaccgacgttacccgtaacttcccgtccggtccggtccctacggtcggtcgtacgggacggtacgtgtacgtagttacgtttactcgtcgctacgtactctaaatcgaaacacgcctaactaccgtactacctacgtactacgtccgtacgtacggtacggtaacgacccggttacgccgtcgtaacgcgaccgaacccgaccgaacccgtaccc

SEQ ID NO: 198677 - DNA, 717 bp, Homo sapiens
  misc_feature: GYAE6OF01E3AZL.18.59.F04.1.454.CMB.1.raw
  modified_base (139)..(139): a, c, t, g, unknown or other
  misc_feature (139)..(139): n is a, c, g, or t
  modified_base (321)..(321): a, c, t, g, unknown or other
  misc_feature (321)..(321): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctctcactcaggcacngggtcctggcccagtctgccctgactcagcctgcctccgtgtcctgggtctcctggacagtcgatcaccatcctcctgcactggaaccagcagtgtacgttggtaggttataactgtgtctcctggtaccaacacgccaccacggacaaaccgacccccaaactcgactagtactttagtanatagtactaactaacgtccggtaccctacggttacgggtttactaacgtccgtacgttctcgtcggtacctaccgaacgttcgtacggactaaccgtacccggtcccttacccgtacgacctacgttacgtccggtaccgggtcctaccgacgggtccgttacgggaacgggtaccggtagggtactacggtaacttttaacgttacgtcgctaacggtctaactaattaaccgtaaacgaacgacctaaccgtaactacgtacccttacgttaccttgttacgttaaccgtacggtaaaccggtcggggtaaaccctaaccggttacccgaccggttacccgtaccggttacaacccggaacccgaacccggtaaccccgaaccccgttaaccgg

SEQ ID NO: 198678 - DNA, 834 bp, Homo sapiens
  misc_feature: GYAE6OF01B7GLL.18.59.F04.1.454.CMB.1.raw
tcagtacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgctattttaaaaggtgtccagtgtgaggtgcagcgtggtggagtcggtgggggaggtcgttagggtaaacgggtcccggggggttacccttacggaccctcccctaggtaccgacgtcctcgtggtacttcctactttcgaggtaacggccgtggtatggtaaccgtcggggtcccgccgacggccgtccggaagggggacggggtcgtgggtaggttggggttacggtaccgttaaacgttaaaaacccgaaaacgtggtacggtagggtacgggaaaccaaacgaacgtaccgtacgccgtacgacccgtacccggtaagggaaacgcgtaacgtactaccacctactcctacgaagtagtatagaacttaaacgaaaacgtccgtaacgtcttaacgtacttaccgtaagtaaacctaaagtacgaaaccgtcgtacccggtaaggaaaccggaacccggtaaacgacccgaacgggtaccggttaccggtttaattaacccgttaacccgtcctaaccccgtaacccgtacccgttaacccccgaagggtaaacccgttcccgtaaaccctaaacccggtttaacccttaacggttaaaccggttaacccgggttacgtaaccccgggttacccgtacgggggtccccgggaaaaccccgggg

SEQ ID NO: 198679 - DNA, 650 bp, Homo sapiens
  misc_feature: GYAE6OF01CZX27.18.59.F04.1.454.CMB.1.raw
  modified_base (195)..(195): a, c, t, g, unknown or other
  misc_feature (195)..(195): n is a, c, g, or t
  modified_base (224)..(224): a, c, t, g, unknown or other
  misc_feature (224)..(224): n is a, c, g, or t
  modified_base (313)..(313): a, c, t, g, unknown or other
  misc_feature (313)..(313): n is a, c, g, or t
  modified_base (524)..(524): a, c, t, g, unknown or other
  misc_feature (524)..(524): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcaggcacagggtcctggcccagtctgccctgactcagcctgcctcgtgtctggtctcctggacngtcgatcaccatctctgcactggaaaccngcagtgtacggttggtagttataactatgtcttcctggtaaccaacacgccaaccagaccaaacgacccccaaatcactagtatttaangtatgtactaactaactccggtcctcggtacggttactaagtccgtcttcgtctcggtctacctaagtcgtacggacaacgtaccgcctccctagacccatccgtacgtcgggccttcgacggtctgggaacggtacgtaggtccttagtaactttaacgttaccgtgactacgtcgtaacctagttaacgtaacaacggacctaccgaancctaaccttctacgttaagtcgttaccgtacggtaaaccggttcgggaaacccgtaacggtcctaaccccggttccgtacgggtaccctaaccggacccaaaccggtaccccaaccccgttaaccg

SEQ ID NO: 198680 - DNA, 707 bp, Homo sapiens
  misc_feature: GYAE6OF01DFBOA.18.59.F04.1.454.CMB.1.raw
  modified_base (203)..(203): a, c, t, g, unknown or other
  misc_feature (203)..(203): n is a, c, g, or t
  modified_base (238)..(238): a, c, t, g, unknown or other
  misc_feature (238)..(238): n is a, c, g, or t
  modified_base (263)..(263): a, c, t, g, unknown or other
  misc_feature (263)..(263): n is a, c, g, or t
  modified_base (277)..(278): a, c, t, g, unknown or other
  misc_feature (277)..(278): n is a, c, g, or t
  modified_base (309)..(309): a, c, t, g, unknown or other
  misc_feature (309)..(309): n is a, c, g, or t
  modified_base (311)..(311): a, c, t, g, unknown or other
  misc_feature (311)..(311): n is a, c, g, or t
  modified_base (472)..(472): a, c, t, g, unknown or other
  misc_feature (472)..(472): n is a, c, g, or t
  modified_base (481)..(481): a, c, t, g, unknown or other
  misc_feature (481)..(481): n is a, c, g, or t
tcagtacgagtatgcacgaccggtgctcgatttagtacacacacttagggattggggggggtctcaggaggcagcgctctcgggacgtctccaccatggcctgggctctgctattccctcacccctcctcactcagggcacgagggtcctgggcccagtctcgccctgactcagcctgcctcgtgtctgggtctccgtggacngtcgatccaccagtctcctgcctacgtcggaaccngcagtgtacgttggtagttatactntgtctctagacacnnccaccagaccaaacgccccaatcatgtattngntacgtctaacgtacgtccggtcctaggtacggttctacgtcgtcttcgtcgtacggctaccgagtcgtcggacctaacgccgtaccctcccgtagtaccctagttcctcggtcggacctaccgaggtcgtaggacgggacgtagcttagtactttactcgngtcgtaacnccttaatactaacgtaacgaccgaccaacggtaccgccgttaccttccttaacgtttacggtttacgttaccccggttaggggttaaacccggacccggggttaaacggtaaccccggtttaccccggtaaacccgggtttaaccccgggtaacgggttaaccccgaaaaccccgggttccccaaaaaacccccgggttcccccgttaaaaaccccgtttcccggg

SEQ ID NO: 198681 - DNA, 736 bp, Homo sapiens
  misc_feature: GYAE6OF01C1QKT.18.59.F04.1.454.CMB.1.raw
  modified_base (205)..(205): a, c, t, g, unknown or other
  misc_feature (205)..(205): n is a, c, g, or t
  modified_base (224)..(224): a, c, t, g, unknown or other
  misc_feature (224)..(224): n is a, c, g, or t
  modified_base (551)..(551): a, c, t, g, unknown or other
  misc_feature (551)..(551): n is a, c, g, or t
tcagtacgagtatgcacgaccggtgctcgatttagtacacacacttagggagttgggggggggtctcaggaggcagcgctctcgggacgtctccaccatggcctgggctctgctattcctcaccctctcactcgagggcagacgggtcctgggcccagtctcgccctgactcacgcctgcctcgtgtcgtgggtcctcgtggacngtcgatcaccatcctaccngccacgtacggaaccagtcaggttggtacggtttgggtagttaactaacgtagttcgtccgtacgtacggtaaccaacgtacgacccaacccgaaggaccgaaaacccgtaccccccaaaacgtcctaagttagtaactttagtagtacgttcgtactaacgtaacgtcccgcccgttacggtacgggtttaactacgtccgtcctttcgtaccgtcgtacctacgtaacgttcgacgtaaccgtaacgcccggtccctccgtacgtaaccctcgttccgtacgtcgggtaccctaccggtaggacgtagggacggaacgtacggtnttacgttatttacgtacgtagtcgtactacttcaaattacgtaacgaccgtacctaacgccgtacctacgttcttaactcgttacggtaccgtaacgaccggttacggaacccgtaaggttccccgaaccgttacggtaaccggtccgaacccgtacccggaaaccgtccccctaaccggttacc

SEQ ID NO: 198682 - DNA, 853 bp, Homo sapiens
  misc_feature: GYAE6OF01CBEHG.18.59.F04.1.454.CMB.1.raw
  modified_base (200)..(200): a, c, t, g, unknown or other
  misc_feature (200)..(200): n is a, c, g, or t
  modified_base (212)..(212): a, c, t, g, unknown or other
  misc_feature (212)..(212): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacgagggtcctgggcccagtctgccctgactcagcctgcctcgtgtctgggtctcctggacngtcgatccaccntcctcctgcactggaaccagcagtgtacgttggtagttataactgtcgtcctcgtacgtaccaacacgaccaccgaggaccaaaccgacccccaaactcagtacgtatttatgtatcgtactaacgtaacgtcccggtcccgttacggttacggggtttacctaacgttccgttactttcgttccgttcggtaccctaccgtaacggttaccgtcggtaaccctaaacggtacccgtccccgttcccctacggtaacccttacgtccgttccggtcgggtcccgttaccgagggtccgtaggggaaccggtacgggtacggttccgttagttacgtttaacgttaccgtgtaccgtacgtcttaacgtaacttaacgtaacctaaccggacccgtaaacccgtacggtaacccttaccgttaccgtttaacctttaacggttacccgggttttaacccggttaaccggggttaaacccggggttaacccgggggttaaacccccggttaaccggggtttaaccccccgttaaccccggggttttaaccccgggtaaccgggttaacccccggtaaaccccgggtaaccccgggtaaaaccccccgggtaaccccccgtaaaaccccccggtttaccccggg

SEQ ID NO: 198683 - DNA, 922 bp, Homo sapiens
  misc_feature: GYAE6OF01BELJX.18.59.F04.1.454.CMB.1.raw
tcagtacgagtatgcacgaccggtgctcgatttagtacacacacttagggattggggtctgggagaggagccccagccttgggattcccaagttgttttcattcagtgatcaggactgaacacagaggactcaccagtggtaggtttgggctgagctggtattttccttgctgtcttaagttttaaaaggtgtacctagtgtggaggtagcaggtcgttgggtgggtaggtcgggtagggggagggtacgttaggggtaaacgggtcccgggggggttacccgttacggtacccgttccccgtacggtaccacgtccgttcgtaggtacttccttacttacgtaacgtaaggtacccgtaggtagtaacggtacggttaccggggtccgtacccgaacgggtccgtacccgggaaggggggtaacgggggaccgggttagggggtacggggtttacgggggtttacggggtaaccggtttaaacgttaaaaaacccgtaaaacgttacggtaaggttacgggtagggtaaacgtaaacgtacggaacgtacgccgttacggacccgtaccggtaacggaaacggacgtacgtaacttaccgtaccgtaactacgtaccaagtaagtacgtaagtaattaaaccgaaaacgtaccaacgttactacgttaagttaccgtataaaccgaaagtacgaaccgtaacgtaccgtaacggaaccggaacggaaccggaacgacggtaaaccgtaccgtttacgttaaaccttaccgtaaccgttaacccgtaaccgtacccgttaacccctaaggtaaaccgtaacccgttaaactaaacccgtaacctttaacccgtaaacccgggtttacgtaaccggtttaacccgggtccgggttaaccgggtaacccggggtaaacccgggg

SEQ ID NO: 198684 - DNA, 694 bp, Homo sapiens
  misc_feature: GYAE6OF01EMPPI.18.59.F04.1.454.CMB.1.raw
  modified_base (230)..(230): a, c, t, g, unknown or other
  misc_feature (230)..(230): n is a, c, g, or t
  modified_base (256)..(256): a, c, t, g, unknown or other
  misc_feature (256)..(256): n is a, c, g, or t
  modified_base (262)..(262): a, c, t, g, unknown or other
  misc_feature (262)..(262): n is a, c, g, or t
  modified_base (274)..(274): a, c, t, g, unknown or other
  misc_feature (274)..(274): n is a, c, g, or t
  modified_base (277)..(277): a, c, t, g, unknown or other
  misc_feature (277)..(277): n is a, c, g, or t
  modified_base (312)..(312): a, c, t, g, unknown or other
  misc_feature (312)..(312): n is a, c, g, or t
tcagtacgagtatgcacgaccggtgctcgatttagtacacacacttagggagttgggggggggtctcaggaggcagcgctctcgggacgtctccaccatggcctgggctctgctattcctcaccctctcactcagggcacgagggtcctgggcccagtctcgccctgactcagcctgtccctcgtgtcgtgggtctccgtggactagtcactccaccatctcctgctacnggaacagcagtcgagttggtagtaanactatntctctgtaccanacncaccagacaaacgccccaactcatcgtatttagtnacttgacactaacgtccgcccttaggtacgggtttactaagttctcttctcgtcgtctacgaagtctacggacaacgtccgtaccctcgtacgacctactctacgtcggtcctaccgaggtccgaggacgggtaacgacggacgttagtaacgtttacttaacggtcgtacgaacgttaccctaagtaacttaaccgttaaacggtaacgtacccaaacgtaaccgtacctacctttacccttaacgttagtttaccggttaacccggtttaacgggaaaccggttaaccgggttaaacccgaacggttacccgtaacccggttaacccggttaggacccgtaaccgaacccgtaacccggaacccccgtaaccctaaccgg

SEQ ID NO: 198685 - DNA, 813 bp, Homo sapiens
  misc_feature: GYAE6OF01ACYXT.18.59.F04.1.454.CMB.1.raw
  modified_base (246)..(246): a, c, t, g, unknown or other
  misc_feature (246)..(246): n is a, c, g, or t
  modified_base (791)..(791): a, c, t, g, unknown or other
  misc_feature (791)..(791): n is a, c, g, or t
tcagtacgagtatgcacgaccggtgctcgatttagtacacacacttagggagttggggggggtctcaggaggcagcgctctcgggacgtctccaccatggcctggctctgctattcctcaccctcgtcactcaaggcacacgggtcctgggcccagtctgccctgactcagcctgcctccgtgtctcggtcctcctggaccagttccgactccaccagttcctccgtgacctacctgggtaacccnggcctaagtcggtaccgttttgggtacggtttaattaaccgtagttcggttccgttcccgttacggggttaacccaaaccgtacggtacctaacccgacgggtaaccaaaaccggtaccccccctaaaacgtcccgtaaactttacggtaacttttaacgtaacggtacgtttacggtaccgtaaacggtaacgttccccggggtaccccttaccggttaacgggggttttacctaaacgttccggttaccgttacctttaccgtagggtcccttaccgtaaggtcgtcggacaaccgtaccggtacccttccgtacgtaacctgtaccgtacggtcgggtacctacgacgggtacgttacggacgggtaccgtacggtaccgtagttaacgttacgttacgtcggacgtacgtcgtactagtacgtaaccgagttaccagtacacggactacgtaccgaaacggttccttacggaaccgtacgggtaacccgtacggttacccgtccgtacccgttaagtccccgtacggacccccggtaaccncccctaacccgtcgttaacccg

SEQ ID NO: 198686 - DNA, 645 bp, Homo sapiens
  misc_feature: GYAE6OF01BYIM9.18.59.F04.1.454.CMB.1.raw
  modified_base (320)..(320): a, c, t, g, unknown or other
  misc_feature (320)..(320): n is a, c, g, or t
  modified_base (503)..(503): a, c, t, g, unknown or other
  misc_feature (503)..(503): n is a, c, g, or t
  modified_base (559)..(559): a, c, t, g, unknown or other
  misc_feature (559)..(559): n is a, c, g, or t
tcagtacgagtatgcacgaccggtgctcgatttagtacacacacttagggagttggggggggtctcaggaggcagcgctctcgggacgtctccaccatggcctggctctgctattcctcaccctcctcactcagggcacgaggtcctggcccagtctgccctgactcagcctgcctcgtgtctgggtctccgtggacagtcgatcacctatctcctgcactcggaaccagctagtcgtacgttggtagttaataactgtcgtctccgtcggtacaacgagccaccaggaccaaacgacccccaaatcgattcgtatttangtactgtacactaagtccgccctagttagggtttactaacgttcgttaccgttctccgtcggtaccttaccgtaaggttccgttacggcaaacccgtccggtccctcccgtacgacctacgtccgttcgtcgggtacctcgtacgcgtaggacggtacggaaggtctaggtatttaacgtcgnacagactacgtaattaacgaacaccgacgacccagtcgtaaccttctactacgttntaccggttacgacggtaccggactaacggtccgtaaccgtacgtacggtaccgtaccgaaccccacggtacccctaacccgtaccg

SEQ ID NO: 198687 - DNA, 731 bp, Homo sapiens
  misc_feature: GYAE6OF01DZR9N.18.59.F04.1.454.CMB.1.raw
  modified_base (354)..(354): a, c, t, g, unknown or other
  misc_feature (354)..(354): n is a, c, g, or t
  modified_base (724)..(724): a, c, t, g, unknown or other
  misc_feature (724)..(724): n is a, c, g, or t
  modified_base (726)..(726): a, c, t, g, unknown or other
  misc_feature (726)..(726): n is a, c, g, or t
  modified_base (728)..(728): a, c, t, g, unknown or other
  misc_feature (728)..(728): n is a, c, g, or t
  modified_base (730)..(731): a, c, t, g, unknown or other
  misc_feature (730)..(731): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagccacccaggaccaaacgacccccaaactcatgtatttatgatgtcactaagtccggccctcgtacggggtttctaatccgtcttctctggcctaccaagtcgtggaccaaccgaccggccctcccctcgaccatcctcgtcgggcctccgaggtcnggacggacggaggcttagtaatttacttacgtacgcacgtcttacgtaattaacgaacctaacgaccctaaccgacgtacctaaccttcttacttacgttcggttaccgttaaccggggtaaacggttaccggggaacccgtaaaccgggttcccgtaaccccgggtttacccgttaacgggtacccaacgggaccccccaaacgggacccccaaacccccgtcgttaccgttcccgtacccttcccgttaccccgttccccccgtaccccttccccttaccctaccgtttacccgttaccggttaaccgccgggtacgggcccggggtaccgttacggggacccggtaacgggacccgacgtaagtcgnancngnn

SEQ ID NO: 198688 - DNA, 929 bp, Homo sapiens
  misc_feature: GYAE6OF01BDWWL.18.59.F04.1.454.CMB.1.raw
tcagtacgagtatgcacgaccggtgctcgatttagtacacacacttagggattgggggggggtctcaggaggcagcgctctcgggacgtctccaccatggcctggctctgctattccctcaccctcctcactcagggcacgacgggtcctgggaccctagtctcgccctgactcacgcctcgcctccgtgtcgtcgggtctcgtggactagtcgactacaccattcctccgtacgacctaccgtacggaaccacgtacgtaaggttacggtaacggtttgggtttacgtttaaactaaacgttacgttacgtttcccgtaccgttaaccgggtaaacccaaaccgtaacgaacccgtaaacccgaacggaaaccccaaaaccccggtaacccccctaaaccgtaccgtaagtttaacggttaacttttacgtacggttacgttacggttacctaaaccgttaccgttaccccggttcccgttacggttaaccggggttttaaccttaacgtccgttaccgtttccgtaccgttacggtaccttaaccgtaacggttaccgtacccggtaaccgtaaacccggtacccggtaccccgttaccccgtacgtaaaccccgtttaccgtttaccgtacccgggtacggggttacccctaccggggtaaccggtacgggtaacgggtaaccgggaccgggttacgtacccggttaagtttaaacgttaaccgtttaccgtacgaacgttacctactaagttaaaccgtaataacccgaaccgaacccttaaacccggccgtaacccttactaccgttacttaacgtcgttaccgggtaacgtaaccgggtaacggtacccgtaacggttacccgaccgggttaccgtaaccggtaccgaaccgaaccccggtaccaaccccgtaaaccggtacc

SEQ ID NO: 198689 - DNA, 785 bp, Homo sapiens
  misc_feature: GYAE6OF01E1OZ7.18.59.F04.1.454.CMB.1.raw
  modified_base (779)..(779): a, c, t, g, unknown or other
  misc_feature (779)..(779): n is a, c, g, or t
tcagtacgagtatgcacgaccggtgctcgatttagtacacacacttagggattgggggagagagacccctcccctgggatcctgggcccagtctgccctgactcagcctgccctccgtgtctgggtctcctggacagtcgatcaccatcctcctgcactggaaccagcagtgacggttggtggttaataactatgtctccgtacggtaaccaacagccacccgaggaccaaaccgacccccaaactcagtagtatttatgatcgtactaacgtaacgtcccggtcccgtagtacgggtttactaactcgtcttctcgtcggtctaccgacgtcgtacggaccaaccgacccggtccctcccgtacgacctacgtccgtccggtcgggtccctaccggagggtctacgggaaggaccggtaggtcttacgttaatttacgtaccgtgtaccgtagtaccttactaagtaacctaacgaacacccaccgacgtacctacctcgtttacctacggttaccgttacggttaaccgggtaaccggtaccgggtaaccgaacccgggttcccgtaacccgggttaccgttaacgggtacctaaccccgggaaccccgaaaccccgggtaccccctaaccccgtaactacccggtacccttaccccttccccgttacccgttaccccccaccccgttaccctaccgttacccttaccgtacccggttacgggtaccggtacggggtcccggtaggtacccgggaacggtaccggaccgtaggaacngctagc

SEQ ID NO: 198690 - DNA, 716 bp, Homo sapiens
  misc_feature: GYAE6OF01DQV6K.18.59.F04.1.454.CMB.1.raw
  modified_base (251)..(251): a, c, t, g, unknown or other
  misc_feature (251)..(251): n is a, c, g, or t
  modified_base (423)..(423): a, c, t, g, unknown or other
  misc_feature (423)..(423): n is a, c, g, or t
  modified_base (611)..(611): a, c, t, g, unknown or other
  misc_feature (611)..(611): n is a, c, g, or t
  modified_base (637)..(637): a, c, t, g, unknown or other
  misc_feature (637)..(637): n is a, c, g, or t
  modified_base (675)..(675): a, c, t, g, unknown or other
  misc_feature (675)..(675): n is a, c, g, or t
  modified_base (706)..(706): a, c, t, g, unknown or other
  misc_feature (706)..(706): n is a, c, g, or t
  modified_base (711)..(712): a, c, t, g, unknown or other
  misc_feature (711)..(712): n is a, c, g, or t
  modified_base (714)..(714): a, c, t, g, unknown or other
  misc_feature (714)..(714): n is a, c, g, or t
  modified_base (716)..(716): a, c, t, g, unknown or other
  misc_feature (716)..(716): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtggacgttggtagttaataactatgtcctccgtaggtaccaacacgccacccgacggaccaaaccgaccccctaaaatcattagtattttagngtagttacgtaccaaccgttaacgtcccggacccgttacggttacggggtttacctaacgtaccgttccttccgttcgtcggtaccttaccgaacgtcgtacgactaaccgccggtccctccgtacgaccgtactccggtcgtcggcctaccgagcgtaggaacggtacggngtactagttaacttaacgtcgtacgcgtaacgtctaacgtaactaacgtaaaccgaccgaccctaactaccgtaccttaccttaccttcgttaggttaccggttaaccggtacggtaaacggtacccggtaaaccgtacgttaccctccggtacctacggacccaccgacccggacccacccaacctntcgtactaccctcgtaccccttcccncccttacactactccgtaccgtcgtcggacggtccggnggtaccgaacggcggacgtaacctggtaacncgtanngngn

SEQ ID NO: 198691 - DNA, 705 bp, Homo sapiens
  misc_feature: GYAE6OF01BWIF2.18.59.F04.1.454.CMB.1.raw
  modified_base (224)..(224): a, c, t, g, unknown or other
  misc_feature (224)..(224): n is a, c, g, or t
  modified_base (266)..(266): a, c, t, g, unknown or other
  misc_feature (266)..(266): n is a, c, g, or t
  modified_base (300)..(300): a, c, t, g, unknown or other
  misc_feature (300)..(300): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcactagggtcctgggcccagtctgccctgactcagcctgcctcgtgtctgggtctcctggacagtcatcacatctctgcactgaaccngcagtgtacgttggtagtataactatgtctctggtaccaacngacaccagacaaacgccccaatcatagtatttangatcgtacaactaacgtccgtaccgttacgtacggtttactacgtactctttctcgtacgcctacgtaacgtcgtaggacctaacgaccgtccctaccgtacgaacctctacgtcgtcggtactaccgaggcgtacggaacggtacgacggtacgttacgttaatttaacgttaacgtggtacagtccttaactaacgttaacaaccgtaagaacctaacccgtaaccgacctttaaccgtactttacttaacggtttacgtttaccggttaaacccgggttaacgttaacccggggtaaacctaacgggtttaccccggtaacccgttaacccggtaaccggttacccgtaacccggtaaaccccgaaaccccgggtacccccgttaaacccggttaaccccgg

SEQ ID NO: 198692 - DNA, 571 bp, Homo sapiens
  misc_feature: GYAE6OF01EK7D6.18.59.F04.1.454.CMB.1.raw
  modified_base (197)..(197): a, c, t, g, unknown or other
  misc_feature (197)..(197): n is a, c, g, or t
  modified_base (557)..(557): a, c, t, g, unknown or other
  misc_feature (557)..(557): n is a, c, g, or t
  modified_base (562)..(562): a, c, t, g, unknown or other
  misc_feature (562)..(562): n is a, c, g, or t
  modified_base (566)..(566): a, c, t, g, unknown or other
  misc_feature (566)..(566): n is a, c, g, or t
  modified_base (568)..(569): a, c, t, g, unknown or other
  misc_feature (568)..(569): n is a, c, g, or t
tcagtacgagtatgcacgaccggtgctcgattttagtacacacacttagggattgggggctttgcctgggtcctgggcccagtctgccctgactcagcctgcctccgtgtctgggtctcctggccagtcgatcaccatctcctgcactggaaccagcagtgacgttggtggttataactatgtctcctggtaccaanagcacccaggcaaacgcccccaaatcatgatttatgatgtccactaatccggcccttacgaggggtttactaactccgcttctcgtcggcctccaagttctggacaaccgaccggtccctacccgtcgaccctatccgttcgtacgggtcctccgtaggtccgtaggacggtacggacggtctaggtattacttacgtcgcagtctataacgtataacagcagccagcaactctaagttccgtacgacgttggacctaggcctacgtctagtcacgccagcccacctgcgtcactctacgtccctccctctccattacctcgacgtcgccggcggccgtcgtacgacggtccacgtaacncgtanctangnncg

SEQ ID NO: 198693 - DNA, 816 bp, Homo sapiens
  misc_feature: GYAE6OF01D0414.18.59.F04.1.454.CMB.1.raw
tcagtacgagtatgcacgaccggtgctcgatttagtacacacacttagggattgggggggggtctcaggaggcagcgctcgtcgggacgtctccaccatggcctgggctctgctattcctcaccctcctcactcagggcacgacgggtcctgggcccagtctgccctgactcagcctgcctccgtgtcgtgggtctcctggacaggtcgactccacctatccgtcctagcacgtacggaaccagcagtcgtacggttggtaggtttaaactaactagttcggttcctccgtacggtaacccaacacgtaccaacccgaaggaccaaaaccgtacccccaaaactccgtaagttaggtaacttttaagtacgaagttcggtaacctaaacgttaaaccgtccgggtacccttacggtaacggggttttactaacgtccggttcctttacgtccggtacgtccctaaccgtaaggttccgtacggtaaccctaacggacccggtccccttaccgtacgtaaccctacgttccgtcggtacggtcccgacgtaacgggcgttacgggaacgggaacggtaccggtacgttaagtacgttttaacgtacccgtaggtacctacggtaacttactaaacgttaagtaaacccgtaacgacctaaacccgaacgaccttaccgtacccttaacttacgtccggttaacccggttaaggaaaccgggttacgggaacccgtaaacggttacccgtaacccggtacttaccgggtaaccggaccccgaaccggtaacccggtaaccccgtaaaccccgtttacc

SEQ ID NO: 198694 - DNA, 733 bp, Homo sapiens
  misc_feature: GYAE6OF01BDL1Z.18.59.F04.1.454.CMB.1.raw
  modified_base (229)..(229): a, c, t, g, unknown or other
  misc_feature (229)..(229): n is a, c, g, or t
  modified_base (249)..(249): a, c, t, g, unknown or other
  misc_feature (249)..(249): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgacctcagcctgcctccgtgtctgggtctcctggacagtcgatcaccatctcctgcactggaaccngcagtgacgtttggagttanaactatgtctctggtaccaacagcaaccagaccaaacgcccccaaactcatcgtatttatgatgtcaactaactcgccctcgaggggtttctaagtcgtcttactctcggtcctacctaagtctacggcctaaaccaccgggtcccttccccgtacgaccctacgttacccttacgttcggggacctacccggacggccgttacgggacgggtaaccgagggtcctaagggtaatttaacgtttaacgtcggtcgtaaccggtctttaccgtaatttaacgtaaaccgaacgtaacccgtaaccaaccggtaaccttaacccttcgttaacgttaccttaaccggttccggtttaaaccggtaaacgggttaccgggtaaaccccggttaaggtccccgttaaccccggttacccggttaacgggtttacccgaacccggaccccgtaaaacccggtaaccccccgaaccccctttaaacccgg

SEQ ID NO: 198695 - DNA, 649 bp, Homo sapiens
  misc_feature: GYAE6OF01EQ0A5.18.59.F04.1.454.CMB.1.raw
  modified_base (226)..(226): a, c, t, g, unknown or other
  misc_feature (226)..(226): n is a, c, g, or t
  modified_base (251)..(251): a, c, t, g, unknown or other
  misc_feature (251)..(251): n is a, c, g, or t
  modified_base (266)..(266): a, c, t, g, unknown or other
  misc_feature (266)..(266): n is a, c, g, or t
  modified_base (300)..(300): a, c, t, g, unknown or other
  misc_feature (300)..(300): n is a, c, g, or t
  modified_base (306)..(306): a, c, t, g, unknown or other
  misc_feature (306)..(306): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacaggggtcctgggcccagtctgccctgactcagcctgcctcgtgtctgggtctctggacagtcgatcacatctctgcactggaaccngcagtgacggttggtgttataactntgtctcctgtaccanacgcaccagacaaacgaccccaatcatgatttanagtatntacactaactcgcctgtagggtttctaagtcgtctctcgtagctcgatctcggacacgcgtcctcctgaccattctcgtcggtcctccgaggcgtcggaggacgacggtcttaggtaacttttacgttactgtcacggtacttacaagttaacgtaacgtaaaccgaccgaaccaccggtactaacctttcccttacgttaaccgtttggttacccgttaaccggggttaacgtcccgggggttaaaacccgaacgggttaccccaaccccgggtttacgttaaacccggtaccgacccgtaaaccccgggaaccggtaaccccccgaaaccctttaccccgg

SEQ ID NO: 198696 - DNA, 758 bp, Homo sapiens
  misc_feature: GYAE6OF01BYDNV.18.59.F04.1.454.CMB.1.raw
  modified_base (354)..(354): a, c, t, g, unknown or other
  misc_feature (354)..(354): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacgagggtcctgggcccagtctcgccctgactcagcctgcctccgtgtcgtgggtctcctggacagtcgatcaccatcctcctgccacgtacggaacctagcgtaagtgacggtttgggtacggtttaactaacgttagtcgttcctccgtacggtaccctaacgacgccaacccgagacctaaaccggacccccaaatccgtagttagtaatttanacgtagttacgtacctaacgttaacgtcccgtcccgttacgggttacgggttttaacctaacgttccgtcctttacctcgtcggtacctacgtacgttggtcgaacctacgacccgcccttacccacgtacctacgtccgtaccgtcggtaccgtaccgtacgggtacgtacgggaacggaacgggtacgtcgttaacgttatttaccgttacgtacggactcgtacctaactactaacgttaacgaccgtaaccgtaccgacgtacctaccgttacttaccgttacttacgttaccggtaaccggtaacggtaccgggtaaccgtaacgggtcccgtaccgtttaaccgggacctaaccggtacccgaacccggtaaaccccgtccccgtaaccccgtacccg

SEQ ID NO: 198697 - DNA, 733 bp, Homo sapiens
  misc_feature: GYAE6OF01BEMSK.18.59.F04.1.454.CMB.1.raw
  modified_base (349)..(349): a, c, t, g, unknown or other
  misc_feature (349)..(349): n is a, c, g, or t
tcagtacgagtatgcacgaccggtgctcgatttagtacacacacttagggattggggggggtctcaggaggcagcgctctcgggacgtctccaccatggcctggcgtctgctattcctcaccctcctcactcagggcacgagggtcctgggcccagtctgccctgactcagcctgcctcgtgtctgggtcctccgtggactagtcgatcaccatcctcctgccacgtcggaaccagctaggtgtacggttggttagttaataacttatgtcctccgtacggtaaccaacgtacgaccaacccgaaggaccaaaaccgcccccctaaaatcaagttacgtattttaacgngtaacttcggtacctaacgttaacgtcccggtacccgttacggttaacgggttttacctaacgtccgtactttccgtcgtcggtacctaccgtaagtccgtcggacaactccgtaacgtccccttacccgagtaccctacgttcgtccgtgggccctacgtacgggtcgtaggaacgggacggaggtcgttagttactttaacgtaccgtgtaccgtacgtccttaacgaacttaacgaaccgtaacgacctaaccgacgtccctaaccttccttaacgtacgtttccgtacccggttaacggaaccggtccggggtaaacctacggggtaccctaccgtacgtaacggaccaaccggtaaccccacgggcccctaaaccccgg

SEQ ID NO: 198698 - DNA, 661 bp, Homo sapiens
  misc_feature: GYAE6OF01CVGZ3.18.59.F04.1.454.CMB.1.raw
  modified_base (233)..(233): a, c, t, g, unknown or other
  misc_feature (233)..(233): n is a, c, g, or t
  modified_base (248)..(248): a, c, t, g, unknown or other
  misc_feature (248)..(248): n is a, c, g, or t
  modified_base (258)..(258): a, c, t, g, unknown or other
  misc_feature (258)..(258): n is a, c, g, or t
tcagtacgagtatgcacgaccggtgctcgatttagtacacacacttagggattggggggggtctcaggaggcagcgctctcgggacgtctccaccatggcctgggctctgctattcctcaccctctcactcagggcacagggtcctgggcccagtctcgccctgacctcagcctgcctcgtgtctgggtctccgtggacagtcgatccaccatcctcctgcacgtcggaaccngcagtcgtagttggngttataactntgtctctcggtacaacacgcaccaggacaacgaccccaactcatgtacttatagtatcgtactaagtactcggcctacgtacgggtttactactcgtcttctctcggtctcgtacgtcgtacgctaaccgacggtcctaccgtcgacctactcgtaccgtcggcctaccgaggtcgtacggtaggacggaacggtccgtagtactttacgttacgtcgtactacgtctactacgtaactacgaacgtacaacgacgtacgtacctattaccgttaagttccgttacgttacgggtaaacgttaccgggtaaccggtaacggttacccgtacccgggttacccgttaccggtaccggtaaacccgaccccgttaaaccggaaccccgtaacccccgtaacccgg

SEQ ID NO: 198699 - DNA, 754 bp, Homo sapiens
  misc_feature: GYAE6OF01DVWEB.18.59.F04.1.454.CMB.1.raw
tcagtacgagtatgcacgaccggtgctcgatttagtacacacacttagggagttgggggggagaggagccccagccttgggattcccaagtgttttcattcagtgactcaggactgaacacgagacgactcaccagtggaggtttggctgagtcttggtattttccgtgctgtacttaagttttaaaggtgtccgtagtgtggtacggtgcgagtcgtgggtgtggtcggtggggagtcggttagggtaacgggccgggggttacctacggaccgtcccgtagtacacgtcctgagtctctacttcgagtacggtctaggatcgacggtcggtccacgtcggtcgtacggagggagggtcgtgggtaggttcgggtaccggtaaccgttaaacgtaaaccgaagtgtagtaggtacggaactaacgagtacgacgtcgtacgtaccgaacgtaggaagtactacggtacttacgaacctagtaccgaagaagtgtacgtacgtaacgtaaactaaacgcgtacgttagttagactacgtacgaaccaacgtgaaccgtacgactacgggaacgaccggtagaccctaacggtcgtcgttaacttagttacccgtacggtaacaccggtaccgttacccgaaggtaacccgttaccgtaaccgtaacgttaacccggttaaccgttaaccgggtacgggttaccgttaccggacccggttaacgggtaccgggtaaacggtacccgggtacccgg

SEQ ID NO: 198700 - DNA, 579 bp, Homo sapiens
  misc_feature: GYAE6OF01A72L0.18.59.F04.1.454.CMB.1.raw
  modified_base (229)..(229): a, c, t, g, unknown or other
  misc_feature (229)..(229): n is a, c, g, or t
  modified_base (253)..(253): a, c, t, g, unknown or other
  misc_feature (253)..(253): n is a, c, g, or t
  modified_base (305)..(305): a, c, t, g, unknown or other
  misc_feature (305)..(305): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcactggaaccngcagtgacgttggtgttataactntgtctctgtaccaacagcaccaggacaaacgcccccaaactcatgtatttangatgtacactaagtccgccctcgtagggtttactaagtcgtcttctcgtcggctaccaagtcgtggacaacgccgccctcctacgaccatcgtcgtcgggcctccgaggtctaggacggacggaggtctagtaatttacgttacgtcgcacgtctactaataacgtaacaacgtaccaaccgacgtaccacctctctagtcgttaccgttacggacgtacggacctaacggtccaccgtacgtacggccacgacccgaacgcccaacccgtacg

SEQ ID NO: 198701 - DNA, 734 bp, Homo sapiens
  misc_feature: GYAE6OF01DGQHE.18.59.F04.1.454.CMB.1.raw
  modified_base (234)..(234): a, c, t, g, unknown or other
  misc_feature (234)..(234): n is a, c, g, or t
  modified_base (730)..(734): a, c, t, g, unknown or other
  misc_feature (730)..(734): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtaggttataactatgtctcctggtaccaacacgcaccaggacaaacgccccaaactcatgtatttangtatgtactactaacgtccggcctcgtacggggtttactaacgttccgtcctttcgtcgttcggccttaccgaagtcgtacggaccaaaccgcccggtccctaccccgtacgacctacttccgtcggtccgggtcctccggacggtcgtagggaacggacggagggtactagttaactttacgttacgtacgacgtacgtactactaaactaacgtaaccgacgtacccaacgtactaccttaccttaccgttacttacggttacggtttaacccggttaaccgggtaaaccgggtaccgggtaaaccgttaaccggttacccgtacccggttaccggtaacgacccgtaacccgaccccgtaacccggtacccccaacccgttacgttcctaccgttcccttacccgttccccgttacccctaccccgttccttaaccgtcgttaccgtccgtaacggcggtaccggcggtacgacggacgcgacgacagtcgannnnn

SEQ ID NO: 198702 - DNA, 581 bp, Homo sapiens
  misc_feature: GYAE6OF01AYORA.18.59.F04.1.454.CMB.1.raw
  modified_base (393)..(393): a, c, t, g, unknown or other
  misc_feature (393)..(393): n is a, c, g, or t
  modified_base (498)..(498): a, c, t, g, unknown or other
  misc_feature (498)..(498): n is a, c, g, or t
  modified_base (541)..(541): a, c, t, g, unknown or other
  misc_feature (541)..(541): n is a, c, g, or t
tcagtacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggattttccttgctgctattttaaaaggtgtccagtgtgagtgcagctggtggagtcgtggggggaggtcgttgggtaaaggccgggggggtcccttagacctcccctgtacagcctctggattcactttcagtaacggcctggatgaactcggggtccgccaggctccgagggagggctgggagtgggtggccgtaataaaaccgaaaactgatggtaggacaacgagaactacgntacgcaccgtagaaaggcagtacttcaccatctacgaagagatagacttacgaaaaagcagtacctgtatctgacgaatgaacagcctagaacgtaacgacgganacgagtccgtagtacttactcgtaccacgacctccctagaacncgtacgtaacctactactacgtaagtcgcgtaccgtccgg

SEQ ID NO: 198703 - DNA, 572 bp, Homo sapiens
  misc_feature: GYAE6OF01D7I6U.18.59.F04.1.454.CMB.1.raw
  modified_base (134)..(134): a, c, t, g, unknown or other
  misc_feature (134)..(134): n is a, c, g, or t
  modified_base (542)..(542): a, c, t, g, unknown or other
  misc_feature (542)..(542): n is a, c, g, or t
  modified_base (546)..(546): a, c, t, g, unknown or other
  misc_feature (546)..(546): n is a, c, g, or t
  modified_base (548)..(549): a, c, t, g, unknown or other
  misc_feature (548)..(549): n is a, c, g, or t
  modified_base (551)..(551): a, c, t, g, unknown or other
  misc_feature (551)..(551): n is a, c, g, or t
  modified_base (553)..(554): a, c, t, g, unknown or other
  misc_feature (553)..(554): n is a, c, g, or t
  modified_base (556)..(564): a, c, t, g, unknown or other
  misc_feature (556)..(564): n is a, c, g, or t
  modified_base (566)..(572): a, c, t, g, unknown or other
  misc_feature (566)..(572): n is a, c, g, or t
tcagtacgagtatgcacgaccggtgctcgatttagtacacacacttagggattgggggctttgtctgggtctcctggacagtcgatcaccatctcctgcactggaaccagcagtgacgttggtggttataactntgtctcctggtaccaacagcacccaggcaaacgcccccaaatcatgatttatgatgtcactaatcggcctgaggggtttctaatcgcttctctcggctaccaagtctggacaacacggcctccctgaccatcctcgtgggacctccgaggtctaggacggaaccgagggcctagtaatttaactttacgtcgcctacggttcctaagtcgaaccaacttaactctacaggttcggttcgttcgggggtcttcgggcggagggtacccgaggctcggaccggtcggcgggtcacgaccgaacggcctcccgtaccccgtcggtcctacttccgtcggttaccccaccctccgtacctagttacctcgtactcggacggtcggcttcggacgaacggccataacgtatgngtcncnngngnngnnnnnnnnncnnnnnnn

SEQ ID NO: 198704 - DNA, 697 bp, Homo sapiens
  misc_feature: GYAE6OF01D49H3.18.59.F04.1.454.CMB.1.raw
  modified_base (574)..(574): a, c, t, g, unknown or other
  misc_feature (574)..(574): n is a, c, g, or t
  modified_base (677)..(677): a, c, t, g, unknown or other
  misc_feature (677)..(677): n is a, c, g, or t
  modified_base (680)..(681): a, c, t, g, unknown or other
  misc_feature (680)..(681): n is a, c, g, or t
  modified_base (683)..(683): a, c, t, g, unknown or other
  misc_feature (683)..(683): n is a, c, g, or t
  modified_base (686)..(691): a, c, t, g, unknown or other
  misc_feature (686)..(691): n is a, c, g, or t
  modified_base (694)..(697): a, c, t, g, unknown or other
  misc_feature (694)..(697): n is a, c, g, or t
tcagtacgagtatgcacgaccggtgctcgatttagtacacacacttagggattggggggctttgtcgtgggtctcctgggacaggtcgatcaccatctcctgcactggaaccagcagtgacggttggtggttataactatgtctccgtcggtaaccaacacgccacccgaggaccaaaccgaccccaaactcatgtatttatgatcgtacaactacgtccggtcctacggtacgggtttactacgtcgtcttcgtcgtcgtacctaccgtaagtcgtacgacaacgtacccggccctaccgtaccgacctacttcgttccgggcggtcccgtaaccggacggacgggtaacggggtaacgggaacggggtacggtaccgtaggtttaacttttaaccgttacgcgtaccggtactacctactaagtaactaaccgaaccactaaccgacactcctacttctacgttcgtcgttacggacgttacgggaacctacgtcgtaaccgtacgagtaccgaccgtacccgaactaccctaaccctcgttaccgacctccgttacccgtcccttaccccnccccgttccaacctaccgttactaacggttccggaacggtccgggcgttacgggaccgggtaaccgtagggaccctaggtaagcccgtgaccttgacgctgancgnncnacnnnnnncannnn

SEQ ID NO: 198705 - DNA, 684 bp, Homo sapiens
  misc_feature: GYAE6OF01AM05I.18.59.F04.1.454.CMB.1.raw
  modified_base (142)..(142): a, c, t, g, unknown or other
  misc_feature (142)..(142): n is a, c, g, or t
  modified_base (188)..(188): a, c, t, g, unknown or other
  misc_feature (188)..(188): n is a, c, g, or t
  modified_base (220)..(220): a, c, t, g, unknown or other
  misc_feature (220)..(220): n is a, c, g, or t
  modified_base (242)..(242): a, c, t, g, unknown or other
  misc_feature (242)..(242): n is a, c, g, or t
  modified_base (244)..(244): a, c, t, g, unknown or other
  misc_feature (244)..(244): n is a, c, g, or t
  modified_base (274)..(274): a, c, t, g, unknown or other
  misc_feature (274)..(274): n is a, c, g, or t
  modified_base (354)..(354): a, c, t, g, unknown or other
  misc_feature (354)..(354): n is a, c, g, or t
  modified_base (489)..(489): a, c, t, g, unknown or other
  misc_feature (489)..(489): n is a, c, g, or t
tcagtacgagtatgcacgaccggtgctcgatttagtacacacacttagggagttggggggggtctcaggaggcagcgctctcgggacgtctccaccatggcctggctctgctattccctcaccctcctcactcagggcacgngggtcctgggcccagtctgccctgactcagcccttgccctccggtntcgtcggtctccgtaggctagtcgatccactnttcgtcctgactacgtgaaccngnagtcgacggttttgggtacgttaaatactntgttcctccgtacggtaaccaacacgacctaaccgaacggtaccaaacccgtaccccctaaatcctattagttacttacngtactcgtactacgtacgtccgtaccgtggttaccggttactacttccgtcttaccttgacgtctaccgtagtccgtcgtaaccaccgtccgtcccttccgactacctacgtccgtcggtccggtaccttaccgngggtaccgtaggaaccggtacgtacggtcgttacgtatttaccggttacgtcgtactcgtacttaacgataaccaacgtaccaccgtacgaatccctaagttcctaattcgtacgtccgtaacgggtccgtaccggtacgtacgtcccccggtatccgggtaacgccgtaacgacccaccgaccccgtcgtaccg

SEQ ID NO: 198706 - DNA, 640 bp, Homo sapiens
  misc_feature: GYAE6OF01DCNED.18.59.F04.1.454.CMB.1.raw
  modified_base (245)..(245): a, c, t, g, unknown or other
  misc_feature (245)..(245): n is a, c, g, or t
  modified_base (247)..(247): a, c, t, g, unknown or other
  misc_feature (247)..(247): n is a, c, g, or t
  modified_base (301)..(301): a, c, t, g, unknown or other
  misc_feature (301)..(301): n is a, c, g, or t
  modified_base (355)..(355): a, c, t, g, unknown or other
  misc_feature (355)..(355): n is a, c, g, or t
  modified_base (527)..(527): a, c, t, g, unknown or other
  misc_feature (527)..(527): n is a, c, g, or t
tcagtacgagtatgcacgaccggtgctcgatttagtacacacacttagggattgggggctggggtctcaggaggcagcgctcgtcgggacgtcctccaccatggcctgggctctgctattcctcaccctcctcactcagggccacgacgggtcctcgggccctagtcctcgccctgactcacgcctgcctccggtgtcgtggtcctcctggacaggtcatcaccatctcctgaccacgtcgaacngnacgtgtaacggttggtaggttaataactatcgtctaccgtaggtaaccaaacgngacctaaccgacggaaccaaaaccgaccccctaaaagtcaacttagtaatttanaggtaattcggtacttaagtaacgtccggtacccgttaggtaggtttactacttacgcttcgtagtcgtactaccgagtcgtacgacaacgaccgccctacacactactcgtcgcgtcacgtgcgaggtcggacgcggtattacgtaattacttaccgtgagtacgcgtaanaacgtactaaagacgaactcgaaccaccataacccgtagtaacgtccggtaaccgacggtaacgaccgtacgcaaccggtatacggacaccgggaccacccgccgtaaacccg

SEQ ID NO: 198707 - DNA, 732 bp, Homo sapiens
  misc_feature: GYAE6OF01CKENE.18.59.F04.1.454.CMB.1.raw
  modified_base (202)..(202): a, c, t, g, unknown or other
  misc_feature (202)..(202): n is a, c, g, or t
  modified_base (233)..(233): a, c, t, g, unknown or other
  misc_feature (233)..(233): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacgagggtcctgggcccagtctcgccctgactcagcctgcctcgtgtctgggtctccgtggacngtcgatcaccatctcctgacacgtggaaccngcaggtcggtacggttgggtagttataactatcgtcctaccgtacggtaaccaaactacgaccaacccgaggaaccaaaccgaccccctaaaatcaagttgtatttagagattagtacgtaagtacgtccggtacccttacgggttacgggtttactaacgtcgttacctttctacgtcgacctacgtaagtcgacgaccaacgccggtaccctccgtacgacctcgttccgtcgtcgggacctacggacggtcgtacgggaacgggaccgtagggtaccgtagttaacgtttaacgttccgacgtacctaagaccttaacaagttaacaacgtaacccgaccgaaccgttacaccttaaccgttcttaaccgttggttaccgttaacgggttaccgggtaaccggtacgggtaaaacccctacgggttccccgttaaaccggttcgtaaccgggtcccaaaccggcccccgtaaaaccggccccctaaacccgtccgg

SEQ ID NO: 198708 - DNA, 796 bp, Homo sapiens
  misc_feature: GYAE6OF01CTQLL.18.59.F04.1.454.CMB.1.raw
  modified_base (160)..(160): a, c, t, g, unknown or other
  misc_feature (160)..(160): n is a, c, g, or t
  modified_base (233)..(233): a, c, t, g, unknown or other
  misc_feature (233)..(233): n is a, c, g, or t
  modified_base (261)..(261): a, c, t, g, unknown or other
  misc_feature (261)..(261): n is a, c, g, or t
tcagtacgagtatgcacgaccggtgctcgatttagtacacacacttagggagttggggggggtctcaggaggcagcgctctcgggacgtctccaccatggcctggctctgctattcctcaccctcctcactcgagggcacgagggtcctgggcccagtcncgccctgactcagcctgcctcgtgtctgggtctccgtggacagtcgatcaccatcctcctgcacgtggaaccngacagtggtacgttggtagttataactntgtctaccgtggtaaccaacagaccaaccgaggaccaaaccgaccccctaaatcctaatcgttaattagtagattacgtacctaacgtaacgtccgtcccttaggtaagggtttctaacgtccgtcttccgtacgtcggtaccgttaccgtaacgtcgtacggaccaacggtacccgtacccgtacccgtacggtaaccctacgttccgtcgttaccgggtccctaccgacggtccgtaagggaacgggaaccggtagaccgtttaacggtaacttttaggttaacccgaggttaaccgtaccggttaccccttaaacgtaagttaaacctaacccggggtaaacaacccggtaacccgtaacggtaccctaacccgtttactttacggtaacgtttaccgtccggttaaaaccgggttaccggttacccggggtaaacgtccgggttaacccccgtacgggtttaacccgtacgggttacccccgaaacggttccccccggaaaaacggtccccccgtaaacccggtttaaccg

SEQ ID NO: 198709 - DNA, 777 bp, Homo sapiens
  misc_feature: GYAE6OF01DW4PA.18.59.F04.1.454.CMB.1.raw
  modified_base (750)..(750): a, c, t, g, unknown or other
  misc_feature (750)..(750): n is a, c, g, or t
tcagtacgagtatgcacgaccggtgctcgatttagtacacacacttagggattggggggggtctcaggaggcagcgctctcgggacgtctccaccatggcctggctctgctattcctcaccctctcactcagggcagagggtcctgggcccagtctcgcctgacgtcacgccttgcctccgtgtcgtgggtctccgtggacctaggtcgacgtccaaccgtacttcctccgtacgacctaaccgtacggaaacccaggtcctaaggttcgtaacgggtttggtacggtttaactaaaccgttagttcgtaccttaccgttacggtaaccaaacgacgaccgaaccgaaggaaccaaaaccgacccccgtaaaactccgtaatttacggtaattttaacgtacggtaacgttacggttaactaaacgttaaccggtccggtcccgttaacggttaacggggtttactaacgttccgtaaccgtttacgtccgttacgggtacccttaaccgtacggtttacgacggtaccgaaacggtacccgtccccgttaccgacgtaaccctacgtttccgacggtccggtcctaccggtacgtacccgttaggaacgggtacgcgtaacgttagtaacgtttacttagacggtacctacggtacctataaacgtacgtaacacggtacctaacgacgtactaacgtctagtacgtcgtacgtaacgaagtccgaactacggtccgtacgtacgtacnccgtaacgaccgtacgaccctcgtacg

SEQ ID NO: 198710 - DNA, 721 bp, Homo sapiens
  misc_feature: GYAE6OF01B915Q.18.59.F04.1.454.CMB.1.raw
  modified_base (239)..(239): a, c, t, g, unknown or other
  misc_feature (239)..(239): n is a, c, g, or t
  modified_base (268)..(268): a, c, t, g, unknown or other
  misc_feature (268)..(268): n is a, c, g, or t
  modified_base (330)..(330): a, c, t, g, unknown or other
  misc_feature (330)..(330): n is a, c, g, or t
tcagtacgagtatgcacgaccggtgctcgatttagtacacacacttagggagttgggggggggtctcaggaggcagcgctctcgggacgtctccaccatggcctgggctctgctattcctcaccctcctcactcagggtcacgagggtcctgggccctagtctcgaccctgactcagcctgcctcgtgtctgggtctccgtggacaggtcgatcaccatcctcctgctacgtggaaccngcagtcgtacggtttggtagttactactntgtcttctacggtaaccaacacgccaccgaggaccaaaccgcccccaatcagtgtactttgngatgtactactaactccggtaccctggttacgggtttactaacgttccgtacctttccgtcgtcggaccttaccgtaacgtcgttacggaacctaacgaccgtccctaccgtcgaaccctatccgttacgtcggtacctacgtaggtcgtacggacgggtacgacgggtacttcgtaatttacgttacgcgtacacggtaccttagtaacttaacgtaaccgaaccgtacctaaccgtacggtacccttaacgttcttaacctttagttaccgtcgtttaaccgggaccggttaacggtaacccgttacggttacccgtcccggtttaacccggtacggttacccgacccggtaaaccccggacccgtaccccgtaaccccgttaacccgg

SEQ ID NO: 198711 - DNA, 638 bp, Homo sapiens
  misc_feature: GYAE6OF01BIU8W.18.59.F04.1.454.CMB.1.raw
  modified_base (240)..(240): a, c, t, g, unknown or other
  misc_feature (240)..(240): n is a, c, g, or t
  modified_base (337)..(337): a, c, t, g, unknown or other
  misc_feature (337)..(337): n is a, c, g, or t
  modified_base (629)..(629): a, c, t, g, unknown or other
  misc_feature (629)..(629): n is a, c, g, or t
  modified_base (633)..(633): a, c, t, g, unknown or other
  misc_feature (633)..(633): n is a, c, g, or t
tcagtacgagtatgcacgaccggtgctcgatttagtacacacacttagggagttggggagagagacccctcccctgggatcctgggcccagtctgccctgactcagcctgcctccgtgtctgggtctcctggacagtcgatcaccatctcctgcactggaaccagcagtgacgttggtggttataactatgtctcgtggtaccaacagcacccaggcaaacgccccaaatcatgatttangatgtcactagtccggccctgtaaggggtttctaatccggcttcctactggtctaccgaagtctaggaccaacgccggcccttcccgtcgaaccctntcctcggtgggctcccgaggcctagggacggacgaggtctaggtattacttacgtgcagtctacgtatactaacacgacctacgacgtcctactactcgttagtcgttacgtacgggaacgtacgggacctaacggtccgtaccgtccgtaaggtccacggtacccgaacgggaccccaacccgtctcgacctaaccgttccgttacccgttccccacccttccgtacctaacttcccgtacggttaccgacggtaccgggtccggcgtaccgggacaacgggtccagtacngtcncgtcg

SEQ ID NO: 198712 - DNA, 1008 bp, Homo sapiens
  misc_feature: GYAE6OF01DQ613.18.59.F04.1.454.CMB.1.raw
tcagtacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgctagtttaaaggtgtccagtgtgaggtgcagcgtggtggagtcggtgggggaggtcgttaggggtaaacggcccgggggggtccttacgacctccccgtagtaccacgccgtcgtggtacttacgtacctttcgaaggtaaacggtcccgttagggacttacggtaaaccggttcggggtaccccgaccggaacgggccgttacccgggaaggggggtaaacgggggtcgttagggggtaggggtttcgggggtttaccgggtaacccggtttaaaacgtttaaaaaaacccgtaaaaaacgttcggtaaaggttcgggggttaaacgggaaaccgaaaaccggaacggtaaacccgttaaccgggtccgttaacggtaccccgaaaccccgggtaagggtaaaacggcccgtaaacggtaacctttacccgaaaccctaacgtttacccgaacgaaagggtacgtaaagttaaccggtaaaactttaaaccggaaaaaaacggtcccgtaacggtaccttaaggttaaccttaccgttagaaaccgtaaaaagtcgaaacccgtacggtacccgttaaggaaacccgggaaaacccggtacggaaaaccgtaacccgggtagtaacccgggtttaatttaacccggtttaccgttaacccgtaaaacccccgtaaccggtaaccccttaacccccggtaaaggtaaaaacccgtttaccccggtaaaccctttaaaacccgttaaacccgtttaacccgtaaaacccggtttaaacccggggtaagtttacccccgggtaacccgggtttccggggtaaaccggggggaaaccccccgg

SEQ ID NO: 198713 - DNA, 764 bp, Homo sapiens
  misc_feature: GYAE6OF01EWVIR.18.59.F04.1.454.CMB.1.raw
  modified_base (650)..(650): a, c, t, g, unknown or other
  misc_feature (650)..(650): n is a, c, g, or t
tcagtacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggtattttccttgctgtacttaagttttaaaaggtgtcctagtgtggaggtgcagcgtgggtggaggtcggtgggggaggtcgttagggtaaacggggtcccgggggggttacccttacggtacccgttccccgtaggtaaccgacgtccttacgtaggtactttacctaacgttttacgaaggttaaacggtccgtagggtaacttacggtaaaccggttccgggggtaccccacccggtacgggtccgtaaccgggaagggggaacggggtcggtaggggtagggttcggggttacggtaaccggtttaaaacttaaaaaccgtaaacgttggtaacgttaggggtacggaaactaacgaagtaacgtacgtcgtacgacccgaaccggtaagaaacggactacggtaacttaccaaccgtactacgtaagaacgtagatagtaacttaaacgaaaacgtcaagtctatacgtctagtaacaagtcgaaacngtacgtaacgaacggaaacgagaccacgtcgtacgttatactacgacgtaccaccgtacgtacccgagtaccacgtaacaacttactacctagaccgttacgtcgccgtacggg

SEQ ID NO: 198714 - DNA, 664 bp, Homo sapiens
  misc_feature: GYAE6OF01CJT42.18.59.F04.1.454.CMB.1.raw
  modified_base (227)..(227): a, c, t, g, unknown or other
  misc_feature (227)..(227): n is a, c, g, or t
  modified_base (252)..(252): a, c, t, g, unknown or other
  misc_feature (252)..(252): n is a, c, g, or t
  modified_base (308)..(308): a, c, t, g, unknown or other
  misc_feature (308)..(308): n is a, c, g, or t
  modified_base (466)..(466): a, c, t, g, unknown or other
  misc_feature (466)..(466): n is a, c, g, or t
tcagtacgagtatgcacgaccggtgctcgatttagtacacacacttagggattggggggggtctcaggaggcagcgctctcgggacgtctccaccatggcctgggctctgctattcctcaccctctcactcagggcacagggtcctgggcccagtctgccctgactcagcctgcctcgtgtctggtctccgtggacagtcatcaccatctcctgcctactggaaccngcaggtgacgttggtagtataactntgtctcctgtaccaacagcaccgaggaccaaacgcccccaaaactcatgtatttangtatctcaacttaacgtccgtccgttagtacggtttactaacgtctcttctcgtcggactccgtagtctacggaccaaccgcccgtaccctccctagtacctctctcgtcggtcctacaggctaggacggacgtacgggtactgttaattacttacgngacgtacgactactaagtactaaccgtacgtacccaaccgtacgtacccacctttcctaacgttcgttaccggtaacccgttttaccgggaacccggttacggggtaacccttaacccggtccgtaccccggtttacccggtaacgtaccgaaccccgttaaccccggaaccccgtacccccgtaaaaccccgtccgg

SEQ ID NO: 198715 - DNA, 787 bp, Homo sapiens
  misc_feature: GYAE6OF01AXKYO.18.59.F04.1.454.CMB.1.raw
  modified_base (263)..(263): a, c, t, g, unknown or other
  misc_feature (263)..(263): n is a, c, g, or t
  modified_base (374)..(374): a, c, t, g, unknown or other
  misc_feature (374)..(374): n is a, c, g, or t
tcagtacgagtatgcacgaccggtgctcgatttagtacacacacttagggattgggggctgggggtctcaggaggcagcgctctcgggacgtctccaccatggcctgggctctgctattcctccaccctcctcactcgagggcacagggtcctcgggcccagtcctcgcccctggactcacgcctcgtccctccgttgtcgtcgggttcctccgtggactagtcgactccacctacttcctcctgcctaccgtacggaaaccncgctaggtcgtacggttggttaggttaactaattctcgtccgttaccgtacggtaaccaacacgaccaccgtagaaccaacccaccccgaaactacgtatagtatttacgngtacttacgtactaacttaccgtccggtcccgttaggttaccgggtttactactccggttccttcgtccgtacggtcccttacgtaacggttaccgtacggtaaccctaaccggtccccgtccccgtacccggttactaacccgttcgttaccccggtccggtccggggtaccctaccggggtgtaaccggtcgggacgggttaccggccttaggttaccgttatttactacggtcgtactacgctaatacctaacggaatacccgaccacctaccgtcaaccttacctgtttaccgtggggtttaaccccgtacggggttaaacggacccggggttaacctacccccgggttactttacccccggagggtttacccaacccggtaccgtacccccgggaaccccgtaacccc

SEQ ID NO: 198716 - DNA, 586 bp, Homo sapiens
  misc_feature: GYAE6OF01CLH6Y.18.59.F04.1.454.CMB.1.raw
  modified_base (227)..(227): a, c, t, g, unknown or other
  misc_feature (227)..(227): n is a, c, g, or t
  modified_base (251)..(251): a, c, t, g, unknown or other
  misc_feature (251)..(251): n is a, c, g, or t
  modified_base (267)..(267): a, c, t, g, unknown or other
  misc_feature (267)..(267): n is a, c, g, or t
  modified_base (302)..(302): a, c, t, g, unknown or other
  misc_feature (302)..(302): n is a, c, g, or t
  modified_base (420)..(420): a, c, t, g, unknown or other
  misc_feature (420)..(420): n is a, c, g, or t
  modified_base (425)..(425): a, c, t, g, unknown or other
  misc_feature (425)..(425): n is a, c, g, or t
  modified_base (429)..(429): a, c, t, g, unknown or other
  misc_feature (429)..(429): n is a, c, g, or t
  modified_base (436)..(436): a, c, t, g, unknown or other
  misc_feature (436)..(436): n is a, c, g, or t
  modified_base (442)..(442): a, c, t, g, unknown or other
  misc_feature (442)..(442): n is a, c, g, or t
  modified_base (446)..(446): a, c, t, g, unknown or other
  misc_feature (446)..(446): n is a, c, g, or t
tcagtacgagtatgcacgaccggtgctcgatttagtacacacacttagggattggggggggtctcaggaggcagcgctctcgggacgtctccaccatggcctggctctgctattcctcaccctcctcactcaggcacagggtcctgggcccagtctgccctgactcagcctgcctccgtgtctgggtctcctggacagtcgatccaccatctcctgcactggaaccngcagtgacgttggtagtataactntgtctctggtaccacngcaccagacaaacgccccaaactcatgtaatttangtatcgtacaacgtaactccggtcccgttcgtaggggtttctaagtccgtacttcgtcgtggcctccgtaagtcgtcggacaaccgcgccctcctgacctgtctcgtcgctccgagcngacgngagntgaattntacgtnactnactacatgaacagtacccacgacgtacctatccgttatagttacgtaccctagggtaaccgtcgggtaaccaacggttcccgcccgttaaccgttacggtccaacccgtacccgaacccggacccttaaaccccgtacgg

SEQ ID NO: 198717 - DNA, 553 bp, Homo sapiens
  misc_feature: GYAE6OF01BC434.18.59.F04.1.454.CMB.1.raw
  modified_base (196)..(196): a, c, t, g, unknown or other
  misc_feature (196)..(196): n is a, c, g, or t
  modified_base (230)..(230): a, c, t, g, unknown or other
  misc_feature (230)..(230): n is a, c, g, or t
  modified_base (249)..(249): a, c, t, g, unknown or other
  misc_feature (249)..(249): n is a, c, g, or t
  modified_base (351)..(351): a, c, t, g, unknown or other
  misc_feature (351)..(351): n is a, c, g, or t
  modified_base (540)..(540): a, c, t, g, unknown or other
  misc_feature (540)..(540): n is a, c, g, or t
  modified_base (545)..(547): a, c, t, g, unknown or other
  misc_feature (545)..(547): n is a, c, g, or t
  modified_base (550)..(550): a, c, t, g, unknown or other
  misc_feature (550)..(550): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaanagcacccaggcaaagcccccaaatcatgatttangatgtcactaatcggcctnaggggtttctaatcgcttctctggctccaagtctggacaacacggcctcctgaccatctcgtgggcctcgaggctgaggacgtaggctagtatttattacgngacagtctcaatactacaacgcacagctacttctactatcgtacgttcggaacgtcggaaccaggtcctaccgtctacggcacgtacccaacgcccaaccctagtcgtacctactccgtccgtccccccgtcccttacacgttacctccgtagtcgcggccgggtcgtcggacgaaggcccgataacgngtacnnnctngta

SEQ ID NO: 198718 - DNA, 710 bp, Homo sapiens
  misc_feature: GYAE6OF01BQVVY.18.59.F04.1.454.CMB.1.raw
  modified_base (228)..(228): a, c, t, g, unknown or other
  misc_feature (228)..(228): n is a, c, g, or t
  modified_base (238)..(238): a, c, t, g, unknown or other
  misc_feature (238)..(238): n is a, c, g, or t
  modified_base (252)..(252): a, c, t, g, unknown or other
  misc_feature (252)..(252): n is a, c, g, or t
  modified_base (281)..(281): a, c, t, g, unknown or other
  misc_feature (281)..(281): n is a, c, g, or t
  modified_base (298)..(298): a, c, t, g, unknown or other
  misc_feature (298)..(298): n is a, c, g, or t
  modified_base (476)..(476): a, c, t, g, unknown or other
  misc_feature (476)..(476): n is a, c, g, or t
tcagtacgagtatgcacgaccggtgctcgatttagtacacacacttagggagttgggggggggtctcaggaggcagcgctctcgggacgtctccaccatcggcctggctctgcttattcctcaccctcctcactcgagggcacgacgggtcctgggcccagtctcgccctgactcacgcctgcctccgtgtcgtcgggtcctccgtggactaggtccgatccaacctnttcctcgtcnctacgtacgaaccngctagtcgtacggttggtagtataacgtntctctcgtagtaccaancgaccaccgacggaacaaccgacccctaactacacttagtactttagcgtatacgtactacgtaacgtccgtccttacggttacggttactacgtcgttcttacgtcgtacggtctacgtacgtcgacgtacaaccgtccgtcctacctacgacctacgtcgtacggtcgctaccggnggtacgacggacggtacgacggtacgttagttaaccttagtacgtcgtacgtacgtacacttaacgttaaccacggaacctaccgtaacctacgtcctaactttcgtacttaacggttccggtttacgtaaccggggtaacttaaccggggacgttacccggttacccggtacccggttaaccgccggtaacccgacccggtaacccgtaacccaccccggttaaccgtaccgg

SEQ ID NO: 198719 - DNA, 716 bp, Homo sapiens
  misc_feature: GYAE6OF01DQQB2.18.59.F04.1.454.CMB.1.raw
  modified_base (697)..(716): a, c, t, g, unknown or other
  misc_feature (697)..(716): n is a, c, g, or t
tcagtacgagtatgcacgaccggtgctcgatttagtacacacacttagggattgggggctttgcctgggtgctgttggtaccaggagacatagttataaccaccatctcctgcactggaaccagcagtgacgttggtggttataactatgtctcctggtaccaacagcacccaggacaaacgcccccaaactcatgatttatgatggtcagtaactccggccctagtaggggtttctaattcgtccttctcgtcggcctaccgaagtccgtaggaccaaccgaccggtccccttcccctacgtacccactttcctccggttggggccctacccggaaggctagggaacggtacggaacggtcgttagtacttttaacttaaccgtcggaccaggttacctactaattaaactaacgaaacgtccgaacgacccgacggacctaaaccgttaccgtaaacggtttcccgttaaccggggtaaacggttacccggggaaacccggtaaacgggttaccccgtaacccggttcccgttaaacggtacccgaaccccgtacccgaaaccggacccccctaacccccggtaactaccgtaccctaccgttaccgttccccgttaaccccctccccctacctaccctaccttacccgttacgtactcgggacgccggacgtgaccggcggcacgacgtagctnnnnnnnnnnnnnnnnnnnn

SEQ ID NO: 198720 - DNA, 673 bp, Homo sapiens
  misc_feature: GYAE6OF01E5KPU.18.59.F04.1.454.CMB.1.raw
  modified_base (230)..(230): a, c, t, g, unknown or other
  misc_feature (230)..(230): n is a, c, g, or t
  modified_base (324)..(324): a, c, t, g, unknown or other
  misc_feature (324)..(324): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctctggacagtcgatcaccatcctcctgcacgtggaaccngcagtgtacggttggtagttaataactatcgtctccgtaggtaacccaacgacgccacccgaggaccaaaccgcccccaaaatcatgtatttangatcgtactaactaacgtccggtacccttaggtacgggtttacaacgtcgtcttctcgtggacctaccgaagttcgtacggaccaaccgacccggtccctacccgtacgaacctacttccgttcggtcgggtcctaccggaacgggtcgtaagggacgggacggtacggtacgttagttaacttttacgtacgtcgtacacgtcctacaactaactaacgaaccgcccgaaccgactcctaaccttacttacgttagtccgttaccggtaacggtaacgtccgggaacctacgggtccctacccgtacgtacgtaccgaccgaaccccgaaccgaccccaacccgtacg

SEQ ID NO: 198721 - DNA, 663 bp, Homo sapiens
  misc_feature: GYAE6OF01EH57O.18.59.F04.1.454.CMB.1.raw
  modified_base (231)..(231): a, c, t, g, unknown or other
  misc_feature (231)..(231): n is a, c, g, or t
tcagtacgagtatgcacgaccggtgctcgatttagtacacacacttagggagttgggggggggtctcaggaggcagcgctctcgggacgtctccaccatggcctgggctctgctattcctcaccctcctcactcagggcacagggtcctgggcccagtctgccctgactcagcctgcctcgtgtcgtgggtctcctggacagtcgatcacatcctctgctacgtggaaccngctagtcggtacgtttgggtagtttaataacctagttcgtcttaccgtaggtaccaaacacgaccaccgagaaccaaaccgacccctaaactccaagtagtatttatacgatacgtacaacttaatccgtccgtacgttagggttactaagtccgtacttcgtacgtcgtctaccgaacgtcgtacggaccaacgtacgtcccctaccgtacgacctagttcgtacgtcggtcctaccgacgtaccgtagggaccggtaacggacgtactaggttactttaacgtacgttcgacgtaggcctactaactaactaacgaacaccgtaccaagtacctacctacgttctagtcgttccgtaacgtacggacgggtaccaacggtccgtaacccgtcgtacggtactacccgacgaccaaccccgtaaccgtacg

SEQ ID NO: 198722 - DNA, 665 bp, Homo sapiens
  misc_feature: GYAE6OF01BM5F1.18.59.F04.1.454.CMB.1.raw
  modified_base (185)..(185): a, c, t, g, unknown or other
  misc_feature (185)..(185): n is a, c, g, or t
  modified_base (208)..(208): a, c, t, g, unknown or other
  misc_feature (208)..(208): n is a, c, g, or t
  modified_base (235)..(235): a, c, t, g, unknown or other
  misc_feature (235)..(235): n is a, c, g, or t
  modified_base (259)..(259): a, c, t, g, unknown or other
  misc_feature (259)..(259): n is a, c, g, or t
  modified_base (308)..(308): a, c, t, g, unknown or other
  misc_feature (308)..(308): n is a, c, g, or t
  modified_base (313)..(313): a, c, t, g, unknown or other
  misc_feature (313)..(313): n is a, c, g, or t
tcagtacgagtatgcacgaccggtgctcgatttagtacacacacttagggattgggggggggtctcaggaggcagcgctctcgggacgtctccaccatggcctgggctctgctattcctcacccctcctcactcagggcacagggtcctgggcccagtctgccctgactcagcctgccctccgtntcgtgggtctctggacagtcgancctttaccatctcctgcacgtgaaccngcagtgacgttgtagttataactntgtctctgtaccacagcaccagactaacgccccaacgtcatagtattanagatntacactaacgtccgtcctacgtcgggttactaatcgcttacgtctgctactaagtctcggacaccgacgtccctcacgacctataccgttggtcggtacctacgtacggtacgtacggaagggaccggaacgttacgttagttacgtttaacgtacgttaggactcggtactactactaacgtaagaaaccgcaaaccgtactactaacccttacttactacttacgggttaccggttaccggtaaaccggttaccgggtaaaccgtaacggttaccccgtaacccgttaccgggttaacgtacccggaacctaacccggaaacccggtaacccccaaaccccgttaacccg

SEQ ID NO: 198723 - DNA, 823 bp, Homo sapiens
  misc_feature: GYAE6OF01EJHLZ.18.59.F04.1.454.CMB.1.raw
tcagtacgagtatgcacgaccggtgctcgatttagtacacacacttagggattggggtctgggagaggacgccccagccttgggacttcccaagttgttttcattcagtgatcaggactgaacacaggaggactcgaccagtggtagttggctgagcgtggtattttccgtgtctgtacttaagtttaaaggtgtccagtgtggaggtgcgacgtgtgggtaggtaggtcgggtagggggacgtacggttacggggtaacggggccccggggggttaccttacggtacccgttcccgtacgtaccgtaccgtccttcgtagttcttaccttacgttacgtaaggttaaccggtcgtaggtacgtacggtacggtcgggtccgaccggacgtaccggtaccggaagggggtaggggtccgtaggggtaggttacggttacggttaaacggttaaacctaaaaccgtaagtcgggtaaggtacggaagggtaacacggtaacgaccgtacgcgaccgcccggtaacgtaagacgacgagtacctaccgactaccgaacgtaccgaaggtataacgtaagtacgttaaacgaaacgtccgttaacgttacgacttaacgtccgttaacgaaacgttaaggaacctacggtaacggtaccgtaacggaacggaaccgaccgtaaccgtacgggtaccctacgtttaataacccgttactaaccggtaaccacccgttaccggtaactacgggaccttaacctaccgtacgttaaccgtaccgtaagtccgttacggtaccggtcgtaaccgggaggtaaacccccgg

SEQ ID NO: 198724 - DNA, 752 bp, Homo sapiens
  misc_feature: GYAE6OF01A5BBW.18.59.F04.1.454.CMB.1.raw
  modified_base (147)..(147): a, c, t, g, unknown or other
  misc_feature (147)..(147): n is a, c, g, or t
  modified_base (204)..(204): a, c, t, g, unknown or other
  misc_feature (204)..(204): n is a, c, g, or t
  modified_base (221)..(221): a, c, t, g, unknown or other
  misc_feature (221)..(221): n is a, c, g, or t
  modified_base (248)..(248): a, c, t, g, unknown or other
  misc_feature (248)..(248): n is a, c, g, or t
  modified_base (437)..(437): a, c, t, g, unknown or other
  misc_feature (437)..(437): n is a, c, g, or t
  modified_base (462)..(462): a, c, t, g, unknown or other
  misc_feature (462)..(462): n is a, c, g, or t
  modified_base (550)..(550): a, c, t, g, unknown or other
  misc_feature (550)..(550): n is a, c, g, or t
tcagtacgagtatgcacgaccggtgctcgatttagtacacacacttagggagttgggggggggtctcgggaggcagcgctctcgggacgtctcccaccagtggcctgggctctgctattcctccacccctctcactcgagggcacgngggtcctgggcccagtctcgccctgactcacgcctcgcctcgtgtcgtcggtctcgngactgtcgatccacctntccgtccgtgacctacggtcgaaccgngcgtaggtcgttacggtttggtaagtttaactaacgtgttcgtccttccgtacgtaaccaagcaccgtacccgaaggacctaaaacccaccccctaatccgtatacgtttatttagacgtacttcgtacctaacgttaccgtcccgggtaccgtgggtttaacggtttcgtacgttccgttacgttccncggtaccgtctaccgttaggttacnccggtaacacccgttacccgtcccttacctcggaacctcttcggtccggttggccgtaaccggtgacgtgggacgacggtcttaggtnttaagtttcgtacgtgacctaggtactaataccgtaaacgtccgtaacgcccttaacgtcccgttaaccttccttacgttagttcgtacgggttaaccttaaccggggtaaccgtaacggacccgtttaaccggcccgttaccggcggtttaacgacccgttaaccggaccccggtaacacccccggttacgctttaacccg

SEQ ID NO: 198725 - DNA, 763 bp, Homo sapiens
  misc_feature: GYAE6OF01C1S19.18.59.F04.1.454.CMB.1.raw
  modified_base (591)..(591): a, c, t, g, unknown or other
  misc_feature (591)..(591): n is a, c, g, or t
  modified_base (611)..(611): a, c, t, g, unknown or other
  misc_feature (611)..(611): n is a, c, g, or t
tcagtacgagtatgcacgaccggtgctcgatttagtacacacacttagggattggggagctctgggagaggagcccagccttgggattcccaagtgtttttcattcagtgatcaggactgaacacagaggactcaccatggtagtttgggctgagctggtatttttccttgcttgtcttaagttttaaaggtgtacctagtgtggaggtgcagctgggtggagtcggtagggggacggtacgtttaggggtaaacggggtccgggggggttacccttagacccgttcccgtagttaccacgtccttcgtaggtactttcgtactttttaccgaaggtaaacggtccgttagggtaacttaacggtaaccgggtcggggttccccgacccggtacggggtcccgttaccggaagggggaacgggggtccgtaggggttagggtggggtttcggtaaccggtaaaactttaaaaaaccgaaatggtaacgtagggtaggaaacctacgaagtacgtaacgctagaccctaccgggaagaagctacgtactccaacctagtcaacgaagcgtaagtagtaaattaacgaaaacncaacgtcttatactacgtanaacgaatacgaactacgacgtaacggacgtaaacggacgtacacgtacgtacgtagttaactacgtaccgtacctaccgtaccgtacccgtagaacggttacctaactaacgtaccttaacctaacggttactacggtcgtacgtaaccggg

SEQ ID NO: 198726 - DNA, 781 bp, Homo sapiens
  misc_feature: GYAE6OF01DA48R.18.59.F04.1.454.CMB.1.raw
  modified_base (220)..(220): a, c, t, g, unknown or other
  misc_feature (220)..(220): n is a, c, g, or t
  modified_base (237)..(237): a, c, t, g, unknown or other
  misc_feature (237)..(237): n is a, c, g, or t
  modified_base (267)..(267): a, c, t, g, unknown or other
  misc_feature (267)..(267): n is a, c, g, or t
  modified_base (768)..(768): a, c, t, g, unknown or other
  misc_feature (768)..(768): n is a, c, g, or t
tcagtacgagtatgcacgaccggtgctcgatttagtacacacacttagggagttgggggggggtctcgaggaggcagcgctctcgggacgtctccaccatggcctggctctgctattcctcaccctctcactcagggcacgcgggtcctcggccagtctgccctgactcagcctgcccttcggtgtcgtcgggttctacgtggacagtcgaactcacctntcctcagcacgtgaccngctgtcgtagtgtatactactagtcgtacnccgtagtaaccacgcgccaaccgaggaccaaccgaccctaaactcgattacgttaatttatcgtattcctaactaaccgtcgtccggtccgttaggttacggtttaactcgtacgttccttacgtacgtcgtaccacgttacgtggtaccgaacccgtaacgtccccgaccttacggtaccgaccttacgttccggtaccgtcgtaaccggtccgtagggtccggtaacggaaacgggtcggtacggttaacccggttaacgtttaacgttttacggacgttaaccggcttaacgttaacctacgtaacggttaaacaccgtaaaaccgtccggaaacctttacccgacttaaccgtttaacccttcgttaacgtttcccggggtttaaccgaaccgggttaacccggtaaaccgggttacctaacccgggttcccgaaaaaccggtttcccgaaccgggttaccccaacccggtaaaccccggacccggttaaacccccnccggttaaacccg

SEQ ID NO: 198727 - DNA, 541 bp, Homo sapiens
  misc_feature: GYAE6OF01D9121.18.59.F04.1.454.CMB.1.raw
  modified_base (252)..(252): a, c, t, g, unknown or other
  misc_feature (252)..(252): n is a, c, g, or t
  modified_base (352)..(352): a, c, t, g, unknown or other
  misc_feature (352)..(352): n is a, c, g, or t
  modified_base (424)..(424): a, c, t, g, unknown or other
  misc_feature (424)..(424): n is a, c, g, or t
  modified_base (516)..(516): a, c, t, g, unknown or other
  misc_feature (516)..(516): n is a, c, g, or t
  modified_base (520)..(520): a, c, t, g, unknown or other
  misc_feature (520)..(520): n is a, c, g, or t
  modified_base (522)..(541): a, c, t, g, unknown or other
  misc_feature (522)..(541): n is a, c, g, or t
tcagtacgagtatgcacgaccggtgctcgatttagtacacacacttagggattgggggctttgtctgggtctcctggacagtcgatcaccatctcctgcactggaaccagcagtgacgttggtggttataactatgtctcctggtaccaacagcacccaggcaaacgcccccaaactcatgatttatgatgtcactaatccggccctgtaggggtttctaatccgcttctctggctccaagtctggccaacnccggtccctcctgaccattcgtcgtgggcctccgaggctggacggcgaggtctagtatttatacgtgactagctacatatacacgcaccagcctacttcncttatcgttcgttacggaaccgtcggaaccgaagtccaccgtcctagtcgaccgacccgaacgcccaacccnctcgtcctactcctcccgttccccaccccttcctacccgtacttaccgtccgtacgtacggccggtacggtcggtcgacgacggcactagangtcncnnnnnnnnnnnnnnnnnnnn

SEQ ID NO: 198728 - DNA, 704 bp, Homo sapiens
  misc_feature: GYAE6OF01DHS2F.18.59.F04.1.454.CMB.1.raw
  modified_base (202)..(202): a, c, t, g, unknown or other
  misc_feature (202)..(202): n is a, c, g, or t
  modified_base (219)..(219): a, c, t, g, unknown or other
  misc_feature (219)..(219): n is a, c, g, or t
  modified_base (230)..(230): a, c, t, g, unknown or other
  misc_feature (230)..(230): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacgagggtcctgggccagtctgccctgactcagcctgcctcgtgtctgggtctccgtggacngtcgatcacatctcctncactaggaccngcagtgtacgttggtacgttaataactagtgtcctccgtacggtaaccaacacgaccaccgagaccaaccgtaccccaaacgtcaatcgtattacagtctagtctaacttacgtccgtaccgtacgttacgggtttactaacgtccgttcttcgtacgtcggtacttactaacgttccgtagacccgtaaaccggaccggtaccccttcccgtacgtacctaacgttcccgtcggtcggtaccgtccgtaggtcgtacggacgggacggtacgtctagttaacgttaagttaccgtgacccgtagtacctacaattacctaaacggacctccgtaaacccgtcgtacctacttacgtaccgttacgttccgttaaccggttaacggtaaccggtaccgggtaaaccgttaccgggtaaccctacccgggtaacttacccgggtagaacccgtaccggtaaccccgaaacccccg

SEQ ID NO: 198729 - DNA, 425 bp, Homo sapiens
  misc_feature: GYAE6OF01CO7VK.18.59.F04.1.454.CMB.1.raw
  modified_base (347)..(347): a, c, t, g, unknown or other
  misc_feature (347)..(347): n is a, c, g, or t
  modified_base (378)..(425): a, c, t, g, unknown or other
  misc_feature (378)..(425): n is a, c, g, or t
tcagtacgagtatgcacgaccggtgctcgatttagtacacacacttagggattgggggctttgtctgggtctcctggacagtcgatcaccatctcctgcactggaaccagcagtgacgttggtggttataactatgtctcctggtaccaacagcacccaggcaaacgcccccaaactcatgtatttatgatgtcactaatccggcctcgtaggggtttctaatcgtcttctctggctccaagtctggccaacgaccggtccctccgtcgacctatcctcgtgggcctccgaggtctaggacggaacgcggctaggtaatttaacttactgacacgtctacaacttanaacgaaagccaaccgacgtacctaaccttcnnnnnnnnnnnnnnnnnnnnnnnnnnnnnnnnnnnnnnnnnnnnnnnn

SEQ ID NO: 198730 - DNA, 995 bp, Homo sapiens
  misc_feature: GYAE6OF01ERPRH.18.59.F04.1.454.CMB.1.raw
tcagtacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggtattttcctgctgtcttaattttaaaggtgtccagtgtgaggtgcagcgtgggtggaggtcggtgggggaggtcgttaggggtaaacgggtcccgggggggttacccttaggacccgttccccgtagtaccgacggtcccttcgtggtactttccgtaaccttttacgaacggttaacggtcccgttagggtaacttaggtaaccggttccggggtaccccgccgtaacgggccgtaccgggaagggggaacgggggtcgtaggggtagggttcggggttacgggtaaccgttaaaattaaaaacccggtaaaacgtggtaacggttacgggtacgggtaaacaaacggtacgtaaccgtaccgcgtacggtaacccgtaacccgggttaaggaaacgggtacctaaacggtaccttaaccgaaacccgtaacttaccggtaacgaaaacggtaaggtaacgttaacggtaaaacttaaaaccgaaaaaaacggccgttaacggtaaccgtttaacggtaacctttaccggtaaacgtaaacccgtaaaagttacccggtaaaaccgtaccgtaacccggtaacgggtaaaccggtaaaacccccggggaagggttaaacccaaaccccgggttaagggtaaccccggtttaagtttaacccgttaaccgtaacccgtaaacccgtaaacccgttaccccggtttaacccccggtaaaaggtaaaccccgttccgggtaaaacccttaaacccttaaacccggtttaaacccgttaaacccgggtttaaacccgggttaaccgttaaccccggggttaacccgttaaccccgggggg

SEQ ID NO: 198731 - DNA, 947 bp, Homo sapiens
  misc_feature: GYAE6OF01B1F7A.18.59.F04.1.454.CMB.1.raw
  modified_base (190)..(190): a, c, t, g, unknown or other
  misc_feature (190)..(190): n is a, c, g, or t
  modified_base (207)..(207): a, c, t, g, unknown or other
  misc_feature (207)..(207): n is a, c, g, or t
  modified_base (249)..(249): a, c, t, g, unknown or other
  misc_feature (249)..(249): n is a, c, g, or t
tcagtacgagtatgcacgaccggtgctcgatttagtacacacacttagggattgggggagagagacccctcccctgggatcctgggcccagtctgccctgactcagcctgcctccgtgtctgggtctcctggacagtcgatcaccatcctcctgcactggaaccagcagtgacgttggtgttaataactntgtctcgtgtaccaacngccaccgaggaccaaaccgaccccaaatcagtagtactttanaggtacttacgtactaacgttaacgtcccggtcccgttacggttacgggtttactaacgtccgtcttcctcgtcggtaccttaccgtaagtccgtacggaccaaaccggccggtaccccttcccgtacgaaccctacgttccgttacggtaccgggtccttaccggacgggtaccgtacgggtaacggggtaaccggtacgggtacgttacgttaaagttttaacgttaaccggtgtaacccggttacggtaccttaacgttaaacggtttaaacctaaccggaaaaccggacccctaaaccggtaccgacccttaaccggtttaaccctttaccggttaacgttttacccggttaccccgggtttaaccgggggaaaccggttaacccgggggtaaaccccggtaaccgggtttacccgttaaccccgggttaacggttaacccgggtaaccggtaacccccggaaccccggttaaaccccgggaacccccccttaaaccccgttaacgggttacccgttacccgtttaaacccgtttcccccgggtttacccctttaaccccccccggtacccctttaaccccggttaacccttacccgtttaaacccgtttacccggtaaccgtacggggtaacccgggcccggggttagtaccggggaacccgtacgggtccgtacttaagggaccctgcgtcg

SEQ ID NO: 198732 - DNA, 704 bp, Homo sapiens
  misc_feature: GYAE6OF01DESW5.18.59.F04.1.454.CMB.1.raw
  modified_base (220)..(220): a, c, t, g, unknown or other
  misc_feature (220)..(220): n is a, c, g, or t
  modified_base (247)..(247): a, c, t, g, unknown or other
  misc_feature (247)..(247): n is a, c, g, or t
tcagtacgagtatgcacgaccggtgctcgatttagtacacacacttagggagttggggggggtctcaggaggcagcgctctcgggacgtcctccaccatggcctgggctctgctattcctcaccctcctcactcagggcacgagggtcctgggcccagtctcgccctgactcagcctgcctccgtgtcttgggtccttccgaggacagtcgatccaaccnttcctcctgacctacgtacggaaaccnggtacctaggttcggtacggttttagggtagttaactaaccgtgttcgttccgttaccgtacggtaacccaaccgtacggacccaaccgacggaaccaaaacccgaccccctaaaactcctaagttacttagtttacgtagtactacggttactaactacgtcccggtaccgttacgttacgggttactaactcgtctttacgtcgttcgtacctactacgtcgtcggacaaccgtcccggtcctaccgtcactactcgtacgtcggcctacgcggacgtggacgtacgacgtgtacgtactttagtacgtgtcggtactactacctaagtacgaacaacgacctaccgcgtactacttacttacgtacgttccgtacgttaccggacgtaccggtaacctcggtaccctacgttacgtaccgtaccgaaccacccgtaaccgccctaacccgtacg

SEQ ID NO: 198733 - DNA, 812 bp, Homo sapiens
  misc_feature: GYAE6OF01D6YS1.18.59.F04.1.454.CMB.1.raw
  modified_base (246)..(246): a, c, t, g, unknown or other
  misc_feature (246)..(246): n is a, c, g, or t
  modified_base (585)..(585): a, c, t, g, unknown or other
  misc_feature (585)..(585): n is a, c, g, or t
  modified_base (691)..(691): a, c, t, g, unknown or other
  misc_feature (691)..(691): n is a, c, g, or t
tcagtacgagtatgcacgaccggtgctcgatttagtacacacacttagggagttgggggggggtctcaggaggcagcgctctcgggacgtctccaccatggcctgggctctgctattcctcaccctcctcactcagggcacagggtcctgggcccagtctgccctgactcagcctgcctcgtgtcgtgggtcctccgtggacagtcgactccaccgtattcctccgtgccaaccgtaggaaacccnggaccgtaggttacggtacggttttgggttaggttttaaactaaacgtttgttcgttccgttacccggttacggttaaacccaacgtaccgacccaacccggaacggaaccccaaaaacccgaaccccccctaaaattccgtaagtttacggttaattttacaggttacttacggtaaccgtaaccgtttaaccgtcccgggttacccttacggggttaaccgggtttttactaacgttccggttcctttacgtcgttacgtccctacgtaacgtccgtacgaccgaaccgtcccggtaccctccgacgtctacttccgtcggtacggtaccctacggngtcgtagggacggtacggtaggtaccgttagttaacgtttacgtaccgtacgtccgtacgtacttaacgtaacttaaaccgtaacaaccggtaccaaccggtaacnccgttaacttccgtaattccggtaccgttaccggtacgggacgttaccgggaaccaccggttacccacggttcccgtaaggtcccgaacccgtacccgtaccccggaaccctaccgtaccg

SEQ ID NO: 198734 - DNA, 750 bp, Homo sapiens
  misc_feature: GYAE6OF01DKLAX.18.59.F04.1.454.CMB.1.raw
  modified_base (230)..(230): a, c, t, g, unknown or other
  misc_feature (230)..(230): n is a, c, g, or t
  modified_base (256)..(256): a, c, t, g, unknown or other
  misc_feature (256)..(256): n is a, c, g, or t
  modified_base (310)..(310): a, c, t, g, unknown or other
  misc_feature (310)..(310): n is a, c, g, or t
tcagtacgagtatgcacgaccggtgctcgatttagtacacacacttagggattgggggggggtctcaggaggcagcgctctcgggacgtctccaccatggcctgggctctgctattcctcacccctcctcactcagggcacagggtcctgggcccagtctgccctgactcagcctgcctccgtgtctgggtctcctggacagtcgatcaccatctcctgcactggaaccngcagtgacggttggtagttataactntgtctctggtaccaacagaccaccaggcaaacgacccccaactcatgtatttangatcgtctaactaacgtccggcccttacggtacgggtttactaagttcgtcctttctcgtcggccttaccgacgtcgtcgaccaaccgccgtacccgtccctacgacctacttcctccgtcggccctccgacggtcgtgggacgggaacggtacggtaccgttaggttaactttaacgttaccgtcgtaccgtacgtaccttaactaacgttaactaaccgaaaccgaccctaaaccgaaccgtaccctaacctttccttaaccgttacgtttccggttacccggttttaacccgggtaaacccgggtttaacgggggtaaaaccccggttaaccgggttaccccggttaaccccggttaaccccggtttaccgggtaaccccggaacccgaacccccccgggtaaaccggaacccccccgtaaacccccgttaacccgg

SEQ ID NO: 198735 - DNA, 775 bp, Homo sapiens
  misc_feature: GYAE6OF01BXMMN.18.59.F04.1.454.CMB.1.raw
  modified_base (207)..(207): a, c, t, g, unknown or other
  misc_feature (207)..(207): n is a, c, g, or t
  modified_base (226)..(226): a, c, t, g, unknown or other
  misc_feature (226)..(226): n is a, c, g, or t
  modified_base (231)..(231): a, c, t, g, unknown or other
  misc_feature (231)..(231): n is a, c, g, or t
  modified_base (257)..(257): a, c, t, g, unknown or other
  misc_feature (257)..(257): n is a, c, g, or t
tcagtacgagtatgcacgaccggtgctcgatttagtacacacacttagggtagtttggggggcctggggtcctcgaggtacggcagtcgtctctcgggtacgtctccaccatggcctgggctctgctattcctcaccctctcactcgagggcacgagggtcctcgggtccctaggttctgtacccttagctcagtcctgcctccgtntcgttgggtctcgtggacngtcgntcacgtagtcctctgcacgtcggacngctagtcgtacgttggtagttactaacgtctcgtccttccgtacggtaccgaacgcgtccgaccgacgacaaaccgaccccgaaagtcgtatgtacgtttagacgtactacgtactaacgtacgtccgtccgttacggtaacggttacctaacggtccgtaccgttcgtccgtacggtctaaccgtacggttacgtaccgaaccgtaaccgtacccggtccctacccggtaaccgtaacccgtaccgttcccgtaaccgggttaccgggcccttaccgggtacggtacgttacgggaaacgtacgggtacgtacgttaagttaactttaacgttcccgagtaccgaccgttagtaacgttacggtaactaaccggtaaactaccctaacggtaacacggtaacccttagtaccgttttagtaccggtttcgggtaaccggtacggttaaccggacccgttaacggtcccggtaccgttaacgccgggtaacccaccggtaccccgaccggtaaacccc

SEQ ID NO: 198736 - DNA, 737 bp, Homo sapiens
  misc_feature: GYAE6OF01EZFF4.18.59.F04.1.454.CMB.1.raw
  modified_base (361)..(361): a, c, t, g, unknown or other
  misc_feature (361)..(361): n is a, c, g, or t
tcagtacgagtatgcacgaccggtgctcgatttagtacacacacttagggattggggagagagacccctcccctgggatcctgggcccagtctgcccctgactcagcctgcctccgtgtctgggtctcctggacagtcgatcaccatctcctgcactggaaccagcagtgacgttggtggttaataactatgtctcctggtaccaacagcacccaggcaaacgcccccaaatcatgtatttatgatgtcactaacgtccggccctgaggggtttctaagtcgtcttctctggtcctacaagtctcggcaacgaccggccctccctgaccactccgtcgtcggctcgaggtctggaggacgnggtctagtattattactgcagctactaataactaacgaacgccaacgacgcctacttctacttagttcgttaccgttaacgggaaccgtacggggtaaccctaacgggttccctaacccggttaccgttacgggtaccgaaccggacccccgaaccgggaaccccctaacccccgtacgttacccgtaccgtaacccgtttcccgtttccccgggtttacccccccgtaccccctttaccccgttaaccctaacccgttttaaccccgtaccccgggtttaaccggttacgggacccggggtacccggggtccggttaaccggggaccggtaaacccggggtacccggtaccgttaaaggtcccggtatacgtccg

SEQ ID NO: 198737 - DNA, 706 bp, Homo sapiens
  misc_feature: GYAE6OF01C599R.18.59.F04.1.454.CMB.1.raw
  modified_base (596)..(596): a, c, t, g, unknown or other
  misc_feature (596)..(596): n is a, c, g, or t
tcagtacgagtatgcacgaccggtgctcgatttagtacacacacttagggattggggggggtctcaggaggcagcgctctcgggacgtctccacatggcctggctctgctattcctcaccctctcactcaggcacagggtcctagggcccagtctcgccctagactcagcctgcctcgtgtctgggtcctctggacagtcgatcacatctctgacacgtcggaaccagctagtcgtaacggttggtagttataactatcgtctccgtacggtaccaacacgaccaccgaggaccaaaaccgaccccctaaactctaagtcgttaaatttagtagtagtcgttactaaggttaacgttcccggtacccgttacggttacggggtttttaccttaaacggttccgttacctttcttcggtacggtaccttaccgtaacggtcttacggacccgtaaaccgacccgtcccgttaccccgtaacgaaccctacgttccgttcgtacggggtcctacccgagtacccgtaggaacggtacgacggtcgttaggtaccttattaccgtagtacgtacgtacgtacctaattacgtaacgaancgtagacacgtacctataccgacgttaccggtacggaacgttacgggaaccgttacgggtctaaccggttccgtagtacgaccgtacccgacgaaccccacgtcgtaccg

SEQ ID NO: 198738 - DNA, 864 bp, Homo sapiens
  misc_feature: GYAE6OF01D56WU.18.59.F04.1.454.CMB.1.raw
tcagtacgagtatgcacgaccggtgctcgatttagtacacacacttagggattggggggggagaggagccccagccttgggtattcccaagttgttttcattcagtgatcaggactgaacacagaggactcaccatggagtttgggctggagctggtattttccttgctgtacttaagttttaaaggtgtcctaggtgtggaggtgcagtcgtgggtggtagttcggtgggggggtacgcgtttaggggtaaacggggtccggggggggttaccttaacggaccttccccgtacggtaacgtccgtccgttcggtcggttacttttcctacttttacgaacggttacggaccgttagggtacttacggtaacggttccggggtaccgtcccgagggtcccgtaccgggaagggggggacggggtacggtaggggtacggggtttcggggggttacggaacccggtttaaaaccttaaaaaaccgtaaaccgttagggtacggttacggggaacgggaacgtaacgaaggaaccttacgggactccggtaaccgaccggtaagaaacggtcgtacgtacgttacccaacctacgtcctaagaagagtaacgttacgtaagttaaaccaaagcctacgtacggttatacacttacggaactaatacgaagtccgtcgtacggaacgaaccggaggaaccacggtacggtaccgtaatttaacgttaccgtactaacccgattaaccccgttacggaaacgtaacccggttctaaccggttaaacctaccgtttaaacccgaggtttaaaccgtaacgttcggaaacccggttcggggaaccgggtaacccgaacggggttaacccg

SEQ ID NO: 198739 - DNA, 679 bp, Homo sapiens
  misc_feature: GYAE6OF01C3LKV.18.59.F04.1.454.CMB.1.raw
  modified_base (197)..(197): a, c, t, g, unknown or other
  misc_feature (197)..(197): n is a, c, g, or t
  modified_base (363)..(363): a, c, t, g, unknown or other
  misc_feature (363)..(363): n is a, c, g, or t
  modified_base (540)..(540): a, c, t, g, unknown or other
  misc_feature (540)..(540): n is a, c, g, or t
  modified_base (546)..(546): a, c, t, g, unknown or other
  misc_feature (546)..(546): n is a, c, g, or t
tcagtacgagtatgcacgaccggtgctcgatttagtacacacacttagggagttggggggggtctcaggaggcagcgctctcgggacgtctccaccatggcctggctctgctattcctcaccctcctcactcagggcacgacggtcctgggcccagtctgccctgactcagcctgcctcagtgtcgtgggtcctcgnggacagtcgactccaacctgtcctcctgacctacgtacggaaaccagtacgtagttacggtacggtttagggttaacgttaacttaacttagttcgtcctccgtacggtaaccaacacgaccaaccgacgaccaaaccgtaccccaaactactagtactattagtnacgtagtaccaacttacgtccgtccgttacggttacggtttactaacgttcgtcttcgtcgtcggtacctacgtacgtcgtacgactaaccgccgtccttaccacgactactccgtcgtcggtcctaccggtaggtctaacgggacggacgtacggtactagtttactacgttacgnggtacncgtactacgtaatactaacgacactacataacgactaaccgtagtaccgtacgtacggtaaacggtccggaacgtacgtaccgtacctacggtacgtaccacccgggtaaccaacccgtaccctaccgtaccg

SEQ ID NO: 198740 - DNA, 730 bp, Homo sapiens
  misc_feature: GYAE6OF01AYRGA.18.59.F04.1.454.CMB.1.raw
  modified_base (203)..(203): a, c, t, g, unknown or other
  misc_feature (203)..(203): n is a, c, g, or t
  modified_base (214)..(214): a, c, t, g, unknown or other
  misc_feature (214)..(214): n is a, c, g, or t
  modified_base (219)..(219): a, c, t, g, unknown or other
  misc_feature (219)..(219): n is a, c, g, or t
  modified_base (233)..(233): a, c, t, g, unknown or other
  misc_feature (233)..(233): n is a, c, g, or t
  modified_base (267)..(267): a, c, t, g, unknown or other
  misc_feature (267)..(267): n is a, c, g, or t
tcagtacgagtatgcacgaccggtgctcgatttagtacacacacttagggagttggggggggtctcaggaggcagcgctctcgggacgtctccaccatggcctgggctctgctattcctcaccctcctcactcagggcacgagggtcctgggcccagtctgccctgactcagcctgccctccgtgtctgggtctccgtggacngtcgatcaccntctcngcacgtaggaaccngctaggtcgtacggttggttaggttaataacgtntcgtccttccgtacggtaacctaacgacgaccgacccgaaggaccaaaccgacccctaaactctagtcgtaatttagtagtagtcgtacctaacgttaccgtaccggtccctaggttacggggtttactacggttcgtccttcgtcgtacggttccctaccgtaagttccgtacgaccgtaacccgtacccgtccgtacccgtagtacctagttccttcgggtcgtcccgtcggacggtcgtacggacgggtaacgtaggtacttagggttaacttacttacggtacgtccgattccgtaactataaccgtacgacgaaccgtcctaaacgcgttactaccgttgtacgttacgtacgttaaccgggtaacggtacgggtaacctacgggttaccgtacccggttaccgtacggttaccgaaccccgttaacccgggaaccgtcccccgtaacccgtacccgg

SEQ ID NO: 198741 - DNA, 719 bp, Homo sapiens
  misc_feature: GYAE6OF01B1413.18.59.F04.1.454.CMB.1.raw
  modified_base (232)..(232): a, c, t, g, unknown or other
  misc_feature (232)..(232): n is a, c, g, or t
  modified_base (359)..(359): a, c, t, g, unknown or other
  misc_feature (359)..(359): n is a, c, g, or t
tcagtacgagtatgcacgaccggtgctcgatttagtacacacacttagggagttgggggggggtctcgaggaggcagcgctcgtcgggacgtctccaccatggcctggctctgctattccctcaccctcctcactcagggcacgagggtcctcgggcccagtcctcgccctgacctcacgcctcgccttcgtgtcgtgggtcctcgtggacagtcgactcaactctcgtccngccaactacgggaaacccagaccgaaggttggtaacgtttggttaagttaactaacgtatcgtctccgtaacggtaaccaacgacgaccaaccgaggaaccaaaccgaccccaagtcatagtattanacgtatcgtacaactacgtccgtcctaggttacggttactagtcctacgttctactcggactacgacgtcgtacgacaaccgtacgtccctaccgtcgaacctcttacgtccgttacggccctagggtacgggtactacggaacgggaccggtagtacgttagttaattaacggtcctacgactaacgtcctaaataacgtaagtaacaacgacctaaccgagtaaccttagtccttaacgtggttacgttaccgttaaaggaaccgtaagggtaaccccggacgttaccccgggaacccgttagaaccggttaaaccgacccgtaaaaccccggtacccaaccccgtaacccgttaacg

SEQ ID NO: 198742 - DNA, 816 bp, Homo sapiens
  misc_feature: GYAE6OF01CKLJJ.18.59.F04.1.454.CMB.1.raw
tcagtacgagtatgcacgaccggtgctcgatttagtacacacacttagggattgggggcgtgggggtctcaggaggcagcgctcgtcgggacgtctccaccatggcctgggctctgctattcctcaccctcctcactcagggcacgagggtcctgggtcccagtctgtgtctgacgcagccgcctcgagtgtcgtcggggcccgagggcaggacgggtccaccatccgtccgtcgcacgtggcgccacctaccaacgtacggtccgggggtcggttagtgacgttacgaactaccgttacggtaaccaggtactacggtccgttaccggaacggggaccaaccccgacccccgtaaaacgtccgtaccgtacgtttcggtttacgggaacacctaaaacgtaccggttacccggtacccgtacgggtaaccggggttcccctaacgggtaccgttaacttccggtccgtaccgggtaccctaccgtaacggttccgttaccgggaccctaccgttacccgacccgtccccgttacccgcggtacccacgtaaccgtacggtaccggtacccgttacggacggtacgtaggtaacggtacgtacgacggtacgttacgtaacttaacgttccgtaccggaccgtaaccgttacgtaacgtaacgtacgtaacgttggtacgttcgggtaaggttggttacgggttcgttaacgttcggttacggttcggtacggttacgggtaacccggtaaccgtaccggttaccgtaccccgttacgttaaccgacctaccgggtcccgtaaacccggtaccccc

SEQ ID NO: 198743 - DNA, 834 bp, Homo sapiens
  misc_feature: GYAE6OF01BZB5N.18.59.F04.1.454.CMB.1.raw
  modified_base (219)..(219): a, c, t, g, unknown or other
  misc_feature (219)..(219): n is a, c, g, or t
tcagtacgagtatgcacgaccggtgctcgatttagtacacacacttagggagttgggggctggggtctcaggaggcagcgctctcgggacgtctccaccatggcctgggctctgctattcctcaccctcctcactcagggcacgagggtcctgggccagtctgccctgactcagcctgcctccgtgtctgggtcctccgtggacagtcgactccacctntcctcctgcacgtacggaaccagactagtcggtacggttggtagttaataacgttagttcgttaccttccgtacggtaacccaacgtacgacccaacccggaggaaccccaaaacccggacccccctaaaatccgtaagttacgtaatttaacgtagtaacttcgtaacctaaccgttacggttcccggtaccccgtttacggtacggggtttacctaacgttccgttcttccgtcggtcgtaccctacgtaacgttaccgtacggaaccgtaacccgtccggtaccccttcccgtagtaccccgtattcccgtcggttaccgggtacccttccgggaacggtccgggtacggtaacgggggacccgtaggggttacccttaaggttaaccgttttacgtaccgttaggtacccgacgtttaaccttaacggaacttaacccgtaacgtaaacccgacgtaaacccacggttaccctaaccttacctttacggttaccgttacccgggtttaaccgttaccggggtaaccgttaacgggtaaacccggtacccggttaccggtaccgttacccggttaggaaccccacgggaaaccccgtaccccgggaaacccc

SEQ ID NO: 198744 - DNA, 875 bp, Homo sapiens
  misc_feature: GYAE6OF01C5IGO.18.59.F04.1.454.CMB.1.raw
  modified_base (207)..(207): a, c, t, g, unknown or other
  misc_feature (207)..(207): n is a, c, g, or t
tcagtacgagtatgcacgaccggtgctcgatttagtacacacacttagggattggggtctgggagaggagccccagccttgggattcccagtgttttcattcagtgatcaggactgaacacagaggactcaccatggagtttgggctgagctggtattttccttgctgacttaattttaaaggtgtccagtgtgaggtgcagctggnggtagtcggtgggggtaggcgtttaggggtaaacgggtcccggggggggttacccttaaggaccccttccccgtagtaaccgacggtcccttcgtcggtaacttccgtaactttccgaagttaacgggccttagggaacttacgaaaccggttcgggtccccgaccgacggtccgtacccggaaggggggtaaaccgggggcgttaggggtacgggttacggggttacggtacccggttaaaacgttaaaaaccccgaaaaataggtaacgtacggggtacgggaactaaaccgaagtaaccgtaccggacgtaccggacccgaacccggtaacggaaaacggctaacggtacttaccgaacctaacttaccgtacgaaaggtaataagtaggaaactttaaccgaaaaagtccctacgtacttaacgtactcgtaagaactaaacgtcgaaacctacgaaccgtaggaaacccgaaccggaacggtaaacccgacgttaacgggacccttaggttaaactaacccgttacgttaaacccctacctaaacccgtaccccgtaaggtaaaacccgtaccggttaaaccctaaacccgttaacccttaacggttaacccgttaaccggtaattacccgggtaacccgttccgggtacggggaaaccccgg

SEQ ID NO: 198745 - DNA, 648 bp, Homo sapiens
  misc_feature: GYAE6OF01ADN5Z.18.59.F04.1.454.CMB.1.raw
  modified_base (230)..(230): a, c, t, g, unknown or other
  misc_feature (230)..(230): n is a, c, g, or t
  modified_base (253)..(253): a, c, t, g, unknown or other
  misc_feature (253)..(253): n is a, c, g, or t
  modified_base (311)..(311): a, c, t, g, unknown or other
  misc_feature (311)..(311): n is a, c, g, or t
  modified_base (439)..(439): a, c, t, g, unknown or other
  misc_feature (439)..(439): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatcctcctgcactggaaccngcagtgacgttggtgttatactntgtctcctaggtaccaacagccacccaggacaaacgcccccaaactcatgtatttatnatgtacactaagtccggtccctcgtacgggttactaatccgtcttctcgtcggctaccgaagtcgtcggacaacgtaccggtcccctacccgtcgaaccctacgttcctcggtacgggtcctacccgnggtaccgtagggacggacggacggtctagttacttacttacgtgacgtacgtctacgtacttaacgtaacctaacgccctaaaccgacgtacctaccttccgtacttagtccgttaccggtaaccggtacggtaccgggtaaccgtaacggtccgacccggttaccgacggtaccacccgtaaccgaacccggtaccccacccgtaccg

SEQ ID NO: 198746 - DNA, 731 bp, Homo sapiens
  misc_feature: GYAE6OF01DEWPM.18.59.F04.1.454.CMB.1.raw
  modified_base (230)..(230): a, c, t, g, unknown or other
  misc_feature (230)..(230): n is a, c, g, or t
tcagtacgagtatgcacgaccggtgctcgatttagtacacacacttagggattggggggggtctcaggaggcagcgctctcgggacgtctccaccatggcctgggctctgctattcctcaccctctcactcagggcacagggtcctgggcccagtctgccctgactcagcctgcctcgtgtctgggtctccgtggacacgtcgatccaccatctctgacactcggaaccngcagttgacggtttgggtagttaattacgtatgtctccgtcggtaaccaacgacgaccaccgaggaccaaaccgtacccccaactacgaattcgaatttagtagtacgtgtactaacgttacgtaccggtacccttacgggtaacgggtttacttacttccggtactttccgtcgtcggtacctccgtaacgtccgtacggcctaaaccgcccggttcccctacccgtacgtaccctacgttccgtaaccggttccggtccgttaccgacggtacggtacggtaacgggacggtaaggtctagtactttaactttagtcgacgtcgtacctacgtaacttaacgttaacaacggtaacacggcgtaaccgtataaccggttaccgacgtttacccggtacgggtaaccgtaacggggtaacctaacggtccccgtaaccgtccggttaaccgcccgaacgttaaccccgaacgtacccccgaaaacccgttcgtaacccgg

SEQ ID NO: 198747 - DNA, 676 bp, Homo sapiens
  misc_feature: GYAE6OF01D7312.18.59.F04.1.454.CMB.1.raw
  modified_base (198)..(198): a, c, t, g, unknown or other
  misc_feature (198)..(198): n is a, c, g, or t
  modified_base (209)..(209): a, c, t, g, unknown or other
  misc_feature (209)..(209): n is a, c, g, or t
  modified_base (229)..(229): a, c, t, g, unknown or other
  misc_feature (229)..(229): n is a, c, g, or t
  modified_base (243)..(243): a, c, t, g, unknown or other
  misc_feature (243)..(243): n is a, c, g, or t
  modified_base (247)..(247): a, c, t, g, unknown or other
  misc_feature (247)..(247): n is a, c, g, or t
  modified_base (249)..(249): a, c, t, g, unknown or other
  misc_feature (249)..(249): n is a, c, g, or t
  modified_base (265)..(265): a, c, t, g, unknown or other
  misc_feature (265)..(265): n is a, c, g, or t
  modified_base (310)..(310): a, c, t, g, unknown or other
  misc_feature (310)..(310): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacgagggtcctgggcccagtctgccctgactcagcctgcctcgtgtctggtctctggacngtcgatcaccntctctgcactgacagcagtnacgtttggagttanactntntcttcgagtaaccaancgaccaccgagaccaaaccgccccaaactcatacgtattttagtnacttggtactaagtaacgtccggaccgttacggtagggtttacctaactccgttactttcctcgttacggtcttaaccgaaggtcgtacgaccgaaacggtcccgtccctacccgaagaccttcgtacgtacgtcgggtcctaccgaggaccggttaaggacgggaacgtcgggtactaacgttaagttacgtatcggtaactaggtacttagtaactaacgtaacaacgtcgaaacctcaacgttaccttacgtatttacgtacgttaccgttaacggtaaacggtcgggtaaacctaacggttacccgtaacggtacggtaccggtacgaacccgaccccgtaaccggaccccacccgttacgg

SEQ ID NO: 198748 - DNA, 655 bp, Homo sapiens
  misc_feature: GYAE6OF01DP9YH.18.59.F04.1.454.CMB.1.raw
  modified_base (224)..(224): a, c, t, g, unknown or other
  misc_feature (224)..(224): n is a, c, g, or t
  modified_base (245)..(245): a, c, t, g, unknown or other
  misc_feature (245)..(245): n is a, c, g, or t
  modified_base (324)..(324): a, c, t, g, unknown or other
  misc_feature (324)..(324): n is a, c, g, or t
  modified_base (622)..(622): a, c, t, g, unknown or other
  misc_feature (622)..(622): n is a, c, g, or t
  modified_base (625)..(625): a, c, t, g, unknown or other
  misc_feature (625)..(625): n is a, c, g, or t
  modified_base (627)..(628): a, c, t, g, unknown or other
  misc_feature (627)..(628): n is a, c, g, or t
  modified_base (631)..(631): a, c, t, g, unknown or other
  misc_feature (631)..(631): n is a, c, g, or t
  modified_base (636)..(636): a, c, t, g, unknown or other
  misc_feature (636)..(636): n is a, c, g, or t
  modified_base (639)..(639): a, c, t, g, unknown or other
  misc_feature (639)..(639): n is a, c, g, or t
  modified_base (641)..(641): a, c, t, g, unknown or other
  misc_feature (641)..(641): n is a, c, g, or t
  modified_base (644)..(645): a, c, t, g, unknown or other
  misc_feature (644)..(645): n is a, c, g, or t
  modified_base (650)..(650): a, c, t, g, unknown or other
  misc_feature (650)..(650): n is a, c, g, or t
  modified_base (652)..(653): a, c, t, g, unknown or other
  misc_feature (652)..(653): n is a, c, g, or t
  modified_base (655)..(655): a, c, t, g, unknown or other
  misc_feature (655)..(655): n is a, c, g, or t
tcagtacgagtatgcacgaccggtgctcgatttagtacacacacttagggattgggggctttgtctgggtctcctggacagtcgatcaccatctcctgcactggaaccagcagtgacgttggtgttataactatgtctcctgtacaacagcacccaggcaaacgaccccaaactcatgatttatgatgtcaactaatccgcctgtagggttactaatcgcttcnctggctacagtctaggcaacncggcctcctacgacctatcgtcgtcgggcttccgaggcagacggacgtaggtactggtaatttatacgtgcacgtctanattaacaactaacgaccacgaccacgtaaccttctactacgttagttaccgtaacgggtacgtacggaaacccggtaacgtacccggtaacggttaccccttagggaacccgacccgtaaaccccgtaaccggaaaccccccaaccgttacccgtttacgacccgttacggtttacccttacccccggtaccccctaacccctttccctacccggttaaccctaaccggtacttaccgtacggaacgggtcccggtaacgtacggaacgtaaccggacggtactaccggtagcctaancancnncancatcngcncncanncgcancnngn

SEQ ID NO: 198749 - DNA, 718 bp, Homo sapiens
  misc_feature: GYAE6OF01CMNQ1.18.59.F04.1.454.CMB.1.raw
  modified_base (212)..(212): a, c, t, g, unknown or other
  misc_feature (212)..(212): n is a, c, g, or t
  modified_base (272)..(272): a, c, t, g, unknown or other
  misc_feature (272)..(272): n is a, c, g, or t
tcagtacgagtatgcacgaccggtgctcgatttagtacacacacttagggagttggggggggtctcaggaggcagcgctctcgggacgtctccaccgatggcctgggctctgctattcctcaccctcctcactcgagggcacgtagggtcctgggccctagtctcgccctagactcagcctgtccctcgtgtcgtgggtcctccgtggaacncgtcggactcaacctgtccttccagacaacgtcggaaaccagctaggtcgtacggttggngttaaataacgtatcgttctaccgtcggtaacaacgagccaaccgaggaccaaaccgacccccaaaattccgaagtagtaatttacgtagtatctaactacgtaacgtcccggtaccctaggtacgggtttactaacctcggttccttactcgttcggcctaacgtaacgttcgcggacaaacccgtcggacccctttccgacggacccttaacgttccttcggaccgggtacctaccggacggtaccgacgggaacgggaaccggtggaccgttaagttactttaacgtttaccgacgtaccgtacacgttaacaaacgtttaacgaaaccgaacgaccgtaacacggtacctacgtacgttacctagttacggtacccgttaacggacgtacggtacgaacgtcctacgacccgtagccgaacgacccacggacccaacgtacg

SEQ ID NO: 198750 - DNA, 635 bp, Homo sapiens
  misc_feature: GYAE6OF01AN7BX.18.59.F04.1.454.CMB.1.raw
  modified_base (356)..(356): a, c, t, g, unknown or other
  misc_feature (356)..(356): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacgagggtcctgggcccagtctgccctgactcagcctgcctccgtgtcgtgggtcctccgtggacagtcgatccaccatcctctgccacgtacggaaccagcaggtcgtacggtttggttaggttaactaacttagttcgttccttccgttacggtaacccaacgacgaccacccgaaggaccaaaccgacccccaaactcatgttattagtatacgtntacactacgtccgacctcgtacggttctacgtctcttcgtcgtcgtcgtacagtcgtcgaccaccgaccgtcctccacgtacctactcgtcgcggctaccgaggtcaggacgcggtacgtcgtagtatttactacgtcgtcctacgcttactataactaacgtaacgaccgtaaccacgtacctaccttacacgttctacggttccggtaccggacggtacggaacctacggtccgtacccgcgtacgtacaccgacccgacggaccctacccgtaccg

SEQ ID NO: 198751 - DNA, 777 bp, Homo sapiens
  misc_feature: GYAE6OF01D1JLE.18.59.F04.1.454.CMB.1.raw
  modified_base (201)..(201): a, c, t, g, unknown or other
  misc_feature (201)..(201): n is a, c, g, or t
  modified_base (259)..(259): a, c, t, g, unknown or other
  misc_feature (259)..(259): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacgacgggtcctgggcccagtctcgccctgactcagcctgcctcgtgtcgtggtctctggacngtcgatcaccatctcctgacacgtacggaaaccgcagtggtacgttggtagtatactntcgtctccgtcggtaaccaacgacgaccaaccgtaacggaaccaaaccgaccccctaaactcgtaatgttaacttttagtagtagttacgtactaacgtacgtcccggtacccgttacggttaagggtttacctaacgttccgttacctttcgtacgttcggtctaaccgttaacgttcgtacggtaacgaaccgtacccggtccccttacccgtacgacccgttaagttcccgttacggtcccgggtaccctaccgggtacggtaccggttagggaacgggtacggtaacgggtccttaggtttaactttacgttacgttacgaccgtacgttcctaacgttactaaacctaaccgtaaccgacccctaaccgtccgtaaccttaaccgtctttaccggttacttacggttacccgtaacggttaccgggtaaccgtaaccggtaaccggttaccgtacccggttacgtaaccgggtcaaacccggtaccgaaaccccgtcccgtaacccgtaaccg

SEQ ID NO: 198752 - DNA, 773 bp, Homo sapiens
  misc_feature: GYAE6OF01CWP7M.18.59.F04.1.454.CMB.1.raw
  modified_base (236)..(236): a, c, t, g, unknown or other
  misc_feature (236)..(236): n is a, c, g, or t
  modified_base (291)..(291): a, c, t, g, unknown or other
  misc_feature (291)..(291): n is a, c, g, or t
  modified_base (325)..(325): a, c, t, g, unknown or other
  misc_feature (325)..(325): n is a, c, g, or t
  modified_base (337)..(337): a, c, t, g, unknown or other
  misc_feature (337)..(337): n is a, c, g, or t
tcagtacgagtatgcacgaccggtgctcgatttagtacacacacttagggagttggggggggtctcaggaggcagcgctctcgggacgtctccaccatggcctgggctctgctattcctcaccctctcactcagggcacagggtcctgggcccagtctcgccctgactcacgcctgcctcgtgtcgtcggtctaccgtggacagtcgatcaccatctacctgcacgtacggaaccngacagttcggacgttagggtacgttaataacgtatcggtctacgtaggtaccaancgaccaaccgaggacctaaaacgcccctaaactnagtacgtattangatgtacaatactcgtaccctagtagggtttacagtcgtacttcgtcgtagtcctacgtaagttcacggtaccgaaccgtacccggcccttaaccccgtagtaaacccgtacttccgttaccggtacgggaccctaacccggtagggtaaccgttcgggaaaccggtaacgggttaacgcggtttaacgttaacgttttaaacggtttcgacggttaccgtacgggtaccttaaaccttaaggttaaaaccaccggaaacgtccgaaggtacctaacggaacccttagtaaccgtaaccgggtttcgttaaaccgggaaacgttaaccggggaaaccgttaaccgggtaccctaaaccgggttttacccgaaaccgggtacaaccccgggttaaacccgaaccccgtaaaccccgaaccccgtagtttaaacccgg

SEQ ID NO: 198753 - DNA, 714 bp, Homo sapiens
  misc_feature: GYAE6OF01BPV5H.18.59.F04.1.454.CMB.1.raw
  modified_base (197)..(197): a, c, t, g, unknown or other
  misc_feature (197)..(197): n is a, c, g, or t
  modified_base (709)..(709): a, c, t, g, unknown or other
  misc_feature (709)..(709): n is a, c, g, or t
  modified_base (713)..(713): a, c, t, g, unknown or other
  misc_feature (713)..(713): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacngcaccaggcaaacgccccaactcatgtatttatgatgtactactaatccggacctcgtaggggtttactaatcgtcttctctggcctaccaagtctggacaaccgaccggccctcctcgaccctatccgtcgtcgggtacctccgagggtacgtagggaacgggtaccggtaaggtccgttaggttaactttaacgtttacggtacaccggtaacgtaccttacgtaaacttaaacaccgaaaccgtaccaacccgtacgaccttaacttccttacgtttacgttaccgttaccgttaacggtaaccgttacgggaaacccgtaacggtacccgtacccggttacgtaccggtaccgaaccggtaccccgaaccggtaccccctaaccccgtccgttacgtaccctacccttacccgttaccccgttccccctaaccccttccctaccctacttaccgttccgtaccgtagaccgggtccggtcgttcgggaacgcggccacgactgacagntcgnc

SEQ ID NO: 198754 - DNA, 886 bp, Homo sapiens
  misc_feature: GYAE6OF01DVNIT.18.59.F04.1.454.CMB.1.raw
  modified_base (217)..(217): a, c, t, g, unknown or other
  misc_feature (217)..(217): n is a, c, g, or t
  modified_base (264)..(264): a, c, t, g, unknown or other
  misc_feature (264)..(264): n is a, c, g, or t
tcagtacgagtatgcacgaccggtgctcgatttagtacacacacttagggagttgggggggggtctcaggaggcagcgctctcgggacgtctccaccatggcctgggctctgctattccctccacccctcctcactcacgggcacacgggtcctgggcccagtctgccctgactcaacctgcctccgtgtcgtggtctccgtggacagtcatcaccntctctgcactggaaccagcagtggtacgttggttagttaactaactntgttctccgtagtaaccacacgccaaccgagaaccaaaccgaccccaaactctactagtagttatagtacttgtactacgtacgtccggtaccgttcggttacgggtttacctacgttccgtctttccgtcggtcggtacctacgtacgtcgtacggtaacctacccggtacccgtccccgtaccctacggtacccttacgttccggttacgggtccgggttaccctacccggtacgggtacggtaaacgggggtaccgggaacccgggttaggtacgtttacggtttaacgttttaaccgttaccgggtactaaccggtacttaccgtttaacgtaaaacgtttacgaaaaccggtaaacctcggaaccggtaactaacccggttaccctaaacccgtttacgggtaaaccgggttttaaaccccggttaaacccgggggttaaaccccggggttaacccggggtaaacccgggtaaacccgggtttaacccccggtaaccccggggtttaaccccggttaaacccgggtaccccgttaaaacccccgggggtaccccgaaaaaccccccgggaacccccccgtttaaaccccccgtggttttaacccccgggttaacccc

SEQ ID NO: 198755 - DNA, 734 bp, Homo sapiens
  misc_feature: GYAE6OF01C1DC6.18.59.F04.1.454.CMB.1.raw
  modified_base (141)..(141): a, c, t, g, unknown or other
  misc_feature (141)..(141): n is a, c, g, or t
  modified_base (204)..(204): a, c, t, g, unknown or other
  misc_feature (204)..(204): n is a, c, g, or t
  modified_base (235)..(235): a, c, t, g, unknown or other
  misc_feature (235)..(235): n is a, c, g, or t
  modified_base (260)..(260): a, c, t, g, unknown or other
  misc_feature (260)..(260): n is a, c, g, or t
tcagtacgagtatgcacgaccggtgctcgatttagtacacacacttagggagttggggggggtctcaggaggcagcgctctcgggacgtctccgaccatggcctggctctgctattcctcaccctctcactcagggcacgngggtcctgggcccagtcctcgccctgactcagcctgcctccgtgtctgggtcctccgtggacngtcgatcaccatcctcctgcacgtggaaccngcagtgtacgttggtagttatactntagtctccgtgtaccaacagccaccaggaccaaacgcccccaaactcactagtaatttagtgtatcggtacaacgttaacgtccggtccccttacggttacggggtttaccttaacgtccggttacctttccttccgtacggtcctaccgtacgtacgttacggactaacccgacccgggtccttaccccgtcgtaaccctacgttccgtaccgtcgggtcccttaccggaggtcgtaggacgggtaacggacggttccgtaggttaactttaacgtacgtacgaccgtagtccgtactaattaaccgtaaccgaacggtacccacgtacgtacctacctccgttactaccgtttacggtacccgttacgggaaaccgtaccgggtaaccgttaaccggtcccgtaacccggttacccggttacggtaccctaacccggaccccgtaaacccgaccccgtaaaccccgttaccg

SEQ ID NO: 198756 - DNA, 725 bp, Homo sapiens
  misc_feature: GYAE6OF01CXRO1.18.59.F04.1.454.CMB.1.raw
  modified_base (239)..(239): a, c, t, g, unknown or other
  misc_feature (239)..(239): n is a, c, g, or t
  modified_base (246)..(246): a, c, t, g, unknown or other
  misc_feature (246)..(246): n is a, c, g, or t
  modified_base (268)..(268): a, c, t, g, unknown or other
  misc_feature (268)..(268): n is a, c, g, or t
  modified_base (285)..(285): a, c, t, g, unknown or other
  misc_feature (285)..(285): n is a, c, g, or t
  modified_base (372)..(372): a, c, t, g, unknown or other
  misc_feature (372)..(372): n is a, c, g, or t
tcagtacgagtatgcacgaccggtgctcgatttagtacacacacttagggagttggggggggtctcaggaggcagcgctcgtcgggacgtcctccaccatggcctggctctgctattcctcaccctcctcactcagggcacgtacggggtcctcgggcccagtctcgccctgacctacaacctcgccttccgtgtcgtcgggtcctaccgtggacagtcatccactatcctctgcacgnggaaccngcagtgtgttggtgtaatactntgtctaccgtgtaccanacgccaccagaccaaaccgaccccaactgatgttattagagtagttctagagtaccgtccgtcctacggttagttaccgattccgtnttccgtcgtacgtacctactagttccgtaggacctaccggtaacccgtcccgtacctacggtaacctagttcccgtcggttaacggccctaccgggtacgtacgtacgggaacggaacgtcggtaacgttggttaactttacgttaccgtacggacgttaccgtacaacgtttaataacgttaaacgacgtaaccgaacgcgtaaccgaccgttaccgttaacgttacggtttaaccccggtaaacgggtacggtaacccggtaccgtaacccgggttaccctaccccggtagttaccggaacccgacgtaaaccccccgtaacgaccccgttaacctgggtcccttaacccg

SEQ ID NO: 198757 - DNA, 692 bp, Homo sapiens
  misc_feature: GYAE6OF01CHKRD.18.59.F04.1.454.CMB.1.raw
  modified_base (279)..(279): a, c, t, g, unknown or other
  misc_feature (279)..(279): n is a, c, g, or t
  modified_base (565)..(565): a, c, t, g, unknown or other
  misc_feature (565)..(565): n is a, c, g, or t
tcagtacgagtatgcacgaccggtgctcgatttagtacacacacttagggagttggggggggtctcaggaggcagcgctctcgggacgtctccacatggcctgggctctgctattcctcacccttcctcactcgagggcacgacgggtcctcgggcccaggtctcgccctgactcacgcctcgcctccgtgtcgtgggtctccgtggacagtcatcaccagtctcctgactacgtacggaaccagcaaggttcgtacggtttggtacggttaataactntcgtcctacgtacggtaccaacgtacgaccaaccgacggaaccaaaccgacccccaaactaccagtattaacgttatacggtatacgtactaactacgtaccggtacccgttacgtaggggtttacctaacgttcgttccgttcgttacgtcggtactaccgtaaggtctacggaccacgtacccgtcccgtccacgtaccagtccgtcgtacgcttccgagtcgtagacgggtacgagtcgtacgtattaattcgataccgtagtactacgaacttagaacaacnccgtaacacgtactactacttacgttaacgttctacgggtaaccgtaaggtaccggtaacgtaaccgttacccggaccgtaccgtaacggtcaaccgtacccgggaaccctacccgaacctacccgg

SEQ ID NO: 198758 - DNA, 694 bp, Homo sapiens
  misc_feature: GYAE6OF01CAFC4.18.59.F04.1.454.CMB.1.raw
  modified_base (138)..(138): a, c, t, g, unknown or other
  misc_feature (138)..(138): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctctcactcaggcanaggtcctgggcccagtctgccctgactcagcctgcctcgtgtctgggtctccgtggaccagtcgatcaccatcctcctgacacgtggaaccagcaggtgtaacggtttggtaggttataacctatgtctcctaggtacctaacacgtccaacctaaggacctaaacgccccctaaactcgaatacggatttatgtactacgtactactaactccggtaccctcgtacgggtttctaagtccgacgtttctacgtcggtcttaccaagttccgtagaccaacgtaccggcccttacccgtcgaccgtactcgtcgtcgggtcctccgaggtcttcggaacggtacgaggcttaggtactttacgttactgcgtagtacgtactaagttacttaacgacgtaccgaaccttacggaccgtaacttccgtaacttacgttacgttaccgttaccggtaaaccgttcgggaaccgttaacccgggtccgtaaccccgttaccggttaacggtacccgtaacccggaacccgtacccggtaccccgaacccccgttaccgg

SEQ ID NO: 198759 - DNA, 746 bp, Homo sapiens
  misc_feature: GYAE6OF01EQ1R5.18.59.F04.1.454.CMB.1.raw
  modified_base (497)..(497): a, c, t, g, unknown or other
  misc_feature (497)..(497): n is a, c, g, or t
tcagtacgagtatgcacgaccggtgctcgatttagtacacacacttagggattgggggctgggggtctcagggaggcagcgctctcgggacgtctccaccatggcctgggctctgctattcctccaccctcctcactcgagggcacgacgggtcctcgggcccagtctcgccctgactcgacgtcctcgtccctcgtgtcgtcgggtcctccgtaggactagtccgtatccacctacttcctctcgacctacgacggaaccagtacgaggtcggtacggtttggttaggttaattaactagtcgtcctacgtacggtaccaacacgtaccgaccgacggacctaaaccccgacccctaaatacctatagttatttagagtagtctactactacgtcccgtaccgtacggtacggtttactactcttaccttctcgtcgtactacgtacgtcgtacgacctacgcccgtactccgcacctacgtcgttcggcggtccncggtacgcgtacggaggtacgcgtgttaagttacttaacgtcgtacgtaccggtactcgtaagtaacgttaacgaactaacccgaccaacgttcccgtacttaccttaaccgttaccgtttccgtacgttttaaacccggacgggttaaccgggacgggtaaaccccgtaccgggttaacccccgttaccggttaaccgggacccgtaaccgtaaccccggtaaacccggtaccccggttaaacccccg

SEQ ID NO: 198760 - DNA, 733 bp, Homo sapiens
  misc_feature: GYAE6OF01DVEYZ.18.59.F04.1.454.CMB.1.raw
  modified_base (166)..(166): a, c, t, g, unknown or other
  misc_feature (166)..(166): n is a, c, g, or t
  modified_base (181)..(181): a, c, t, g, unknown or other
  misc_feature (181)..(181): n is a, c, g, or t
  modified_base (276)..(276): a, c, t, g, unknown or other
  misc_feature (276)..(276): n is a, c, g, or t
  modified_base (278)..(278): a, c, t, g, unknown or other
  misc_feature (278)..(278): n is a, c, g, or t
  modified_base (311)..(311): a, c, t, g, unknown or other
  misc_feature (311)..(311): n is a, c, g, or t
  modified_base (313)..(313): a, c, t, g, unknown or other
  misc_feature (313)..(313): n is a, c, g, or t
tcagtacgagtatgcacgaccggtgctcgatttagtacacacacttagggagttggggggggtctcaggaggcagcgctctcgggacgtctccaccatggcctggctctgctattcctcaccctctcactcagggcacagggtcctggcccagtctgccctgactnagcctgcctcgtgtntagggtcacctggacaggtcgatcaccgatctcctagcctactggaaccagctagtgaacggtttggtagttaatactatgtctctggtaccaanancaccagacaacgaccccaactcatcgatttagngntgtcagtagtccgccctagtacgggtttactaatcgtacgttctcgttcggtctaccgtaagtccgttacggacctaaaccgtccgggtaccttccccggttacgacccgttagtttccgaccggttacgggtaccgttaaccggacgggtccgttaaggacgggtaaactgggaccggtacgtcgtaaccgtttaacttaccgtacgcccgtaacgtaccgtacgttaacgacgttaaagtcggtagtacgttacggttaaccgggttaggtttacccgtaagtttccggtacgttccggggtaagtttcccggttaacggggtaacccgttaaacgggtaccctaaccccggttaaccgttaaaccggttaaccggaaccccggtaacccgtaaccgggtaaacccccgtaacccccg

SEQ ID NO: 198761 - DNA, 724 bp, Homo sapiens
  misc_feature: GYAE6OF01E269K.18.59.F04.1.454.CMB.1.raw
  modified_base (285)..(285): a, c, t, g, unknown or other
  misc_feature (285)..(285): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctctcactcagggcacagggtcctgggcccagtctgccctgactcagcctgcctcgtgtctgggtctctggacagtcgatcaccatctcctgcactggaaccagcagtgacgttggtagttatactatgtctcctggtaccaacagcaccaggacaaacncccccaaactcatgattatgatgtacactaactccggacctcgtagggtttctaagtcgtcttctcgtcggcctaccgtaacgtcgtcggtacctaacgacccgggtcccttcccgtacggaccctacgtccttaccggtcgggtccctaccggtacggtccgttacgggaacgggtaccgggtaacgggtccgttaaggttaactttacgtttaaccggtcgacgtaccgtaccgttctaacttaacgttaaccgaaacggtacctaacccgacggtaccctaacttcccgttacgttaacgtttcggttaccgtttaaccggggtaaaccgggtttaccgggtaaaccccggttaaacggggttaccccttaacccgggttacccggttaaacgggacccgtaacccggtacccccgaaaccgggtaacccccccgg

SEQ ID NO: 198762 - DNA, 772 bp, Homo sapiens
  misc_feature: GYAE6OF01CMP8D.18.59.F04.1.454.CMB.1.raw
tcagtacgagtatgcacgaccggtgctcgatttagtacacacacttagggattggggggggtctcaggaggcagcgctctcgggacgtctccaccatggcctgggctctgctattcctcaccctcctcactcgaggcacagggtcctgggcccagtctcgccctgactcagcctgcctcatgtcgtgggtctccgtggacctaggtccgatccaaccctattcctccgtcgcctaacgtcgggaaacccaggccgtaaggtcggttaaccggtttggggtacgttttaaactaacgttattcgttaccgttaccgtacggttaaaccaacgaccggacccaacccgacggaaccaaaacccgtacccccctaaaactccgtaacttacgttactttaacgtacgtacttcggttaacctaacgttaacgttcccgggtcccttacgggtaacgggtttacctaacgttccgtctttcgtcgtcgtactacgtaacgtcgtacgacctaccgtacccgtcctcccgactacctactccgtcgtaccgggtaccctaggtcggtaccgttaggacggtacggtacgtaccgttagttaagtttaccgttaacgtcgtaccgtatacccgttactaacgttaacgaaccgaacgcctaaacccgtatacctacgtccttacgtcgttacggttaccgtacggtaacgtccggtaaacgtcggttaccctacggtaccgtacggaccgtacccacccggtaacgaccctaacccgg

SEQ ID NO: 198763 - DNA, 812 bp, Homo sapiens
  misc_feature: GYAE6OF01DW2CV.18.59.F04.1.454.CMB.1.raw
  modified_base (63)..(63): a, c, t, g, unknown or other
  misc_feature (63)..(63): n is a, c, g, or t
  modified_base (192)..(192): a, c, t, g, unknown or other
  misc_feature (192)..(192): n is a, c, g, or t
  modified_base (275)..(275): a, c, t, g, unknown or other
  misc_feature (275)..(275): n is a, c, g, or t
  modified_base (534)..(534): a, c, t, g, unknown or other
  misc_feature (534)..(534): n is a, c, g, or t
  modified_base (595)..(595): a, c, t, g, unknown or other
  misc_feature (595)..(595): n is a, c, g, or t
tcagtacgagtatgcacgaccggtgctcgatttagtacacacacttagggattggggagctcngggagaggagccccagccttgggattcccaagtgttttcattcagtgatcaggactgaacacagaggactcaccatggagtttgggctgagctggtattttccgttgcttgcttaagttttaaaaggtntcagtgtgaggtgcagcgtggtggagtcgtgggggagcgttagggtaaacgggcccggggggttcccttagaccgttccccgngtaaccacgccttcgtggtaactttctaactttcgtaggtaacggccttaggatcgtaacggtcggggtccaccgagggtcctaccgggaagggggtacgggggcgtggggtaaggttgggggtcgtaaccgttaaattaaaaaaccgaaacgtagtaggtacgggtacggaaactaaacgtacgtaaccgtaccgctacgtaccgaacccggtaggaaagccgaagtaccgttacaccctaagtctaactaaacggtnaagttacgtaaacgttaaacgaaaaacgtaccgaacgtccgttaaggttacttaaccgtanaaacgtaaagtacgaaaccgttacgggaaccttaaacgggaaccggaaacgggtaaccggaaccgaaccggtaacccggtaccggtttacttaaacggtttaccctaacggttaccccgaaaccgtcccgtaaaccccttaaaggaaccggttacctaaccgttaaacctaacccgttaacttaacgtacccggttacgtacggcccgttaacgggg

SEQ ID NO: 198764 - DNA, 697 bp, Homo sapiens
  misc_feature: GYAE6OF01DLGUH.18.59.F04.1.454.CMB.1.raw
  modified_base (317)..(317): a, c, t, g, unknown or other
  misc_feature (317)..(317): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctctcactcagggcacagggtcctgggcccagtctgccctgactcagcctgcctccgtgtctgggtctcctggacagtcgatcaccatcctcctgcacgtggaccagcagtgacgttggtagtatactatcgtctcgtcgtaccaacacgcaccccaggacaaaccgaccccaaacgtcatcgtaatttagngtatcgtacaacgttaacgtccggtaccctacggtacgggtttactaagttccgtcttacgtcgtacggcctacgtaacgtcgtacgcgtaaccgaccggtccctaccgtacggaaccctattcccgtcgtcggggtaccctccggacggtacgtacgggtaacgggtaccggacggtccgttaaggttaacctttaagttaccctagggccctaacggtaccttactagttaaacgttaacaccggacctaacccacgtacctaccttaccctactacgtttaccggttaccgtttaccgggtaaacgttaccggaaaccgtaccggtacccgtaacccgtcggtaaccgtacgaacccgaccgtaacccggaaccccc

SEQ ID NO: 198765 - DNA, 642 bp, Homo sapiens
  misc_feature: GYAE6OF01D4IDE.18.59.F04.1.454.CMB.1.raw
  modified_base (235)..(235): a, c, t, g, unknown or other
  misc_feature (235)..(235): n is a, c, g, or t
  modified_base (314)..(314): a, c, t, g, unknown or other
  misc_feature (314)..(314): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacgagggtcctgggcccagtctgccctgactcagcctgccttccgtgtctgggtctccgtggacagtcgatcacctatctcctgcagtggaaccngcagtgacgttggtagttataactatcgtctctggtaccaacagacaccaggacaaacgaccccaaatcatgtatttangatcgtactaactaagtccggacctacgtacgggtttacaacgtcgtctttactcgtcgctaccgaacgtaccggacaaccgaccggtccctcccgtacgtacctactcgttacgtcgggcctacgacggtcgtaggaacggtacgaggtcgtagtaattaactttcgtacgacgacgtactagaattaactaacgaacgtactaccacgtacctaccttctacttagtccgttacgttaccggtaacgtaggggaaccctacgggtacccgtacccgttaccggtacggttaccaaccggaccccgaaaccgtaccccgtaaacccc

SEQ ID NO: 198766 - DNA, 667 bp, Homo sapiens
  misc_feature: GYAE6OF01A6OQ0.18.59.F04.1.454.CMB.1.raw
  modified_base (174)..(174): a, c, t, g, unknown or other
  misc_feature (174)..(174): n is a, c, g, or t
  modified_base (182)..(182): a, c, t, g, unknown or other
  misc_feature (182)..(182): n is a, c, g, or t
  modified_base (190)..(190): a, c, t, g, unknown or other
  misc_feature (190)..(190): n is a, c, g, or t
  modified_base (205)..(205): a, c, t, g, unknown or other
  misc_feature (205)..(205): n is a, c, g, or t
  modified_base (213)..(213): a, c, t, g, unknown or other
  misc_feature (213)..(213): n is a, c, g, or t
  modified_base (222)..(222): a, c, t, g, unknown or other
  misc_feature (222)..(222): n is a, c, g, or t
  modified_base (227)..(227): a, c, t, g, unknown or other
  misc_feature (227)..(227): n is a, c, g, or t
  modified_base (429)..(429): a, c, t, g, unknown or other
  misc_feature (429)..(429): n is a, c, g, or t
  modified_base (660)..(661): a, c, t, g, unknown or other
  misc_feature (660)..(661): n is a, c, g, or t
  modified_base (664)..(664): a, c, t, g, unknown or other
  misc_feature (664)..(664): n is a, c, g, or t
tcagtacgagtatgcacgaccggtgctcgatttagtacacacacttagggattggggctttgcctgggtcctggcccagtctgccctgactcagcctgcctccgtgtctgggtctcctggacagtcgatccacctatctcctgcactggacagcagtgtacgtggtgtataatntgtctccngtaccacngccaccgagacaacncccctaancatgtattngagtnactactacgtcgccctaggtaggttactagtctccttctacgtcggtccacgtaacggtcgtacggaccaaaccggtcccgtccctccgttacgacctaccttccgtacgtcggccttcccggaagccgtaacgggacgaccggtagggtacttcggttaaacttaggtaccctaggacgttaccgacttacgacgtttaanaaccgaacgacccgacatacgtccttacgtcttcgttacgttccgttaccgtacggtaccggtaacgtaccgtaccgtaccgtaccgtagtaccgtaccgaccgtaacccgaaccctaacccgcgttaccgaccgttaaccctcgtaccccgttcccctacccttccgtaccttaacccgtacgtaccgtacgtcgacggacgtcgtacgcggcgttccgactacgtgacnnccntgc

SEQ ID NO: 198767 - DNA, 586 bp, Homo sapiens
  misc_feature: GYAE6OF01E3DVY.18.59.F04.1.454.CMB.1.raw
  modified_base (225)..(225): a, c, t, g, unknown or other
  misc_feature (225)..(225): n is a, c, g, or t
  modified_base (415)..(415): a, c, t, g, unknown or other
  misc_feature (415)..(415): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctcgtgtctggtctctggacagtcgatcaccatctcctgcactggaaccngcagtgacgttggtgttataactatgtctctggtaccaacagcaccaggacaacgcccccaactcatgatttatgatgtacactaatccggcctcgtaggggtttctaatcgtcttctctgctccaagtctggcaacgaccggtccctcctgacctatctcgtggctccgagcgtgaacggacgaggctntagttattactgacctagtctacaattactaacaacgccaacccagtaccacgttcttactacgtcgttaccggttaccggaaaccggtcgggtaacccctaaagggtcccaacccggtttaccggtaacgtccgtaacccgacccgaaccggacccccaacccctaaccg

SEQ ID NO: 198768 - DNA, 848 bp, Homo sapiens
  misc_feature: GYAE6OF01D87OZ.18.59.F04.1.454.CMB.1.raw
  modified_base (412)..(412): a, c, t, g, unknown or other
  misc_feature (412)..(412): n is a, c, g, or t
  modified_base (627)..(627): a, c, t, g, unknown or other
  misc_feature (627)..(627): n is a, c, g, or t
tcagtacgagtatgcacgaccggtgctcgatttagtacacacacttagggattggggagctctgggagaggacgccccagccgttgggacttcccaagttgttttcattcagtgatcaggactgaacacagaggacctcaccagtggagtttggctgagctaggttatttccttgctacgtctttaaagttttaaagggtcgtaccagtgtaggtagggtcgcctaggtcggtgggttaggacggttcgggtagggggacggtacggttaaggggtaaaaccggggtcccggggggttaccttaaccggtccccttaccccggtagtacgaccgttccgttccgtagggttactttacctaccgttacgtaacgggtaacgtccgttggatacgggtaacgtccggggtccnccgtaacgggtcaccggaaggggaaggtcggtaggtagggtacgggtttcgaaaccggtttaaaacttaaaaaaccggtaaagttaggaaggggttacgggaacgtaaaccgaaacggtacgtaacgtaccggtcgtacgacccgtacggaaagaacgggtcaaggtacctacaacgttacacgtacaagtagagtacgtaaactaacgaaacgnaaaccgttagtacgttaactacgtacgaacttaaacgaacgtaccgaacgtaacccgacggaacggaaacggtacgaaccgaacggttaccgacgtttaacggtaaccttaatcccgaaacccgtacccttacgtaccccgtaagtaacccggtaactaaccgaaacccttacccgttaaaccgtacggtaactttaccggaacccgcgggttaacccggg

SEQ ID NO: 198769 - DNA, 641 bp, Homo sapiens
  misc_feature: GYAE6OF01AKO6F.18.59.F04.1.454.CMB.1.raw
  modified_base (231)..(231): a, c, t, g, unknown or other
  misc_feature (231)..(231): n is a, c, g, or t
  modified_base (297)..(297): a, c, t, g, unknown or other
  misc_feature (297)..(297): n is a, c, g, or t
  modified_base (328)..(328): a, c, t, g, unknown or other
  misc_feature (328)..(328): n is a, c, g, or t
  modified_base (382)..(382): a, c, t, g, unknown or other
  misc_feature (382)..(382): n is a, c, g, or t
  modified_base (627)..(627): a, c, t, g, unknown or other
  misc_feature (627)..(627): n is a, c, g, or t
  modified_base (636)..(636): a, c, t, g, unknown or other
  misc_feature (636)..(636): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgccccaaactcatgatttancgatgtactactaactccggcctcgtacggggtttctaatcgcttctctcggctcagtctgcaacncgcctcctcgaccatctcgtggactcgagcnggacggacgaggctagtattattactcgcgacgctcaatataacaagcagcganaccgtactcttcgattcgtacgttacggtaacggtacggaaccgtaacggtcctacccggtaaccgttcgggaaccaacggaccccaaacggtccccaaacccgtacgtccgtaccacccgtttccgtcccgtttaccccacccctttacccgaccgtaaccttaccgtcccggttaaactccgggaccgggtccgggtaccggttacggggaaccctacggggtaccaccgtaaacgtacggtnaacggttcncgacg

SEQ ID NO: 198770 - DNA, 654 bp, Homo sapiens
  misc_feature: GYAE6OF01AIBMW.18.59.F04.1.454.CMB.1.raw
  modified_base (201)..(201): a, c, t, g, unknown or other
  misc_feature (201)..(201): n is a, c, g, or t
  modified_base (231)..(231): a, c, t, g, unknown or other
  misc_feature (231)..(231): n is a, c, g, or t
  modified_base (234)..(234): a, c, t, g, unknown or other
  misc_feature (234)..(234): n is a, c, g, or t
  modified_base (460)..(460): a, c, t, g, unknown or other
  misc_feature (460)..(460): n is a, c, g, or t
  modified_base (490)..(490): a, c, t, g, unknown or other
  misc_feature (490)..(490): n is a, c, g, or t
  modified_base (544)..(544): a, c, t, g, unknown or other
  misc_feature (544)..(544): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtcgtggtctccgtggacngtcgatcacatctcctgcacgtcggaaccngcngtcgtcgttggtcgttactacgtatgtctcgtacgtaccaacacgccaccgaggaccaaacggcccccaaagtcattgtaactttagagtatcgtacaacgttaaccgtccggacccgtaggttacgggtttacttaacgtccggttccttcgtacgtccgtctccgtaaggtcgtcgactaaccgcccgtcctccgacgacctctccgtcggtcggtccgtacgnggtcggtacggacgggacgtcggtacgttntaacgtttacttacgcgcctacggcttaacgacttgaacctacgcctaaccggntacctactcgtacgttcgcgtttacgtcggtaaacgtcggtacccgtagggtccctaaccggttccgtaacggtcaacccgggtacccaaccgtccccgaacccttccgg

SEQ ID NO: 198771 - DNA, 811 bp, Homo sapiens
  misc_feature: GYAE6OF01D5X1S.18.59.F04.1.454.CMB.1.raw
  modified_base (755)..(755): a, c, t, g, unknown or other
  misc_feature (755)..(755): n is a, c, g, or t
tcagtacgagtatgcacgaccggtgctcgatttagtacacacacttagggattggggtctgggagaggagccccagccttgggattcccaagtgttttcgattcagtgatcaggactgaacacagaggactcaccatggaggtttgggctgagctggtattttcctgctgcttaatttaaaaggtgtaccagtgtgtaggtgcagcgtggtggagtcggtgggggaggtcgttagggtaaacgggtcccggggggttacccttaggtacctccccgtagtacacgtcctcgtggtacttctactttcgaagttaacggtccgtggagtgaaccgttcggggtcccgaccgacggtccttaccgggagggggtaacgggggtcgttagggggtaagggttcggggggtttacgggtaacccgtttaaacgtttaaaaaacccgtaaaaacgttggtaacggtaggggtaacggggaaccaaaaccggacggtaacctaaccggtcctacgggccctaacccgggtaaggaaacgggcctaaggtactttacccgacctaagtaccgtaacgtaacggtaacgtaagtaacggttaagttaaacccgaaaaaagtcccgtaacgtacttaaggtaactcggtaacgactaaaacgtacgaaaccgacgtacgtaaccggaacggaaccgacggaaccacgacgtacggtattactaacgtactaaccgactaccgtaccggtaagaacgtccttaanaacccgttataccgtaaccgtaaggttactacggtacctagggccgggtaaaccgg

SEQ ID NO: 198772 - DNA, 767 bp, Homo sapiens
  misc_feature: GYAE6OF01DQ223.18.59.F04.1.454.CMB.1.raw
  modified_base (186)..(186): a, c, t, g, unknown or other
  misc_feature (186)..(186): n is a, c, g, or t
  modified_base (202)..(202): a, c, t, g, unknown or other
  misc_feature (202)..(202): n is a, c, g, or t
  modified_base (238)..(238): a, c, t, g, unknown or other
  misc_feature (238)..(238): n is a, c, g, or t
  modified_base (654)..(654): a, c, t, g, unknown or other
  misc_feature (654)..(654): n is a, c, g, or t
tcagtacgagtatgcacgaccggtgctcgatttagtacacacacttagggattggggggggtctcaggaggcagcgctctcgggacgtctccaccatggcctgggctctgctattcctcaccctctcactcagggcacgagggtcctcgggcccagtctcgccctgactcacgcctcgcctccgtntcgtggtctctggacngtcgatcaccatcctctcgactacgtacggaaaccngacctaggtcggtacggttttgggttacggttaattaacttagtttcgttccttccgttacgtaaccaacgaccgacccaacccgaacggacctaaaaacccgaccccctaaaataccgtatagttaatttatgtacttactacctaacttaaccgtcccgggtaccccttagggttaaccggttttaccttacgtccttcctttccgtaacgttcggtaacccttccgtaaacgtttccgcgtaacccgaacccgtcccggtcccctttacccggactaaccctacgtttccttcgggttacccggccgtaccgggttacggaccgtacggggtaacggaacgggtgtaccgtttagtttaacgttaactttacgaccgtcctagtactactaagtaactacgaacaccgaaacnccgcttaacttcttacgttacgttcgttacccggtaagtaccgggtacgtaaacccgtacgggtccctaccgggtatcggtaccaccggaacccacccgaaccctacggaccc

SEQ ID NO: 198773 - DNA, 708 bp, Homo sapiens
  misc_feature: GYAE6OF01CB4UK.18.59.F04.1.454.CMB.1.raw
  modified_base (200)..(200): a, c, t, g, unknown or other
  misc_feature (200)..(200): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgccctccgtgtctgggtctcctggacngtcgatcaccatctcctgctactacggaaccaacgagtgtacgtttgggtagttaaataactagtcgtccttccgtacggtaaccaacgacgaccaccgaacggaccaaaccgaccccaaatcatacgtattagtagatcgtactaactaacgtccggtaccgttacggtacgggttttactaacgtccgtacttcgtcgtcgcctacgtaagtcgtacgaaccaacgtaccgtccctaccgtacgtacctacgtcgtacgtccggtaccgtcgacggtcgtaggaacggacgtacggtatagttattacgttacgtcgacgtcgtactagtactaacgtaaccgaacacccgtaaccgtacgtacctacttacttaccgttacttccggttaccggtaccggtaacggtacccgggtaacctaaccgggtacccgtaccggttacccgtaacggtaaccctacccgggaaccccgtaacccggaaccccctaaccgtccgttacccg

SEQ ID NO: 198774 - DNA, 751 bp, Homo sapiens
  misc_feature: GYAE6OF01BLC7I.18.59.F04.1.454.CMB.1.raw
  modified_base (258)..(258): a, c, t, g, unknown or other
  misc_feature (258)..(258): n is a, c, g, or t
  modified_base (351)..(351): a, c, t, g, unknown or other
  misc_feature (351)..(351): n is a, c, g, or t
tcagtacgagtatgcacgaccggtgctcgatttagtacacacacttagggattgggggggggtctcaggaggcagcgctctcgggacgtctccaccatggcctggctctgctattcctcaccctcctcactcagggcacgagggtccgtcgggcccagtctacgccctagacctcacggtcctcgccttccgtgttccgtgggtcctccgtggaactagtcgtactccacctactccttctcgtacacgtcgaaaccngactaggtggtacgttgggttagttaacttaactagtcgttccgtcgtacgtaaccaacgacgaccaaccgacgaaccaaccgaccctaactntacgtattattatcgtacgttacgtacaacgttaccgtccgtaccgtacggttacggttactacgtcttctctcgtacgtcgtacgtacgtcgtacgaccgtacgtccgtccttaccgtactacgtacttcgtccgtacggtcctacgtacggtacgtacgggacgtacggcgtacgttagtacgtttaacgtcgtcgacctacgttaactaacgtaactacgaaccgtaacgtaacctaccgtacttacctactttaccgtaccgttacgttaccggtaccggttaaacggtacccggtaacgggttaacccgtaccggtaacccggtttacccggttaaccgtaacgggtacccgtacccggaaaccccggttaaccctaaccccgttaacccggtac

SEQ ID NO: 198775 - DNA, 820 bp, Homo sapiens
  misc_feature: GYAE6OF01AUGCZ.18.59.F04.1.454.CMB.1.raw
tcagtacgagtatgcacgaccggtgctcgatttagtacacacacttagggattgggggggggtctcaggaggcagcgctctcgggacgtctccaccatggcctgggctctgctattcctcaccctcctcactcagggcacgagggtcctgggcccagtctgccctgactcacgcctgcctcgtgtcgtcgggtctccgtggacagtcgatcaccactctctgcacgtgaaccagcagtcgtacggttgggtagttactaacgtattgtccttccgtacggtaacccaaacgtacgacctaacccggaggtaacccaaaccgtacccccctaaaagtcccgtattacggttaacttttagagtaacttcggtacctaaacgttaaccgtcccgggtcccgttacgggttaacgggtttacctaacgtccggttccttccgtcgtaccggtacccgtaccgtaacggtttccgacggtaaccgtaaaccggtccccggtaccgttccccgtacgtaacccgtccgttcggttcgggtcgggttaccctaccgggtacgggtaccggtacggaacgggggtaccggtagtaccgttacgggttaacttttaccggtaccctaggtaccgtacgtttcctaacgttaactaacctacggaaccacccgtactacggttaccctacgttcgttacttacgggtaccttccgggtaaccgggtaacggttacccggaaacggttaccccggtccgtaaaccccggttcggtacgggtacccgtaacccggtaaccccggtaacccgaaaccccgtacccgttaccg

SEQ ID NO: 198776 - DNA, 717 bp, Homo sapiens
  misc_feature: GYAE6OF01CDLBE.18.59.F04.1.454.CMB.1.raw
  modified_base (204)..(204): a, c, t, g, unknown or other
  misc_feature (204)..(204): n is a, c, g, or t
  modified_base (233)..(233): a, c, t, g, unknown or other
  misc_feature (233)..(233): n is a, c, g, or t
  modified_base (285)..(285): a, c, t, g, unknown or other
  misc_feature (285)..(285): n is a, c, g, or t
tcagtacgagtatgcacgaccggtgctcgatttagtacacacacttagggattgggggctgggggtctcaggaggcagcgctctcgggacgtctccaccatggcctgggctctgctattcctcaccctcctcactcagggcacagggtcctgggcccagtctgccctgactcagcctgcctcgtgtcgtgggtctccgtggacngtcgatcacatcctctgcactcggaaccngcaggtgtacggttggtagttaataacgtatcgtctccgtacgtaaccaacncgaccaccgaggaccaaaccgacccccaactcatgtaatttagtcgattcgactactaacgtcccggcctacggtacgggtttactactcgtcgttactcgtcggtcctacgtaagttccgtacgggaccaacccgtaccggttccccttaccgtaccgaccttaccgttccgttaccgggtccggtaccgttaccgacgggtacgtacggggaacgggtaccggtacggtacttacggttaacttttacgttacctacggcgtaaccgtccgttaagtaacttaacgtaaccgaaccgtacctaccgtaaccgtacctacttaccgtacgtacttaccgggttacccgttacgggaaggttaccgggtaacctacgggtaccctacccggttacgccggtacgacccggtacccgaaacccgtaacccccg

SEQ ID NO: 198777 - DNA, 1054 bp, Homo sapiens
  misc_feature: GYAE6OF01CPRR8.18.59.F04.1.454.CMB.1.raw
  modified_base (229)..(229): a, c, t, g, unknown or other
  misc_feature (229)..(229): n is a, c, g, or t
tcagtacgagtatgcacgaccggtgctcgatttagtacacacacttagggagttggggggggtctcaggaggcagcgctctcgggacgtctccaccatggcctggctctgctattcctcaccctcctcactcgagggcacgacgggtcctcgggccctagtctcgccctgacctcgacgcctcgccctcgtgtcgtcgggtcctaccgtggacagtcgactccaacctnttccgtcctcgacctaacgtaccgggaaaccaggtaccgtaagggttcggtaaccgggtttttgggtaacggttttaaactaaaccgttagttccggttcccgttaccgttacggtaacccaaaaccgaccggaccccaaaccccgaacgggaaacccaaaaacccccgggacccccccctaaaaacctaccgtaacgtttaacgttaacgtttaacgttacggtacgttaccggtttaaccctaaaccgtttaaccgttccccggggttacccccgtttaacgggttaaccgggggttttaacctaaaccgtttaccgttcccgtttttacccgtccggtttacggtaccccgttacccgttaaccggtttccggtaacccgggaacctaaaccccgggtacccccggtccccttaccccgtaaccgtaccccgtacggtttcccgtccggtttaccggggcccctaaccgggtacgggtaccggttaacggggtaacccggggtaacggggaacgttttaccggttagtttaaacggttttaaacccttacggttaccgtaccggttaacgtcccgtttaaataacttaaacccgttaaacgaaacccgtaacccgaaccgtccttaacccgtaccttttaccgtaacgttttacggtttcccgttaaccgggtttaaccgggaacccgggtttaaacgggtaaaccccggttaacgggtcccccccggttaaacccggttaacccgggtacccggttaaacccggaaacccccggtccccccgggaaaaacccccgtcccccgtaaaccccggtttaccccg

SEQ ID NO: 198778 - DNA, 780 bp, Homo sapiens
  misc_feature: GYAE6OF01C1ZSV.18.59.F04.1.454.CMB.1.raw
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagccacccaggccaaaacgcccccaaaatcatgtattttatgaatgtacaagtaacgtccggaccctcgtaggggtttctaaactcgactttcctctggccttaccgaaagtcgtaggaccaacgaccggcctacccctagaccatctcgtcgggctaccgaggtactcggaaggacgaggtctagtaactttacttactgacagtctaacaataactaacgaagacgacgacgaaggacctaacgttacgtaaacgggtttcccgtttaacggggaaaccgttaacgggggtaaacccctaaacgggttaccctaaacccgggttcccgttaaacggggtacccaaccgggtaaacccccccgaaacgggtaaccccccaaaaccccccgttacgttaccgttaccgtaaacccgtttccccgttaacccggttttaccccccccggacccctttaccccgtaacccttaaccgttaccgttacccggttaacgttacgggaccggggtacccggggtccttaccggggaacggttacggggacctaacccgtaaggttaacggcaacgagtacgcgtagacg

SEQ ID NO: 198779 - DNA, 708 bp, Homo sapiens
  misc_feature: GYAE6OF01A64NU.18.59.F04.1.454.CMB.1.raw
  modified_base (580)..(580): a, c, t, g, unknown or other
  misc_feature (580)..(580): n is a, c, g, or t
tcagtacgagtatgcacgaccggtgctcgatttagtacacacacttagggagttggggggggtctcaggaggcagcgctctcgggacgtctccaccatggcctggctctgctattcctcaccctcctcactcagggcacagggtcctgggcccagtctgccctgactcagcctgcctccgtgttctgggtcctaccgtggactacgtcgatccaccgtatcctctgaccaacgtgggaacccagctaaggtgtaacggttgggttacgttaataacttactcggttcctaccgtacggtaaccaacgacgcccgaaccgacggaacccaaaacccgacccccgtaaactacgtacgtacgtttaacgtttagtagtaactagtttaacctaaccgttaaccgtccggttaccccgttacggttaacggggttttacctaaccgttccgttaccgtttctcggtacgtaccgtaccgttaaggtccgtacggaccgtaacccgaccgtcccgtacgtacgaccacgtcctggtcggtcctacggcgtgacgtacggacgtcgtactagtactttataccgngtcagtctacagttacaaccgcaccgacgtactacttccacttacgttcgtcgttaaccgttaggaccgtcggaactacggtctacccgtcgtacgtactacccggtacccaccgtcccgaactcccg

SEQ ID NO: 198780 - DNA, 767 bp, Homo sapiens
  misc_feature: GYAE6OF01CU27P.18.59.F04.1.454.CMB.1.raw
  modified_base (763)..(763): a, c, t, g, unknown or other
  misc_feature (763)..(763): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcacatctcctgcactggaaccagcagtgtacgttggtaggttataactatcgtcctcctaggtaaccaacgagacccaccgaacggaccaaaccgacccccaaaactcagtagtatttatagattcgtactaactaaccgtccggtacccgttacggttacggggttttacctaacgttccgtcctttcgtcgtcggtactaccgtaagtcgtacggaccaaccggaccggtccctccgacgtaacctcgtccgtcggtcggtcctaccggaggtacgtacgggacgggacggtaaggtcgttaagttaacgtttaacgtaccgtagacgacgtactacgtaaacttacaaaccgaaccgacccgtaaccgaccgtaaccttacctttacctacgttacgttaccggttaccggttaaccgggtaaaccgggtaccgggtaaaccgtaacggtacccgttacccggtaccggtaccggtaccgaacccgacccgaacccgtacccctaaccgtctaccgtcctaccgttcccgttacccgttcccccgtaccttcccttaccgtaccgttaccgtcgtaccgcggtaccgggcggtacggtacgaccggtacgaccgtagacgtacgcgatngcag

SEQ ID NO: 198781 - DNA, 714 bp, Homo sapiens
  misc_feature: GYAE6OF01DVNUP.18.59.F04.1.454.CMB.1.raw
  modified_base (203)..(203): a, c, t, g, unknown or other
  misc_feature (203)..(203): n is a, c, g, or t
  modified_base (301)..(301): a, c, t, g, unknown or other
  misc_feature (301)..(301): n is a, c, g, or t
  modified_base (365)..(365): a, c, t, g, unknown or other
  misc_feature (365)..(365): n is a, c, g, or t
  modified_base (600)..(600): a, c, t, g, unknown or other
  misc_feature (600)..(600): n is a, c, g, or t
tcagtacgagtatgcacgaccggtgctcgatttagtacacacacttagggattgggggctgggggtctcaggaggcagcgctcgtcgggacgtctccaccatggcctgggctctgcttattcctcaccctcctcactcagggcacaggtcctgggcccagtctgccctgactcagcctgcctcgtgtctgggtctccgtgganagtcgactcaaccatcctcctgacctacgtacggaaccagcaggtcgtagggtttaggtaggttaactaacttagttgtcctcgtacggtaaccaacncggaccaacccgaggaacaaccccgacccctaaaacgtcacttagttactttagtagaacgttntacctaacttaacgtccgtacccgtttacgggtacgggtttactaacgttccgtcctttactcggtcgtccgtaactacggtccgtcgaaccaccggtacccgtcctacccgtcgaacctacttcgtacggtccggtcctacggcggtagtacgggaacggggcgtaggtacttacgtttatttacgtacgtgaccgtactcttaataaccaataccgaactcccggtaaacccnccttacgtccttactacgttacttccggtaacggtaccgtacggtaaccggtaccgtaccgggtacccttaccggtacgacgtacccggaaccccgaccccgtaaccacccccg

SEQ ID NO: 198782 - DNA, 727 bp, Homo sapiens
  misc_feature: GYAE6OF01DAXCL.18.59.F04.1.454.CMB.1.raw
  modified_base (179)..(179): a, c, t, g, unknown or other
  misc_feature (179)..(179): n is a, c, g, or t
  modified_base (196)..(196): a, c, t, g, unknown or other
  misc_feature (196)..(196): n is a, c, g, or t
  modified_base (224)..(224): a, c, t, g, unknown or other
  misc_feature (224)..(224): n is a, c, g, or t
  modified_base (231)..(231): a, c, t, g, unknown or other
  misc_feature (231)..(231): n is a, c, g, or t
  modified_base (720)..(720): a, c, t, g, unknown or other
  misc_feature (720)..(720): n is a, c, g, or t
  modified_base (724)..(724): a, c, t, g, unknown or other
  misc_feature (724)..(724): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcacatctcctgcactggaaccagcagtgacgttggtaggttataactntgtctcctggtaccaancgcaccaggacaaccgccccaaatcatntatttangtatgtcacgtacgtcggacctggtacgggttactaactcgtcttctcgtacgtcctaccgtagtcgtacggaccaacgcccggtccctaccgtacaacctacgttcgtaccggtccgggtaccttccggaacggtcgtagggaaacgggacggtaacgtcgtaagttactttacttaacgtcggacttacgtctaacgtaagtaacaacgtacgaccaccgtagtaccctacttactacttcgtaccggttaccgttaacggtaccggtaaggtaaaccgtacgtccctaccggtccgttacggtaccacccgacccgaaccgtaaccccgtaaccctagttccgtacccgtaccgttaccccgttacccgttacccccctaccgtaccccttacgtaccttacccggtaccggttaacgccggggtacccggacccggggttccgacgggtttaacccgaacgggttcccaagtaacggtcactcgntcgntac

SEQ ID NO: 198783 - DNA, 694 bp, Homo sapiens
  misc_feature: GYAE6OF01C8KAX.18.59.F04.1.454.CMB.1.raw
  modified_base (199)..(199): a, c, t, g, unknown or other
  misc_feature (199)..(199): n is a, c, g, or t
  modified_base (216)..(216): a, c, t, g, unknown or other
  misc_feature (216)..(216): n is a, c, g, or t
  modified_base (229)..(229): a, c, t, g, unknown or other
  misc_feature (229)..(229): n is a, c, g, or t
tcagtacgagtatgcacgaccggtgctcgatttagtacacacacttagggattggggggggtctcaggaggcagcgctctcgggacgtctccaccatggcctgggctctgctattccctcaccctcctcactcagggcacagggtcctgggcccagtctcgccctgactcagcctgcctcgtgtcgtggtctctggacngtcgatcaccatctccngccacgtgaaccngcgagtgtacgttgtagttatactatcgtctcctggtaaccacacgaccaccagaccaaaccgacccctaatcagtcgtattatgatacgtctactaacgccggtccctaggttacgggttactaacgtctcttctcgtgtcctcgtaagtcgtacgaccgaaccgtaccggtccctaccgtcgtaaccctcgttccgtcgtccggaccgttccgaggtaccgtacgggaggaaccggtgtaccttagttaacttacgttacgtcgacgtactacctaagtaactaacgtaaccgaccgtaaccacgtaaccgtacttaaccttccgttaacgttaccgtttccgttaacccgggttacggtaaccgggtacgggtaaccccgtttaaccggtacccgtaacccggttacccgaccggttaccaacccggtcccgtaaacccgcccccgttaacccttaacccgg

SEQ ID NO: 198784 - DNA, 855 bp, Homo sapiens
  misc_feature: GYAE6OF01BHBK5.18.59.F04.1.454.CMB.1.raw
  modified_base (202)..(202): a, c, t, g, unknown or other
  misc_feature (202)..(202): n is a, c, g, or t
  modified_base (213)..(213): a, c, t, g, unknown or other
  misc_feature (213)..(213): n is a, c, g, or t
  modified_base (232)..(232): a, c, t, g, unknown or other
  misc_feature (232)..(232): n is a, c, g, or t
  modified_base (280)..(280): a, c, t, g, unknown or other
  misc_feature (280)..(280): n is a, c, g, or t
tcagtacgagtatgcacgaccggtgctcgatttagtacacacacttagggattgggggctgggggtctcaggaggcagcgctctcgggacgtctccaccatggcctgggctctgctattcctcaccctcctcactcagggcacagggtcctgggcccagtctcgccctgactcagcctgcctcgtgtctgggtctcgtgacngtcgatcaccntcctctgcacgtcgaaccngctagtgtacgttggtagttaataactatgtcctctacggtaccaacncgaccaccgacggaccaaaccgacccccaaactcattagtaatttacgtgtaacttgtacctaacgttaacgtcccggtacccgttacggttaacggggtttactaacgttccgttcctttcttcgtccgtactaccgtaacgtcgacggtaaccaaccgtaccggtccctacccgtactaacctcgttccgttcggtcgggtaccctccgggaacggtccggttacgggaaccgggtaacggtacggttacggttaacgtttaacgtttaaccgtttaccggtacgtaccgtaaccgggttaccttaacgttaaaccttaacggaaacccgtaaacccgggtaaccctaaacccggaccggttaaccccttaccgtttaccgttaaaccgtttacccggttttaacccggggtttcccggtttaaaacccgggggttaaacccgggtttaaccccggggtaaaaccccggtttaaccggggttaaccccctttaacccgggggttttaacccgaacccgggttaaccccgaacccccgggtaaaccccggtaacccccggtaaaacccccccgg

SEQ ID NO: 198785 - DNA, 783 bp, Homo sapiens
  misc_feature: GYAE6OF01CYGRJ.18.59.F04.1.454.CMB.1.raw
  modified_base (138)..(138): a, c, t, g, unknown or other
  misc_feature (138)..(138): n is a, c, g, or t
  modified_base (196)..(196): a, c, t, g, unknown or other
  misc_feature (196)..(196): n is a, c, g, or t
  modified_base (207)..(207): a, c, t, g, unknown or other
  misc_feature (207)..(207): n is a, c, g, or t
  modified_base (213)..(213): a, c, t, g, unknown or other
  misc_feature (213)..(213): n is a, c, g, or t
  modified_base (226)..(226): a, c, t, g, unknown or other
  misc_feature (226)..(226): n is a, c, g, or t
  modified_base (255)..(255): a, c, t, g, unknown or other
  misc_feature (255)..(255): n is a, c, g, or t
tcagtacgagtatgcacgaccggtgctcgatttagtacacacacttagggagttggggggggtctcaggaggcagcgctctcgggacgtctccacatggcctggctctgctattcctcaccctctcactcagggcacngggtcctgggcccagtctgccctgactcagcctgcctcgtgtctgggtctcgtggacngtcgatccacntctccngccatcggaaccngcaggtgtacggtttggagttataacgtnttcgtctcgttacggtaccaacgtacgccaaccgaggaaccaaaccgaccccctaaatcctagttagtaatttatcggtattcgtacctaacgttaccgtccggtacccgttacggttacgggtttacctaacgttccgttcctttcgttcgtcggtacctaaccgtacgtttaccggacggtaaccgtaacccggacccgggttacccttaccccggtacgttaacccaccggtttccgtaaccggtccgggtcccttaacccggacgggttaccgaggtaacgggaccgtacggtacgttacgtactttacgttacgacggtacgtacgtaccttaatacgttaaacgaccgttaaacgcccgtaacgtaacgtaccctacggtttccctatttaaccgggttcgtttaaccggtaccggtaaaccggtaccgggtaacccgtacccggttaacgtacccccgggtttaagtacggttaccccgaacggtaccccgaaaaccccgggcccccttaacccgtaacgg

SEQ ID NO: 198786 - DNA, 750 bp, Homo sapiens
  misc_feature: GYAE6OF01BVYI7.18.59.F04.1.454.CMB.1.raw
  modified_base (218)..(218): a, c, t, g, unknown or other
  misc_feature (218)..(218): n is a, c, g, or t
tcagtacgagtatgcacgaccggtgctcgatttagtacacacacttagggattgggggctggggtctcaggaggcagcgctctcgggacgtctccaccatggcctgggcttctgctattcctcaccctcctcacgtcagggcacagggtcctgggcccagtctgccctgactcagcctgcctccgtgtctggtctcctggacagtcatcaccatctcngcactggaaccagcagtgacgttgtagttatatatgtctcctagtaccaacagcaccgacgaccaacgaccccaaatctatagtactttatagatgtacctacgtaacgtccggaccttacgtagggttttaccaacttcgtccttctacttcggtacctaccgtaacgttcgtaccgggacctaaaccgtcccggtacccttaccccgtacgaaccccgtacttacccgtccggttacggggtacccctccgggtaaacgggtccggttaacgggaaacggggtaaccggtaacgggtttccgttaaggtttaaccgttttaacgtttaacccgttcgaaccgtaccggttaccttaacgtaacttaaaccgtaaccgtaacgaaccctaacccgaacgtaccttacccgtcgttaccttagtaccggttaccggttaccggtaacggttaccgggtaaccgtaacggtacccgttaacccgttaccggtaacggtaccgaacccggtaaccccgaacggtaaaccccccg

SEQ ID NO: 198787 - DNA, 649 bp, Homo sapiens
  misc_feature: GYAE6OF01CAGS2.18.59.F04.1.454.CMB.1.raw
  modified_base (230)..(230): a, c, t, g, unknown or other
  misc_feature (230)..(230): n is a, c, g, or t
  modified_base (258)..(258): a, c, t, g, unknown or other
  misc_feature (258)..(258): n is a, c, g, or t
tcagtacgagtatgcacgaccggtgctcgatttagtacacacacttagggattggggggggtctcgaggaggcagcgctctcgggacgtctccaccatggcctgggctctgctattcctcaccctcctcactcgagggcacgacgggtcctcgggccagtctgccctgactcagtcctgcctcgtgtcgtggtctcgtggacagtcgatcacagtctctgcagtacgacngcgagtcgtacgttggtagttaatactnttcgtcttcctagtacaacacgccaccgagacaaccgacccctaaactcatacgttattacgtagtactacgtaccgtaactaacgtccgtccgtacggtacgggtttactaacgtctcgttctgtcggctacgtaacgtcgcgacaacgacgtccctccgacgtaccacgtcgtcgtcggtacgtcgacggtacgtacgacggtacgacggtactaggtaactttacgtacgtacggactacgacgtactacgtaactacgacgaccgactacgacgacctactaaccgtaggtaccgtacggtaccgacggtaaccgtaacggtcctaccggttccggttaacgaccgtaacgtacccggaacccgtaccctaaacccgtcggttaccc

SEQ ID NO: 198788 - DNA, 883 bp, Homo sapiens
  misc_feature: GYAE6OF01ATBE5.18.59.F04.1.454.CMB.1.raw
tcagtacgagtatgcacgaccggtgctcgatttagtacacacacttagggattgggggctggggtctcaggtaggcagccgctctcgggacgtctccaccatggcctgggctctgctattcctcaccctctcaactcacgggcacaggtcctgggcccagtcctgccctgactcagcctcgcctccgtgtcgtcgggtctcctggacagtacgactcaccgtattcctaccgcgactacgtacggaacctgactaggttacgtacgtttgggttaggttaaacttaaccgttagtccggttccttccggttacggtaacccaaacgtacgtacccgtaacccggacgggaacctaaaaccccggtacccccctaaaaggttacctaaacgttacggttaaacttttttaacgcggttaacttaccggttaaccctaaacgttaccgttccccgggtaaccccttggggtttaaaccggggttttactaacgtttcccgtacgtttttccgcccggttacgtacccgtaacctaccgggtactccggtaaaaccgacccggtcccgtaccgttacccgtacgtacccttaacgtcccgttacgggtccggtaccttacccggggtaaggccggttaacgggaacccggtacgggaacggttacttaccggttaatttacgtacgtacgactaccgtagttacaaacctacggtaccgaccacgtacccaaccgtactaccttaccgtacgttcgttaccggttaccgtttaacccgggaacgggtttcccggaaaacgtttaccccggggtaccctaaaccccggggtttaaccgacggttaacccgtaacccccggtaacccggaccccggtttaaaaccccc

SEQ ID NO: 198789 - DNA, 749 bp, Homo sapiens
  misc_feature: GYAE6OF01A6BEG.18.59.F04.1.454.CMB.1.raw
  modified_base (557)..(557): a, c, t, g, unknown or other
  misc_feature (557)..(557): n is a, c, g, or t
  modified_base (583)..(583): a, c, t, g, unknown or other
  misc_feature (583)..(583): n is a, c, g, or t
  modified_base (633)..(633): a, c, t, g, unknown or other
  misc_feature (633)..(633): n is a, c, g, or t
tcagtacgagtatgcacgaccggtgctcgatttagtacacacacttagggattgggggggagaggagcccagccttgggattcccaagtgttttcattcagtgatcaggactgaacacagaggactcaccatggagtttgggctgagctggtatttccttgctgtcttaattttaaaggtcgtacagtgtggaggtgctagtcgtggtggacgtcggtgggggagtgttagggtaaacgggtcccggggggtacccttaggtaccgttccccgtagtaccacggtcccgtcgtaggtacttctaccttttacgacggttaacggccgtaggtatacggaacggttccgggtaccgccgtaggccgtaccggaggggtaacggggtcgtagggtagggttcggggttacggtaccggtttaaactaaaaacccgaaaggtgtaggttagggacggaacaacgacgaaccgtacgacgtacgacctaaccggtaaggaacgctaggacttaccacgtactacacgaaagtgatagtaactaaacgaaactcgtaacctntacgtaactcgaaagactaacggtanaaccgtcgacgtaacgaacgacccgaaggaacctacgggctacggttaancttagacctacctacgaccgttaccgagtaacgcccgttactaacctacgtttacccggaaagtcccgttagtacccggttacgtaaccgggtccgggtaaaccgcgggtaccccg

SEQ ID NO: 198790 - DNA, 874 bp, Homo sapiens
  misc_feature: GYAE6OF01DYWZR.18.59.F04.1.454.CMB.1.raw
  modified_base (191)..(191): a, c, t, g, unknown or other
  misc_feature (191)..(191): n is a, c, g, or t
  modified_base (226)..(226): a, c, t, g, unknown or other
  misc_feature (226)..(226): n is a, c, g, or t
  modified_base (872)..(872): a, c, t, g, unknown or other
  misc_feature (872)..(872): n is a, c, g, or t
tcagtacgagtatgcacgaccggtgctcgatttagtacacacacttagggattgggggctttgcctgggtcctgggcccaggtctgccctgactcagcctgcctccgtgtctgggtctcctggacagtcgatcacatctcctgcactggaaccagcagtgacgttgtgttatactatgtctctgtaccaangcaccaggacaacgaccccaaatcatgtatttagntatagtaccaacgtaacgtccggacccttacggttaggggtttactaacttcgtcctttctccgtcggtaccttaccgtaacgttcgtcggactaaaccgacccggtccctcccgtacggaccctacgttccgtccggtcggtaccgttacccgggagtaccccggtaagggaacgggaccggtaacggtcgttacgttaaactttaacgtttaaccgtcgggtaacctacgtacctactaaactttaacgtaaacccgaaacggaccaacccggtaacctccttaaccctttactactttaacccgtttacgggtttaaccggttaaccgggttaaacccggggtaaacggttaaccccggttaaaacccggtacccgttaacccccggtttaaccggtttaacgggaacccccgttaccggaaacccccggtaacccgtacccccccggttaaacccgttaccgttacggttaacccctacccgtttcccgtttaacccccgggttccccttacccccttaccccggttaacctaccggtttcccgaacccggttaccggtacgggtacccgggtaccggggtaacgttaccggggaaccgccggggtaaaccggtagtaaaccggtccgacgttaggctgtcncg

SEQ ID NO: 198791 - DNA, 758 bp, Homo sapiens
  misc_feature: GYAE6OF01DRSD9.18.59.F04.1.454.CMB.1.raw
  modified_base (198)..(198): a, c, t, g, unknown or other
  misc_feature (198)..(198): n is a, c, g, or t
  modified_base (750)..(750): a, c, t, g, unknown or other
  misc_feature (750)..(750): n is a, c, g, or t
  modified_base (756)..(756): a, c, t, g, unknown or other
  misc_feature (756)..(756): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacggttggtgttataactatcgtctcctggtaaccaanacgccacccgaggaccaaaaccgccccccaaaactcagttagtattttaatgtattgtacctaacctaacgtcccggccccgttacggttacggggtttaccttaacgtcccgttcctttaccgttcgttcggtacccttacccgaaaggtttccacgggaacccaacccgaccccgggtcccccttccccgtacgaacccttacgttcccgttcgggttcggggtccccttacccggagggtaccgttaagggacggggtacccgaacgggttaccgtttaagtaaacgtttttaactaccgttagcccgtaacgtcctaactaacttaaacgtaacaaaccgtacccaaccgtacgacctacgtttctacgttacgtcgtttaccgttacgtaaccggtacggaaccgtaacggccgtaccgtccgtagccacgaccgaaccgaccccacctctcgacctcctaccgtcccgttaccccacccttccctaccgtattacccgtccgttacgcgacgggtccggtcggtacggacgacggacctgtacagngcagtngc

SEQ ID NO: 198792 - DNA, 617 bp, Homo sapiens
  misc_feature: GYAE6OF01BHHT5.18.59.F04.1.454.CMB.1.raw
  modified_base (250)..(250): a, c, t, g, unknown or other
  misc_feature (250)..(250): n is a, c, g, or t
  modified_base (271)..(271): a, c, t, g, unknown or other
  misc_feature (271)..(271): n is a, c, g, or t
  modified_base (306)..(306): a, c, t, g, unknown or other
  misc_feature (306)..(306): n is a, c, g, or t
  modified_base (422)..(422): a, c, t, g, unknown or other
  misc_feature (422)..(422): n is a, c, g, or t
  modified_base (433)..(433): a, c, t, g, unknown or other
  misc_feature (433)..(433): n is a, c, g, or t
tcagtacgagtatgcacgaccggtgctcgatttagtacacacacttagggagttggggggggtctcaggaggcagcgctctcgggacgtctccaccatggcctgggctctgctattcctcaccctcctcactcagggcacgagggtcctgggcccagtctgccctgactcagcctgcctcgtgtctgggtctccgtggacagtcgatccacatctcctgcagtggaaccagtcagtgacgttggtagtanaacgtatgtctctgtaccaangacaccgagactaaacgccccaaatcatgtattangatgtacaataatcggaccctagtagggtttactaatcgtacttctactcggacctacgtaagtcgtacggactaaccgaccgcctcctagactactcgtagtcggtccacgacgntaggaccgagngtacgtagtatttacgtatgacgtacacttactaaataacgtaacgacgtaaccaacgtaccgtacttacctacgttcttaaggttccgttacgtaaccgtaacggtaccggaaactaccggtaccgtaccgtaccggtaacgtccgaaccgtaacccggaaccgtacccctaaccccgtaacg

SEQ ID NO: 198793 - DNA, 758 bp, Homo sapiens
  misc_feature: GYAE6OF01CKDRE.18.59.F04.1.454.CMB.1.raw
  modified_base (169)..(169): a, c, t, g, unknown or other
  misc_feature (169)..(169): n is a, c, g, or t
  modified_base (183)..(183): a, c, t, g, unknown or other
  misc_feature (183)..(183): n is a, c, g, or t
  modified_base (289)..(289): a, c, t, g, unknown or other
  misc_feature (289)..(289): n is a, c, g, or t
  modified_base (345)..(345): a, c, t, g, unknown or other
  misc_feature (345)..(345): n is a, c, g, or t
tcagtacgagtatgcacgaccggtgctcgatttagtacacacacttagggattgggggggggtctcaggaggcagcgctctcgggacgtctccaccatggcctggctctgctattcctcaccctcctcactcgagggcacgagggtcctgggcccagtctgccctgacncagcctgcctcgtntcgtgggtctcgtggacagtcatcactatcctctgactacgtaggaaccagcaggtgtacggttggtagttaataacttagtcgtacctacgtaggtaacccaaanacggccaaccgaggaaccaaaaccgacccccaaaacttctaacgtagtaattttanagtaatcgtacgtaacttaacgccgtacccgttacggtacgggtttactaagtccgttactttccgtcgtacgggtacctaccgtaagtccgtaggaacctaacggtacccgtcccgttacctagaaccctaagttcccgtacggtccggtacgttaccccggtaagggtaccgtaagggacgggtaacgggaacggtttaccgtaaggtttaaccttttaaattaccggtaccgtacgaacggttctaaaccgtaaacttaacgtaaaccgaagaaccccgaacgtaaccacctaactccgttactaggttacgtacgtaaccggtaacggaacgggtaaccgtaacggttaccgaccccgttaagtacggaccaacccgaacccgaaaccgaccccgtaaaccccgtaccg

SEQ ID NO: 198794 - DNA, 746 bp, Homo sapiens
  misc_feature: GYAE6OF01EA34E.18.59.F04.1.454.CMB.1.raw
  modified_base (236)..(236): a, c, t, g, unknown or other
  misc_feature (236)..(236): n is a, c, g, or t
  modified_base (264)..(264): a, c, t, g, unknown or other
  misc_feature (264)..(264): n is a, c, g, or t
  modified_base (280)..(280): a, c, t, g, unknown or other
  misc_feature (280)..(280): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacgagggtcctgggcccagtctgccctgactcagcctgcctccgtgtcgtgggtctccgtggacagtcgatcaccatctcctgcacgtaggaaccngcaggtgtacggttggtagttataactntgtctcctgtaccaancgacaccgacggacaaaccgaccccaaatcattacgtaatttacgatatcgtactactaacgtccggtcccttaggtacgggttttactaacgttccgtacttctacgtcggtcctacgtacgttacgtcgaccgaacgtcccggtaccctcccgtaactacccgtacttcccgttaccggtccgggtcctaacccgggtacggtcgtagggaacgggtaccggagtaccgttaacttaacgtttacgtaccgtacgacctactaccttactaaagtacgttaaacccggaactaccccaacgtacctacccgttaccttaaccgttacctttaacggttacccgtttaccggttaaccgggtaaacgggtttacccggaaacccggttaaaccgtaccccggttaaccccgtaacgggttaccgtaacccggaccccggaaacccgtaccccggtaaaacccccg

SEQ ID NO: 198795 - DNA, 707 bp, Homo sapiens
  misc_feature: GYAE6OF01DH7WA.18.59.F04.1.454.CMB.1.raw
  modified_base (206)..(206): a, c, t, g, unknown or other
  misc_feature (206)..(206): n is a, c, g, or t
  modified_base (217)..(217): a, c, t, g, unknown or other
  misc_feature (217)..(217): n is a, c, g, or t
  modified_base (237)..(237): a, c, t, g, unknown or other
  misc_feature (237)..(237): n is a, c, g, or t
  modified_base (258)..(258): a, c, t, g, unknown or other
  misc_feature (258)..(258): n is a, c, g, or t
  modified_base (263)..(263): a, c, t, g, unknown or other
  misc_feature (263)..(263): n is a, c, g, or t
  modified_base (389)..(389): a, c, t, g, unknown or other
  misc_feature (389)..(389): n is a, c, g, or t
tcagtacgagtatgcacgaccggtgctcgatttagtacacacacttagggagttgggggggggtctcaggaggcagcgctcgtcgggactcctccaccatggcctgggctctgctattccctcaccctctcactcagggcacgagggtcctgggcccagtctcgccctgactcacgctcgtcctccgtgtcgtggtctcgtggacngtcgatccacntctctgctgtacgaccagtnagtcgtacggttggtagttanaactntcgtcttaccacggtaaccagacgacctaccgacggacctaaaccgaacccctaactcgaatttgtaatttagtgtaacttcgacctaacgttaccgtcccggtacccgtaggttaaccgggtttnacgtcgtccttctcgtgtacctaccgtaaggttccgtaccgaccgttaaccgcccgtcccttccgtacttaaccctgtttccggttaccgtcggtacccgtaccgtcggtacggtaagggaccggtacggtaaccgtcggttattaacgtttacctactccgtccaagttaccgtctaagaacctaacaccgtaacctacctacttaccgtaccttacttacgttagttcggttcccgtaaggtacgtcggaacccgttacgacccgttaccgtcgtaccggtaccgaaccgtcccgaaaccggtccccgacccgtac

SEQ ID NO: 198796 - DNA, 633 bp, Homo sapiens
  misc_feature: GYAE6OF01DESHS.18.59.F04.1.454.CMB.1.raw
  modified_base (129)..(129): a, c, t, g, unknown or other
  misc_feature (129)..(129): n is a, c, g, or t
  modified_base (166)..(166): a, c, t, g, unknown or other
  misc_feature (166)..(166): n is a, c, g, or t
  modified_base (385)..(385): a, c, t, g, unknown or other
  misc_feature (385)..(385): n is a, c, g, or t
  modified_base (392)..(392): a, c, t, g, unknown or other
  misc_feature (392)..(392): n is a, c, g, or t
  modified_base (408)..(408): a, c, t, g, unknown or other
  misc_feature (408)..(408): n is a, c, g, or t
  modified_base (413)..(413): a, c, t, g, unknown or other
  misc_feature (413)..(413): n is a, c, g, or t
  modified_base (421)..(421): a, c, t, g, unknown or other
  misc_feature (421)..(421): n is a, c, g, or t
  modified_base (471)..(471): a, c, t, g, unknown or other
  misc_feature (471)..(471): n is a, c, g, or t
  modified_base (512)..(512): a, c, t, g, unknown or other
  misc_feature (512)..(512): n is a, c, g, or t
  modified_base (522)..(522): a, c, t, g, unknown or other
  misc_feature (522)..(522): n is a, c, g, or t
  modified_base (528)..(528): a, c, t, g, unknown or other
  misc_feature (528)..(528): n is a, c, g, or t
  modified_base (533)..(533): a, c, t, g, unknown or other
  misc_feature (533)..(533): n is a, c, g, or t
  modified_base (627)..(627): a, c, t, g, unknown or other
  misc_feature (627)..(627): n is a, c, g, or t
  modified_base (629)..(629): a, c, t, g, unknown or other
  misc_feature (629)..(629): n is a, c, g, or t
  modified_base (631)..(633): a, c, t, g, unknown or other
  misc_feature (631)..(633): n is a, c, g, or t
tcagtacgagtatgcacgaccggtgctcgatttagtacacacacttagggagttgggggctttgcctgggtcctgggcccagtctgccctgactcagcctgcctcgtgtctgggtctcctggacagcgntacaccactctccgtgacacgtacgaaccagcgaagnggtacggttggttaggttaataattatgtctcctaggtaaccaacacgccaccacggacaaaccgacccctaaacacatagttaattcgtagtagtctacctaagtaaccgtccggtaccgtacggtacgggtttaacaacgttccgtcttctcgtacgtacctacgtaacgtcgacggacaccgaccgttccaccgtacactcgtctcgcggctacgngtcaggngacgtagctagtactntacgngaaccgtntaactacgtataacgactacaacgtcctagactctactagtcgttaacgngtaacgtcgaaacggctacgcccgttagaggtccacgaccnccgtaacccncgtacngtacncccgttcgtacccttcccgacccttcctacgtaccttacgtaaccgtacgtcgacgggtcggacgggtaccacgtaacgggacacgcgacgtanancnnn

SEQ ID NO: 198797 - DNA, 765 bp, Homo sapiens
  misc_feature: GYAE6OF01BOMV2.18.59.F04.1.454.CMB.1.raw
  modified_base (412)..(412): a, c, t, g, unknown or other
  misc_feature (412)..(412): n is a, c, g, or t
  modified_base (625)..(625): a, c, t, g, unknown or other
  misc_feature (625)..(625): n is a, c, g, or t
  modified_base (642)..(642): a, c, t, g, unknown or other
  misc_feature (642)..(642): n is a, c, g, or t
  modified_base (659)..(659): a, c, t, g, unknown or other
  misc_feature (659)..(659): n is a, c, g, or t
  modified_base (715)..(715): a, c, t, g, unknown or other
  misc_feature (715)..(715): n is a, c, g, or t
tcagtacgagtatgcacgaccggtgctcgatttagtacacacacttagggattggggggggtctcagggaggcagcgctctcgggacgtctccaccatggcctgggctctgctattcctccaccctcctcactcagggcacgacgggtcctcgggcccaggtcctgcccttgactcacgcctcgccttccgtgtccgtcgggtctccgtaggacagttcgactccacctacttcctccgtcgactacgtacgaaccgagtaccgtaggttcggtacggttttagggttacggttttaactaaacgttcgttcggttccgttacccgttacggtaaccaaccggtacgacccgaacccgaacggaaccaaaacccggaccccctaaaactccggtaattcggttaacttttanaggtacctttagtaaccgtactaaacggttcccggtaccttacgggttacgggttttaacctcttccggttcctttctaaccgtgtacccgtacgtaagtccgtcgaacctaccgtcccggtacccttaccgtcggacctcgttcaacgggttcgaccctacgagtccgtaggacgtcgacggtcttaggtactttgtacgtcaacggttacnccgtatacgacgtaacncgaaccgtcgacttacnctttacgtacgtctaccgtttcgaaccggtaaccggtccgacggttaacggtcccncccgtacggttccgaccctaacggacccttaccccggaccctaacgtccg

SEQ ID NO: 198798 - DNA, 787 bp, Homo sapiens
  misc_feature: GYAE6OF01B94KW.18.59.F04.1.454.CMB.1.raw
  modified_base (260)..(260): a, c, t, g, unknown or other
  misc_feature (260)..(260): n is a, c, g, or t
  modified_base (293)..(293): a, c, t, g, unknown or other
  misc_feature (293)..(293): n is a, c, g, or t
tcagtacgagtatgcacgaccggtgctcgatttagtacacacacttagggagttggggggggtctcaggaggcagcgctcgtcgggacgtctccaccatggcctgggctctgctattcctcaccctcctcactcgagggcacgacgggtcctcgggccctagttcctcgcccttagacctcgacgtcctgcccttccgtgtccgtgggtcctccgtggactaggtcgactccaccatcctctacgaccagtacggaaccngcgtaagtcgtaggttggtacgttactaacgtntcgtcgtccgtacgaacctaacgacgaccaaccgaacgacaaacccgaacccctaatactactagtatttagacgtactacgtaccaacgtaaccgtccggtaccgtacggtttaacggttactaaccggttcactttccgtggtaccgtacgttaccgtaacgtttccgaacggaactaacccggtacccgtaccccgtctaaaccgtaccttaccgttacggttacccggacggttaccctaccgggaacggtaccgtaggggtaaaccggtacggtaacgtttcgttaacgttaacgttttaacgttaccgacgttacggtacccttaataaccctaaagtaacctaaaacggtacccaccgtaaccgtacgtaacccttacgtaccgtttaacgtcgttaccgttccgggtaaacgtaccggtacggtaacccggtgtacccgtaccgtacggactacccggactaacccgaaccctaccgtacgtaccg

SEQ ID NO: 198799 - DNA, 651 bp, Homo sapiens
  misc_feature: GYAE6OF01CU9GI.18.59.F04.1.454.CMB.1.raw
  modified_base (260)..(260): a, c, t, g, unknown or other
  misc_feature (260)..(260): n is a, c, g, or t
  modified_base (266)..(266): a, c, t, g, unknown or other
  misc_feature (266)..(266): n is a, c, g, or t
  modified_base (274)..(274): a, c, t, g, unknown or other
  misc_feature (274)..(274): n is a, c, g, or t
  modified_base (284)..(284): a, c, t, g, unknown or other
  misc_feature (284)..(284): n is a, c, g, or t
  modified_base (308)..(308): a, c, t, g, unknown or other
  misc_feature (308)..(308): n is a, c, g, or t
  modified_base (320)..(320): a, c, t, g, unknown or other
  misc_feature (320)..(320): n is a, c, g, or t
  modified_base (445)..(445): a, c, t, g, unknown or other
  misc_feature (445)..(445): n is a, c, g, or t
  modified_base (463)..(463): a, c, t, g, unknown or other
  misc_feature (463)..(463): n is a, c, g, or t
tcagtacgagtatgcacgaccggtgctcgatttagtacacacacttagggagttggggggggtctcaggaggcagcgctctcgggacgtctccaccatggcctggctctgctattcctcaccctcctcactcagggcacgaggtcctgggcccagtctgccctgactcagcctgccctcgtgtctggtcctcgtgacagtcgatccacctatcctccgtgctaccgacggaaccaggcaggttgtacgttggtaggttanaacgtntgtactcnggtacaacgngccaccagaccaacgcccctaaancatcgtattagngtattcgactaactactccggaccctacggttagggttactaacgtcgtccttacgtctcggtccacgagtcgtcggaccaacgaccgccctaccctagacctacttcgtcgtcggctccgacgngtacgacggaacggtcgntagtactttagtacgtcgacgtacgtactactaacgtaacgtaacaccggaaccctaacgaccggtactacctaccttacgttacgtacgtaccgttacggtaaccgtcgggtaaaccctaccggtaccgttacccgtacgttacggaccctaccggacccttaaccggacccctaaccgtaacccgg

SEQ ID NO: 198800 - DNA, 683 bp, Homo sapiens
  misc_feature: GYAE6OF01B3AZD.18.59.F04.1.454.CMB.1.raw
  modified_base (187)..(187): a, c, t, g, unknown or other
  misc_feature (187)..(187): n is a, c, g, or t
  modified_base (201)..(201): a, c, t, g, unknown or other
  misc_feature (201)..(201): n is a, c, g, or t
  modified_base (240)..(240): a, c, t, g, unknown or other
  misc_feature (240)..(240): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcgagggcacgagggtcctgggcccagtctcgccctgactcagcctcgcctccggtntcgtggtcctccgnggacagtcgactcacctatcctcgtgcacgtaggaaccngcacgtggtacgttggtacgttataacgttgtcgtcgtaccgtacgtaaccaacgaccgaccgaaccgacgaaccaaacccgaccccaaatctaagttagtaacgtttatacgtagtacgtactaaacgttaccgtccggtaccgtacggttaacggtttactacgtccgtccttcgtcgtcgtacctacgtagtcgtacgaccgtaaccgcccgtccctacgtactaccgtacgtccgtcgtcggcccgtacggcgtacggacggtaacgaggtacggtacttagtttaacgttacgtacgtacgcgtacgtactacgtaacgtaactacgaactacctacgtactctcctactacgtacgttacgtccgtaacgacggtaacgtaccgtacgtacccgtacgtaccgacgtaccaaccgtaacccgacgtaccccacgtac

SEQ ID NO: 198801 - DNA, 761 bp, Homo sapiens
  misc_feature: GYAE6OF01CQBF0.18.59.F04.1.454.CMB.1.raw
  modified_base (260)..(260): a, c, t, g, unknown or other
  misc_feature (260)..(260): n is a, c, g, or t
  modified_base (738)..(738): a, c, t, g, unknown or other
  misc_feature (738)..(738): n is a, c, g, or t
  modified_base (751)..(751): a, c, t, g, unknown or other
  misc_feature (751)..(751): n is a, c, g, or t
  modified_base (757)..(757): a, c, t, g, unknown or other
  misc_feature (757)..(757): n is a, c, g, or t
tcagtacgagtatgcacgaccggtgctcgatttagtacacacacttagggattgggggcctttgcctgggtcctgggcccagtctgccctgactcgagcctgcctccgtgtctgggtctcctggacagtcgatcacatctcctagcacgtggaaccagcgtagtacgacgttggtaggttataactatcgtctccgtggtaaccaacgacgaccacccgaggtaccaaaccgccccctaaaatctagttagtattttaancgtaattcgtacgtaacttaaccgtccggtacccgtaggttacgggtttactaacgttccggtacttccgttacgtcggtaccgttacctaaggttcgtacgggtaaccaaaccggtccccggtcccttacccgtacgacctacgttaccgttcggaaccgggtctaacccgtaggtaccgtacgggtaaacggtcggtaacgggtacttaacggttactttaacgttccgtacgaacgtacggtactaacgttaactaactaaaccgactaccgaaccgttacgtacctaaccgttcgtaacgttaccgttacggttaccgttacggaacggttaaccgtaaccggtaacgtaccgtaccgttacgacggtacgaaccggaccgtaaccggaccctaccgtacgtacgtcgtaacctcggtaccctcctaccgtcacgtactccgtagtcgcggtacgtcgtagcgaacgtcaacgnttaacggctacgnttacgncgta

SEQ ID NO: 198802 - DNA, 912 bp, Homo sapiens
  misc_feature: GYAE6OF01EIW1U.18.59.F04.1.454.CMB.1.raw
  modified_base (244)..(244): a, c, t, g, unknown or other
  misc_feature (244)..(244): n is a, c, g, or t
  modified_base (250)..(250): a, c, t, g, unknown or other
  misc_feature (250)..(250): n is a, c, g, or t
tcagtacgagtatgcacgaccggtgctcgatttagtacacacacttagggaggttgggggctggggtctcaggaggcagcgctctcgggactctccaccatgcctgggctctgctattcctcaccctctcactcgagggcacgacgggtcctgggcccaggtctcgcccctgaccttcgagtccgtcgtccgttccgttgttacgtggggtccttaccggtggactcggtacgactccgaaccngttccncctggcctacgtacggaaaccctgacgaggttggtacgggtttggttacgttaacttaacttagtccgttaccttaccggtacggtaaacccaacacggtacccaaaccccgtacggtaaccaaacccgttacccccctaaaaagttcctaacgttacggtttaactttagtacggtacttacgtaccgtaagtttaaccgtccccgggtacctttacggttacggggttttacctacggttccttacgtttcctaacggtcgtaaccgtttaccaacgggttccgtaacggtacccgtaaacccggttcccggtacccgttacctaaccgtaccgttacggttaacccgttaccgggttaccgggtacccgttaccggacgggtaccggttaacggaaccggggtaaacggtcggtttacgtttaacggtttaaccttttaacgttaaccggtccgtttaacgggtacctaccctaaagttaaacgtaaccggtaaccgtaccgtaaccgtaaccgttcgttaacccctacggtttccttaaccggttttacgtacgttttaccccgggaagttaaacccgggttggaaaaccccgttgggttaacccccgttacggtacccacgggttaaccacccggtacccgtaaaccccggtacccc

SEQ ID NO: 198803 - DNA, 908 bp, Homo sapiens
  misc_feature: GYAE6OF01EGU3L.18.59.F04.1.454.CMB.1.raw
  modified_base (645)..(645): a, c, t, g, unknown or other
  misc_feature (645)..(645): n is a, c, g, or t
tcagtacgagtatgcacgaccggtgctcgatttagtacacacacttagggagttgggggggggtctcaggaggcagcgctcgtcgggacgtctccaccagtcggccgtgggctctgcttacttccctccaccctcctcacctcgagggcacgacgggtccgtcgggacccagtctacgccctgactcacgctcgcccttcgtgtcgtcggtcctccgtaggacacgtcgactaccacctacttcctccgtagcctaacgtacggaacctagtacgtaggtacggttacggtttgggttacggttaaacttacgttacgttccggtaccttaccgttaacgggtaaacccaacggaccgtaacccgaacccggtaaacggaaacccccgtaaaaacccccgtacccccctaaaagtttcgtaaacgtttacggtttaaattttaacgacggttaacggtttaaccggtaccctaacggttaacccgggttccccgtaaccgtttacggggttaacggtttaacctacgttccgtttaccgtcccgttaggtacccgtacccgttaacgttacggtcccggttacgaacccaccggttacccggtcccctaacctcgtactacgtccgttccggacgtcctacgggngtacggacgttacggggaccttaacgatttacggttaatttaccggcctaggtaccgttaaccgaactttacgtaaaacctttacgggaaaccctaacgggtacccctactaccggtaccttaacgggttctttaacggggacctttcgggtaaccggtaacgggtaacccggttccggaaacgttaaccgtccccggtaaccggttacgttacgaaaccccccgaggtttaaacccccccggactcccgttcctaaaccccg

SEQ ID NO: 198804 - DNA, 630 bp, Homo sapiens
  misc_feature: GYAE6OF01B1888.18.59.F04.1.454.CMB.1.raw
  modified_base (235)..(235): a, c, t, g, unknown or other
  misc_feature (235)..(235): n is a, c, g, or t
  modified_base (329)..(329): a, c, t, g, unknown or other
  misc_feature (329)..(329): n is a, c, g, or t
tcagtacgagtatgcacgaccggtgctcgatttagtacacacacttagggagttgggggggggtctcaggaggcagcgctcgtcgggacgtctccaccatggcctgggctctgctattcctcaccctctcactcagggcacagggtcctgggcccagtctgcctgactcagcctgcctccgtgtcgtgggtctcgtggacagtcgatccacctatctcctgccacgtcggaaccngcaggtgacgttggtagttataacgtgttcgtctcgtaggtaaccaacgacgccaccgaggaccaaaccgacccccaaactcagtagtatttanagtagtgtactacgtacgtccgccgttcgtacgggttactaacgtcgtcttacgtcgtcgtcctactattcgtgacaacgtccgtccctccgtacgtacctatcgtcgtcggtcctcgaggtcagggtaacggacgagtacgtagtacgtttacgtactacggtacacgtactatacgtactaacgacgaccgacacgtacctacttctgtacgttacgtcggtaaccggacggtcggaaccgtacggtacccgtaccgtaccgtacggtaccgaccgtaccgaccgtacccgaaccgtcg

SEQ ID NO: 198805 - DNA, 752 bp, Homo sapiens
  misc_feature: GYAE6OF01DBJOZ.18.59.F04.1.454.CMB.1.raw
  modified_base (233)..(233): a, c, t, g, unknown or other
  misc_feature (233)..(233): n is a, c, g, or t
  modified_base (238)..(238): a, c, t, g, unknown or other
  misc_feature (238)..(238): n is a, c, g, or t
  modified_base (276)..(276): a, c, t, g, unknown or other
  misc_feature (276)..(276): n is a, c, g, or t
  modified_base (292)..(292): a, c, t, g, unknown or other
  misc_feature (292)..(292): n is a, c, g, or t
  modified_base (333)..(333): a, c, t, g, unknown or other
  misc_feature (333)..(333): n is a, c, g, or t
tcagtacgagtatgcacgaccggtgctcgatttagtacacacacttagggattgggggggggtctcaggaggcagcgctctcgggacgtctccaccatggcctgggctctgcttattccctccacccttcctcactcagggcacgagggtcctgggcccagtctcgccctgactcacgcctcgccctcggtgtcgtgggtccttccgtggaccaggtcatccaccattcctcngaccncgtacggaccagcagtgtacggttggtagttataactntcgtctctgtaccaancacaccgagactaaccgaccccaatcatactattgagtctntacctacttactccggtacccttaggttacgggttactaacgttcgttaccttcgtcgtaccgtacctaccgttagtaccggttccgacgtaaaccccgtcccggtaccctcccgggtactacccgaacgtttcccggtacggttccgggtacccgttaaccgggtacgggtaccgtaaggggtaaccgggtaacgggtaacggcccgttttaaggttaaaccgttttacggttaaccggtcgttaaccggtaaacgtcttaacctaacgtaaaccgttacaaaccgttacccgaactacggtactaacccgtttcgtactttacgtaccggtaccgttaccgggtaacgtaccgggtaaccgacggttacccgacgtaccgtagtacccgacgtacccacccgaccctccgtaacccg

SEQ ID NO: 198806 - DNA, 807 bp, Homo sapiens
  misc_feature: GYAE6OF01EEFOM.18.59.F04.1.454.CMB.1.raw
  modified_base (206)..(206): a, c, t, g, unknown or other
  misc_feature (206)..(206): n is a, c, g, or t
  modified_base (211)..(211): a, c, t, g, unknown or other
  misc_feature (211)..(211): n is a, c, g, or t
  modified_base (255)..(255): a, c, t, g, unknown or other
  misc_feature (255)..(255): n is a, c, g, or t
  modified_base (259)..(259): a, c, t, g, unknown or other
  misc_feature (259)..(259): n is a, c, g, or t
  modified_base (433)..(433): a, c, t, g, unknown or other
  misc_feature (433)..(433): n is a, c, g, or t
tcagtacgagtatgcacgaccggtgctcgatttagtacacacacttagggattgggggggggtctcaggaggcagcgctctcgggacgtctccaccatggcctgggctctgctattccctcacccctcctcactcagggcacgagggtccgtcgggcccagtctcgccctgactcagcctgcctccgtgtcgtggtctcgtggacngtcgntcaccatcctctgcactggacagcagtgtacggttggtgttaanactntcgtctccgtacgtaccaacgcgtaccaccgacggaccaaaacccgacccccctaaacttcgaagttcgttaattttagtaggtacttacgtacctaacgttacggtcccggtaccccgtggtttaccggtttactaacgttccgtctttctcgtcggtcctacgaacggttcnccggacaccggccgtccctccgtacggacctacgttccgttacggccggttacccgcggtaacggtcgttaaaggggccgggtaaacggtccggttaaggtttaacgttaaggttttaaccgtttacccgtaggaccgtacgttaacctaaccgttaattaaaccctaacggaacccgtaaccgaaccgttacgtaccccttaacccttccgttaaccgttacggtttacccggtttaaccgggttaacccgggttaaaacccggggtccgggttaaacccggtaaacgggttaccccgttaccccggttaccggaaccgggtaccccgaacggttaaccccccgaaccggtaaccccccacccggttaacccg

SEQ ID NO: 198807 - DNA, 593 bp, Homo sapiens
  misc_feature: GYAE6OF01EPSKC.18.59.F04.1.454.CMB.1.raw
  modified_base (330)..(330): a, c, t, g, unknown or other
  misc_feature (330)..(330): n is a, c, g, or t
  modified_base (364)..(364): a, c, t, g, unknown or other
  misc_feature (364)..(364): n is a, c, g, or t
  modified_base (466)..(466): a, c, t, g, unknown or other
  misc_feature (466)..(466): n is a, c, g, or t
  modified_base (501)..(501): a, c, t, g, unknown or other
  misc_feature (501)..(501): n is a, c, g, or t
tcagtacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtggggaggcttgggtaaagccgggggggtcccttagactcccctgtacagcctctggattcactttcagtaaggcctggatgaactgggtccgccaggctccgagggaggggctgggngtgggttggaccgtaataaaaccaaaatgatggnggacaacagaactacgctggcacccgtgaaaggcaagattccaccatctacaagagagtagattaacaaaaacgcaacgctgtatcgtagacaaatgaaacngacctagaacgaaccgaaggaccacgacgccgtanacttactactacacctacgtaccctaccgaagtaacgactacctaaccttaacctacgtaacgtacgtagtaccgtccgtcgggtaaccggg

SEQ ID NO: 198808 - DNA, 826 bp, Homo sapiens
  misc_feature: GYAE6OF01AJTUH.18.59.F04.1.454.CMB.1.raw
  modified_base (196)..(196): a, c, t, g, unknown or other
  misc_feature (196)..(196): n is a, c, g, or t
  modified_base (229)..(229): a, c, t, g, unknown or other
  misc_feature (229)..(229): n is a, c, g, or t
  modified_base (304)..(304): a, c, t, g, unknown or other
  misc_feature (304)..(304): n is a, c, g, or t
  modified_base (820)..(820): a, c, t, g, unknown or other
  misc_feature (820)..(820): n is a, c, g, or t
tcagtacgagtatgcacgaccggtgctcgatttagtacacacacttagggattgggggctttgcctgggtcctgggcccagtctgccctgactcaacctgcctccgtgtctgggtctcctggacagtcgatcaccatctcctgcactggaaccagcagtgacgttggtggttataactatgtctcctggtaccaanagcacccaggcaaagccccaaatcatgatttangatgtcagtaatcggccctgtaggggtttctaagtcgtcttctctggctccaagtctggacacgacggccttccngaccatctcgtagggcctaccgagggtctggaacgggacgacggcctttaggtaacttttaagtacccgttggtaccaggtacccttactaaacgtttaacttaaccgaaacggaccaaggtacccgtaagtaccctaacgttaccggttaaacgtttacccggttaacggggtaaaccgttacggggaaaccccgttaaacggggtacccttaaccccgggttacccgttaaacgggttcccgaaacccggtaacccggtaaacccgggtaaccccctaaacccccgtaaccgtttaccggtaccctaaccccgttttaccgttacccccggtttaaccccccggtccccgttacccccctttaaacccgtacccgttttaaaccctcccgggtttaaaccgtaaccgggtacccggggtaccgggggttaacccgttacgggggaaccgttaacccgggggtaccctaacccggtaacggtttaaacccgggctacccgtaagacgccggtacncgtacg

SEQ ID NO: 198809 - DNA, 693 bp, Homo sapiens
  misc_feature: GYAE6OF01DJYV4.18.59.F04.1.454.CMB.1.raw
  modified_base (251)..(251): a, c, t, g, unknown or other
  misc_feature (251)..(251): n is a, c, g, or t
  modified_base (285)..(285): a, c, t, g, unknown or other
  misc_feature (285)..(285): n is a, c, g, or t
  modified_base (307)..(307): a, c, t, g, unknown or other
  misc_feature (307)..(307): n is a, c, g, or t
  modified_base (537)..(537): a, c, t, g, unknown or other
  misc_feature (537)..(537): n is a, c, g, or t
  modified_base (547)..(547): a, c, t, g, unknown or other
  misc_feature (547)..(547): n is a, c, g, or t
tcagtacgagtatgcacgaccggtgctcgatttagtacacacacttagggattgggggggggtctcaggaggcagcgctctcgggacgtctccaccatggcctgggctctgctattcctccacccctcctcactcgagggcacgagggtcctgggccccagtctcgccctgacctcacgcctcgccctcgtgtcgtgggtcctccgtggacagtcgactccacctactcctcctgcctacgtacggaaccngacgtaggtcggtacggtttggtagttataactntcgtctacgtcggtaaccaacncgacccaccgaggaccaaaccgcccccaaaatcgattagtatttagagtatcgtactaacctacgtcccggtaccgtgtacgggtttacctacgtccgtcttccgtcgtcggacctaccgtacgtcgtcggacctaaccggccgtccctaccgactaacctcgttccgccggttccgccgtcggacggcgtacggacggacggtacgtcgttaagttactttacgtaccngtactacgtnaacgtaatacgtaccacaccgtacgactcgtaccttacgtcgttaccgttcggtaccgtacgggtaaccggtacggtaacccgtaccggttcccgaaccggttcaacggtcccaaccggaacccgtaacccgaccctaacccgtcg

SEQ ID NO: 198810 - DNA, 674 bp, Homo sapiens
  misc_feature: GYAE6OF01AR7KN.18.59.F04.1.454.CMB.1.raw
  modified_base (198)..(198): a, c, t, g, unknown or other
  misc_feature (198)..(198): n is a, c, g, or t
  modified_base (203)..(203): a, c, t, g, unknown or other
  misc_feature (203)..(203): n is a, c, g, or t
  modified_base (209)..(209): a, c, t, g, unknown or other
  misc_feature (209)..(209): n is a, c, g, or t
  modified_base (215)..(215): a, c, t, g, unknown or other
  misc_feature (215)..(215): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctcgccctgactcagcctgcctcgtgtctgggtctctggacngtcgntcactntctccngcacgtaggaaccgcagtgacgtttggtagttatactatcgttctccgtacgtaccaacgacgaccacccgaggaaccaaaccggtacccccaaacgtactagttacgttaatttcgagtactcggtacctacgtaacgttccggtcccttacggttacgggtttaccttaacgtccgttccgtttactcggtacggtacctcgtaacgttcacggtaccacgtacccgtacctccctacgtacctactccgtcgtccggtacctacggacgtcgtacggaccggtggtacgacgttacttaacgttaccgttctaccggaccgttataccgtactcgtaacgtgaaggcgtcgtaaggttcgttagttacgtcgttgttccgtagtcgtacgggtccgtacgtcggtaccctacccgtagttaccgtacgaccggtaaccctcccgtaacctccctcg

SEQ ID NO: 198811 - DNA, 865 bp, Homo sapiens
  misc_feature: GYAE6OF01AL6L9.18.59.F04.1.454.CMB.1.raw
tcagtacgagtatgcacgaccggtgctcgatttagtacacacacttagggattgggggggggtctcaggaggcagcgctctcggggacgtctccaccatggcctgggctctgctattcctcacccctcctcactcagggcacgagggtcctgggcccagtctcgccctgactcagcctgcctccgtgtcgtgggtctccgtggactgtcgatcaccgattcctcctgcacgtacggaaccagcgaggtacggtacgttgggttacgttaataacgttagtcgttcctaccgtacggtaccaacgacgtccaccgacgaccaaccgaccccaaatctatagttacttagtcgtacgtacgtactaacgtaaccgtcccgggtaccgttacggttacgggtttactacgttccgttaccgttcgttaccggtcgtaccctaccggttaacgtaccggtacggtaacccgtaacccggtaccccggtccccgttacccgtaccgtaacccgttccgttaccgttccgggtaccggttacccgtacccgggtaggtttacccgggtaacgggtaacggggtaccgggttaacgttccggttaaacggtttaccgtttaaaccggttacccggtacgtaccgttacccgtacgttaaacgttaccgaaaccggtaacctacggaacccgtaaccgttaccggtaactttcccggttaccgttaccttgggtttaaaccgtacccgggttaaccgttaacccgggtaaccggttaccgggttaacccgttacccgttaaccggttcccgtaaccggggtaaccgtcccccggaaaaaccctccccggtaaacccccgtaacgttaccccgg

SEQ ID NO: 198812 - DNA, 871 bp, Homo sapiens
  misc_feature: GYAE6OF01D0A2A.18.59.F04.1.454.CMB.1.raw
  modified_base (188)..(188): a, c, t, g, unknown or other
  misc_feature (188)..(188): n is a, c, g, or t
  modified_base (862)..(862): a, c, t, g, unknown or other
  misc_feature (862)..(862): n is a, c, g, or t
tcagtacgagtatgcacgaccggtgctcgatttagtacacacacttagggattggggtctgggagaggagccccagccgttgggattcccgaagtgttttcattcagtgatcaggactgaacacagagactcaccagtggagtttgggctgagctggattttcctgctgtcttaagttttaaaaggtntaccagttggtgaggtgacagtcgtgggtaggtacggtcggtgggggacggtcgtttaggggtaaaacggggccccgggggggttcctaggtacgtaccgttaccgttccgtgttaccgagttcttacggtacggtactttacccgtaacccgtttcgttaccccttacgttttttacgacccgtaacggttcgggttccccggtcgggggttaccccggccccggggtaccttaccccggggaagggggaaaccggggttcccgttacgggggtaaggtttccggggtaacccttcccggaaacgttttacgaccgtacggttacggaacctacggttaggttaaaggtcggacgttaacgacggacgtaaaggttcggtacgacgtaaacggggccctttacggggacggggtaggggtacccgttacaaccgtaggttacgaaccgtaaggaacgtaccgtaaacttaccgtaaacgaaacccggtacgttacgttaataaccgtaataaacgtacggtaacacggtaccgtagaaggtaacgggaccgaaacgggtccgaaaccgggttccctagtttagtttccgtcggttagtcgggaaacgtaggtaacccttaaagggtaaccctttccggttaaatcgtttagttacctaggctttaagtcgggngggtaaacg

SEQ ID NO: 198813 - DNA, 845 bp, Homo sapiens
  misc_feature: GYAE6OF01CF4Z7.18.59.F04.1.454.CMB.1.raw
  modified_base (541)..(541): a, c, t, g, unknown or other
  misc_feature (541)..(541): n is a, c, g, or t
  modified_base (620)..(620): a, c, t, g, unknown or other
  misc_feature (620)..(620): n is a, c, g, or t
tcagtacgagtatgcacgaccggtgctcgatttagtacacacacttagggattggggtctgggagaggagccccagccttgggattcccaagtgttttcattcagtgatcaggactgaacacagaggactcaccatggagtttgggctgagctggtattttccttggctgtacttattttaaaaggtgtccagtgtagaggtgcagcgtggtgggtagtcggtgggggtacggtcggttaaggggtaaaacggggtccccggggggggttcccttaaggtacccgttcccccgttaggtaccacgtcccgttacgtggtacttcctacgtttacgaaggtaacggccgtaggactacggtaaccgttccggggtccgaccgaggtccgtaccgggaagggggtacgggcgttgggacggttggggttacggtaaccgtttaaacgttaaaaacccgaaaagttggtaacggtacgggtaagggaaaccaacgtaacgtaacgtaccggccttacggaccctaaccgggtaaggaaacgggntaacggtactacccaacctagtacctaacgaagtacgtaagtacgtaaacgttaaacgaaaacgtcgtaaacccggttnttaaacggttacctacgttaacgaacgtaaaacgttaccgaaaccttacggtaacccgtaacgggaaaccggtaaacccggaaacggtaccgaaccggttacgaccgtttatacccttaccgacgtacccgtacacccgtacccgtaacggtacgtaccgaacttaactaacccgttactaacgttacgtacgtaccgtaccggtcgggaccgggtaaacccggg

SEQ ID NO: 198814 - DNA, 916 bp, Homo sapiens
  misc_feature: GYAE6OF01D0TJN.18.59.F04.1.454.CMB.1.raw
tcagtacgagtatgcacgaccggtgctcgatttagtacacacacttagggattggggtctgggagaggagccccagccgttgggattcccaagtgttttcattcagtgatcaggactgaacacagagactcaccagtggagtttgggctgagcgtggtattttccgtgctgactttaagttttaaaggtcgtccgagtagtggacggtgcgagtcgtggtgggaggtcggtgggggaggtcgttaggggtaaaccgggtcccggggggttaccttacggaccttcccccgtagtaccacgtcccttacgttggtacttcgttaacctttacgtaaggtaaccggtcccgttagggtaacgttacgtaaccggttcgggtccccggaccgacgggtcccgttacggggaacggggggaacggggttcggttacggggtacgggttcgggggtttacggtaaccggtttaaaaacgttaaaaaccccgtaaagtacggtaaggttaggggaacggtaaccgaaacggtaacggaaccgttaccgtacgtacggtacccgaaccgggtaagaaaccgggtaactagtaccctttaaccgaaccgttatcccgtaaaggaacgtacgtaacgttaacgtaacgttaaaaccaaaaggaccctaacggtcgtttaataaccgttgaaagtaacaaaggtacgaacccgtacgccggtaactaacgggaaaccgacggaaccaccggtaggttaccttaacgttaaccttaccgtcggtaaacccacgtccccgtaacgtaacggaaacccgttaccgtaacccttaaccggttaaacccgtaacccttttaaaccggggtacccgtttaaacggtacccgggtttaaccccggagggtttcccccgggggtaaaaacccgg

SEQ ID NO: 198815 - DNA, 844 bp, Homo sapiens
  misc_feature: GYAE6OF01ATBRG.18.59.F04.1.454.CMB.1.raw
  modified_base (696)..(696): a, c, t, g, unknown or other
  misc_feature (696)..(696): n is a, c, g, or t
tcagtacgagtatgcacgaccggtgctcgatttagtacacacacttagggattggggggggtctcaggaggcagcgctctcgggacgtctccaccatggcctgggctctgctattcctcacccctcctcactcaggcacgtagggtcctgggcccagtctcgccctgactcagcctgccctcgtgtcgtgggtcctccgtaggtacacgttccgatccacctactctcctgaccacgtcggaaccagcacgtgtacggttggttaggttaatacgtagttcgtaccttccgtacggtaaccaacgtacgaccaacccgtacggaaccaaaccgtaccccccctaaaacgtcctaagttacgttaacttttacgtacgtaagttcgtaaccgtaacgttaaccggtccccggttacccgttaacgggttaacgggttttaacctaacgttcccggtttctttaccgttcgtcggtacccttaacggttacgttaccgtcggtaacccgaaccggttaccccggtccccttacccggttaccgtacccgttacgtttacccgtaccggtcccgggtaccgtcccggtacgggtaccgtaacgggacgggtaccgacgggttacttagttaaccgttttacgttacgtcgtacctcggtaacttcgtaaacgtctaaaccgaaccacccgtaacccganacccgttaccttactaccgttacgttccggttaccgtaaccgggtaacggtcccggttaacccggtacggtaccccgttaaccgggtacccgttaccggtacccgacccgggtaaccccgaaccggttacccccgaaccgttacccgg

SEQ ID NO: 198816 - DNA, 631 bp, Homo sapiens
  misc_feature: GYAE6OF01AVXDK.18.59.F04.1.454.CMB.1.raw
  modified_base (230)..(230): a, c, t, g, unknown or other
  misc_feature (230)..(230): n is a, c, g, or t
  modified_base (257)..(257): a, c, t, g, unknown or other
  misc_feature (257)..(257): n is a, c, g, or t
  modified_base (401)..(401): a, c, t, g, unknown or other
  misc_feature (401)..(401): n is a, c, g, or t
  modified_base (547)..(547): a, c, t, g, unknown or other
  misc_feature (547)..(547): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctcgccctgactcagcctgcctccgtgtctgggtctcctggacagtcgatcaccatctcctgcacgtcgaaccngcagtgacgttggtacggttataactntcgtcctccgtaggtaccaacacgaccaccgaaggaccaaaccgcccccaaaactcactgtactttatcgatgtacaactacgtccggcccttcggtacggggtttactaacgtcgtcttcgtcgtcggtcctccgtaacgtcncggtaccaacgaccgtccctcctacgacctactccgtcgtcggcctaccgacggcgtacggacggacggtacgtcgtagtactttacgtacgtgacgacgtcgtatactaagtacaacggccaaccgacgtaccaccttctacgtntcggttccgtacggtaacggtacggtacctacggtccctaccggtacgtacgtacgaccggacccgaaccgaccctacccgtac

SEQ ID NO: 198817 - DNA, 670 bp, Homo sapiens
  misc_feature: GYAE6OF01BL0DC.18.59.F04.1.454.CMB.1.raw
  modified_base (199)..(199): a, c, t, g, unknown or other
  misc_feature (199)..(199): n is a, c, g, or t
  modified_base (243)..(243): a, c, t, g, unknown or other
  misc_feature (243)..(243): n is a, c, g, or t
  modified_base (590)..(590): a, c, t, g, unknown or other
  misc_feature (590)..(590): n is a, c, g, or t
  modified_base (602)..(602): a, c, t, g, unknown or other
  misc_feature (602)..(602): n is a, c, g, or t
  modified_base (610)..(610): a, c, t, g, unknown or other
  misc_feature (610)..(610): n is a, c, g, or t
  modified_base (620)..(620): a, c, t, g, unknown or other
  misc_feature (620)..(620): n is a, c, g, or t
  modified_base (649)..(649): a, c, t, g, unknown or other
  misc_feature (649)..(649): n is a, c, g, or t
  modified_base (659)..(659): a, c, t, g, unknown or other
  misc_feature (659)..(659): n is a, c, g, or t
  modified_base (661)..(661): a, c, t, g, unknown or other
  misc_feature (661)..(661): n is a, c, g, or t
  modified_base (667)..(667): a, c, t, g, unknown or other
  misc_feature (667)..(667): n is a, c, g, or t
tcagtacgagtatgcacgaccggtgctcgatttagtacacacacttagggattgggggctttgcctgggtcctgggcccagtctgccctgactcagcctgcctccgtgtcgtgggtctcctggacagtcgatcaccatctcctgcactgaaccagcagtgtacgttggtgttataactatgtactccgtggtaaccaangaccaccaggacaaccgaccccaatcatgtatttatgatcgtanacgtactcgtcctgtacggtttactagtctcttctcgtcgtcctacgtaagtcgtacgaccgaaaccgccgtccctccgtacgacctcgttcgtcgtcggctcgtacgtcgaggtacggagtcgacgtattagttacttacgtgaccgtagtctacgtaagttaacgaacgaccttacccgaactacgtaacctacggtttacctaacggtttacgtttcggttaacgttaaccccgggtaacgtaaccggttaaaccgacccggtttaccgaacccgtttacgacccgtaacgaacccgtacccgaacctaccccgtacttaccggtacttccctacggttccccnccgtttaccccncccttccnctacgtaccncgtcgtacggcggtacgctaagggcacgngtacgacgtngnagtccntcg

SEQ ID NO: 198818 - DNA, 679 bp, Homo sapiens
  misc_feature: GYAE6OF01CSKSO.18.59.F04.1.454.CMB.1.raw
  modified_base (565)..(565): a, c, t, g, unknown or other
  misc_feature (565)..(565): n is a, c, g, or t
  modified_base (658)..(658): a, c, t, g, unknown or other
  misc_feature (658)..(658): n is a, c, g, or t
  modified_base (675)..(675): a, c, t, g, unknown or other
  misc_feature (675)..(675): n is a, c, g, or t
  modified_base (677)..(677): a, c, t, g, unknown or other
  misc_feature (677)..(677): n is a, c, g, or t
tcagtacgagtatgcacgaccggtgctcgatttagtacacacacttagggattgggggctttgcctgggtcctgggccagtctgccctgactcagcctgcctcgtgtctgggtctcctggacagtcgatcacatctcctgcacgtacggaaccagctaggttacgtacgttgggttagttaactaacttagttcgtaccttccgtacggtaaccaacacgccaaccgtaagaccaaaccgtacccctaaatcagtgttaatttactagtactaccgtactaacgtaacgtcccggtaccgttacggttacgggttactaacgtccgtctttaccgtcgtcgtaccttacgtagttacgtacggacctaccgtccggtcccttccgtacgacctcgttaccgtcggtcggtaccttcggacggtacgtacgggagtaacggcgtactagttaacgttactacgtacgacgactaccttaagaattaaccgaacgacgactaccggactctacgtcttacgtacgtcgttaacggtacgaggtaacccgacgtaacgtcgtaccgtntacgaccacgaccaaccgtaccgactactcgtacctcttccgtcccgtaccctctcgtactacgtacgtcacgtaggcgttcgacgtcgacgngaccatactgacgtacngnac

SEQ ID NO: 198819 - DNA, 721 bp, Homo sapiens
  misc_feature: GYAE6OF01CKQ40.18.59.F04.1.454.CMB.1.raw
  modified_base (243)..(243): a, c, t, g, unknown or other
  misc_feature (243)..(243): n is a, c, g, or t
tcagtacgagtatgcacgaccggtgctcgatttagtacacacacttagggattggggggggtctcaggagcagcgctctcgggacgtctccaccatggcctggctctgctattcctcaccctctcactcagggcacagggtcctgggcccaggtctgccctgactcagcctgcctccgtgtctgggtctccgtggacaggtcgatcaccatctcctgcactggaaccgcagtcgtacgttggngttataactatgtctctacgtaccacagcaccaggacaacgcccctaaactcatcgtatttatggtactcggtactaactaacgtccggtccctcgtaggggtttactaacgtcgttaccttcttcgtacggtcctacctaaggtccgttcgggaaccctaaacgtacccggtacccgtttcccgtaccgtaccctacgtacccgttcggttaccggtacccgttaccccgacgggtcttaaccgggaacgggtaacggtacggtaccggttacgtaaagttttaccgttaacctcgggtccgaacgtccgttaaccaattaacttaccgaacgtaaccctaccgaacgtcctaccttacgtcccttaggttccgttaccgttaccggtaacggtaccgggtaaccgaaccgggttaccgtacccgttacctacggggtccaaccggaccgtaaaccgcccccgtaaccccttaaccg

SEQ ID NO: 198820 - DNA, 646 bp, Homo sapiens
  misc_feature: GYAE6OF01AHXF6.18.59.F04.1.454.CMB.1.raw
  modified_base (180)..(180): a, c, t, g, unknown or other
  misc_feature (180)..(180): n is a, c, g, or t
  modified_base (186)..(186): a, c, t, g, unknown or other
  misc_feature (186)..(186): n is a, c, g, or t
  modified_base (196)..(196): a, c, t, g, unknown or other
  misc_feature (196)..(196): n is a, c, g, or t
  modified_base (203)..(203): a, c, t, g, unknown or other
  misc_feature (203)..(203): n is a, c, g, or t
  modified_base (213)..(213): a, c, t, g, unknown or other
  misc_feature (213)..(213): n is a, c, g, or t
  modified_base (217)..(217): a, c, t, g, unknown or other
  misc_feature (217)..(217): n is a, c, g, or t
  modified_base (261)..(261): a, c, t, g, unknown or other
  misc_feature (261)..(261): n is a, c, g, or t
  modified_base (486)..(486): a, c, t, g, unknown or other
  misc_feature (486)..(486): n is a, c, g, or t
  modified_base (500)..(500): a, c, t, g, unknown or other
  misc_feature (500)..(500): n is a, c, g, or t
  modified_base (522)..(522): a, c, t, g, unknown or other
  misc_feature (522)..(522): n is a, c, g, or t
  modified_base (530)..(530): a, c, t, g, unknown or other
  misc_feature (530)..(530): n is a, c, g, or t
  modified_base (542)..(542): a, c, t, g, unknown or other
  misc_feature (542)..(542): n is a, c, g, or t
  modified_base (633)..(633): a, c, t, g, unknown or other
  misc_feature (633)..(633): n is a, c, g, or t
tcagtacgagtatgcacgaccggtgctcgatttagtacacacacttagggagttggggggggtctcaggaggcagcgctctcgggacgtctccaccatggccgtggctctgctattcctcaccctctcactcgagggcacgacgggtccctgggcccagtctcgccctagactcagcctncctcgngtctgggtcnctggacngtcatcacgnttcnctagccagtacgaccagcgagtacggtcgttggtattaatactntagtcctcgttacgacctaacgacgacctaccgacgtaaccgaacccgtaaccccaacgttactaacgttagttacttagtacgtacgtctaccgttaacttaccggtacccgtaccggtttacggtacggtttactacgttccgtccgtttaccgtcgtacgcccgtacgtagtcgtcgccacgaccgtacctcgtaccacacttcgccgtgtaccgcgtacgngtaccggagacggnttgtagtacttacggtactcgngttaaccntagtacataacnccggacaacttaccactctaccttgaccttacggtcccgttaagaccggtaccgagtacctccggatcccgtagacccgacaccccgtacncccgtacgtaccg

SEQ ID NO: 198821 - DNA, 809 bp, Homo sapiens
  misc_feature: GYAE6OF01CDSMW.18.59.F04.1.454.CMB.1.raw
  modified_base (129)..(129): a, c, t, g, unknown or other
  misc_feature (129)..(129): n is a, c, g, or t
  modified_base (153)..(153): a, c, t, g, unknown or other
  misc_feature (153)..(153): n is a, c, g, or t
  modified_base (164)..(164): a, c, t, g, unknown or other
  misc_feature (164)..(164): n is a, c, g, or t
  modified_base (459)..(459): a, c, t, g, unknown or other
  misc_feature (459)..(459): n is a, c, g, or t
  modified_base (759)..(759): a, c, t, g, unknown or other
  misc_feature (759)..(759): n is a, c, g, or t
  modified_base (768)..(768): a, c, t, g, unknown or other
  misc_feature (768)..(768): n is a, c, g, or t
  modified_base (775)..(775): a, c, t, g, unknown or other
  misc_feature (775)..(775): n is a, c, g, or t
  modified_base (778)..(778): a, c, t, g, unknown or other
  misc_feature (778)..(778): n is a, c, g, or t
  modified_base (783)..(783): a, c, t, g, unknown or other
  misc_feature (783)..(783): n is a, c, g, or t
  modified_base (785)..(785): a, c, t, g, unknown or other
  misc_feature (785)..(785): n is a, c, g, or t
  modified_base (789)..(789): a, c, t, g, unknown or other
  misc_feature (789)..(789): n is a, c, g, or t
  modified_base (792)..(792): a, c, t, g, unknown or other
  misc_feature (792)..(792): n is a, c, g, or t
  modified_base (798)..(798): a, c, t, g, unknown or other
  misc_feature (798)..(798): n is a, c, g, or t
  modified_base (803)..(804): a, c, t, g, unknown or other
  misc_feature (803)..(804): n is a, c, g, or t
  modified_base (809)..(809): a, c, t, g, unknown or other
  misc_feature (809)..(809): n is a, c, g, or t
tcagtacgagtatgcacgaccggtgctcgatttagtacacacacttagggagttgggggctttgtcgtgggtctcctggacagtcgatcaccatctcctgcacgtggaaccagcgagttgaacgttggnggttataaacctatggtctaccgnggttacaaacnggacacccgagggaccaaacgtcccccaaaatctaagtgaattttataggaatcggttaaccacgtaaagttcccgggaccctaggtaacggggttttacctaatcggtccttttacgacgttcgggaccctttaccaaaggttccgtaaggaaccgaaacccgtaaccgggtccctacccgttaacggacctaaacggttccgttaacgtttcgggggtactaacccggaggttaccggtaacggtaagggacgggtttaacgccggttaattaacgggttttaaactttccgngggtaacccttacggaactttacccggtaaggttaacaaacgggaattaccccgaacggttactaaccgggacttacccgttaagttagttcggtacggtttaaaccgggaaccttacggggggaaactttaaacgggcctaaacccgtttaccggtacggttaaccggaacccggacgaaacccgggtttacccctaaccccgggtactttaccgaaccgttccgttacgtaccgttacccgtaccctaccgtacttacggtacttacgacgtcgacggcgttacgagacgtacgacgnaacgtagcngtagcangtncggtnancgangcntggacngatanncgtgn

SEQ ID NO: 198822 - DNA, 694 bp, Homo sapiens
  misc_feature: GYAE6OF01A72UM.18.59.F04.1.454.CMB.1.raw
  modified_base (204)..(204): a, c, t, g, unknown or other
  misc_feature (204)..(204): n is a, c, g, or t
  modified_base (627)..(627): a, c, t, g, unknown or other
  misc_feature (627)..(627): n is a, c, g, or t
tcagtacgagtatgcacgaccggtgctcgatttagtacacacacttagggattggggagagagacccctcccctgggatcctgggcccagtctgcccctgactcagcctgcctccgtgtctcgggtctcctggacagtcgactcaccatctcctgcaactcggaaccagcagtgacgttggtggttaataactagtgtcctccnggtaccacacgcacccaggacaaacgcccccaaactctatcggtatttactaggattcgctacgtaaacgtccggtaccccgttgtaacgggggtttacttaaacgtacgtcttccgtaccgtggcctaccgtaacgtcgacggtccaacgccggtaccctccgtctaccgctactcgtcggcctccgagcgtaggaggtacggacgtcgtagtactttaacgttacgtacgacgtaccgtctaactacgtaaagtaaccgtaaacgacccaaccggtactccgtaactttctacctaagtttcggtacccgttaaccgggaacgtaccggtaacccgtacgggtaccctaccggaccgttacgggtaccacgacccgaaccgaccccgaaccctgtactacccacgtaccgtcccgtacccncccgtctacctagtccctacgtacgtcgtaggcggttacgcggtataccggcaccgataggcctagc

SEQ ID NO: 198823 - DNA, 846 bp, Homo sapiens
  misc_feature: GYAE6OF01A4NDT.18.59.F04.1.454.CMB.1.raw
  modified_base (741)..(741): a, c, t, g, unknown or other
  misc_feature (741)..(741): n is a, c, g, or t
tcagtacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggtattttccttgctgcttaatttaaaggtgtccagtgtgaggtgcagtcgtggtggagtcgtgggggaggtcgttagggtaaacgggtccggggggtacccttaggacctccccgtgtacgacgtcctcgtggtacttccgtacttttaccaaggttaacggtcccgttaggacgttacggaaaccgttcggggtccccgaccgtacggggtccgttacccgggaaaggggggtaacggggtccgttaggggaggtttacgggggttcgggtaacccggtttaaaacgtttaaaaaacccgaaaacgttcggtaaacggttacggggtaacgggaaccaaaacgtaggtaacccgttacggactacgacccgtaaccccggttaaggaaaacggcctaaaggtaaccttaccgaacccgtaacttaccgtaaccgaaacggtaacgtaacgttacggtaaatttaacccggaaaaaacgtccgaacggtacttagtacgttacgtagtactaaacgtcgaaaccgtcgtaccgtaaggaaccgtaaccggaaggtaacccacgtaacggtaccgttataacgtntacccgtaacctaccgaaccgttacccgtaagaaccggcccgttaaacgtaaacctacccgttaactaaccgttaacggtacttaccggacccgttaacccgggg

SEQ ID NO: 198824 - DNA, 695 bp, Homo sapiens
  misc_feature: GYAE6OF01DMM2O.18.59.F04.1.454.CMB.1.raw
  modified_base (193)..(193): a, c, t, g, unknown or other
  misc_feature (193)..(193): n is a, c, g, or t
  modified_base (355)..(355): a, c, t, g, unknown or other
  misc_feature (355)..(355): n is a, c, g, or t
  modified_base (370)..(370): a, c, t, g, unknown or other
  misc_feature (370)..(370): n is a, c, g, or t
  modified_base (384)..(384): a, c, t, g, unknown or other
  misc_feature (384)..(384): n is a, c, g, or t
  modified_base (653)..(654): a, c, t, g, unknown or other
  misc_feature (653)..(654): n is a, c, g, or t
  modified_base (657)..(657): a, c, t, g, unknown or other
  misc_feature (657)..(657): n is a, c, g, or t
  modified_base (665)..(665): a, c, t, g, unknown or other
  misc_feature (665)..(665): n is a, c, g, or t
  modified_base (671)..(671): a, c, t, g, unknown or other
  misc_feature (671)..(671): n is a, c, g, or t
  modified_base (677)..(677): a, c, t, g, unknown or other
  misc_feature (677)..(677): n is a, c, g, or t
  modified_base (687)..(687): a, c, t, g, unknown or other
  misc_feature (687)..(687): n is a, c, g, or t
  modified_base (689)..(689): a, c, t, g, unknown or other
  misc_feature (689)..(689): n is a, c, g, or t
  modified_base (692)..(692): a, c, t, g, unknown or other
  misc_feature (692)..(692): n is a, c, g, or t
tcagtacgagtatgcacgaccggtgctcgatttagtacacacacttagggagttgggggctttgtctgggtctcctggacagtcgatcaccatctcctgcactggaaccagcgagtgacgttggtagttactatatcgtctccgtggtaaccacagccacccgaggacaaacgaccccaaatcatgtattagngtatcgtacactagtccgtccaggtagggttactacgtcgtcttactcgtcggtacctacgagtcgtacgacgaaccgtcctccgtaccatacctatcgtacgtcggacctcgaagcgtaggacggacgtacggtacagtttacttaagttcgacgtaccgngacttaacagttaanacgaacaccgtaancctaacgttctacggtacttaacgtcgtacgttaacggagtaaccgtacggttaaaccgccgtaaccggttacgaaccgtccggaaacccttaaccggaaccccgaaccctacccggtaacttacccgttaacgtaccccgtttaccggttaaccctacccccggttaacccttacccgtaacccttaaccgttcgttaacccgtaggtaccggacgggtaacccgggagaaccgggacaacggtccgaaagtaccgtgactatggacnnagngtagacgngtagcncgacgnacgtacaganancgngcg

SEQ ID NO: 198825 - DNA, 789 bp, Homo sapiens
  misc_feature: GYAE6OF01AUGTI.18.59.F04.1.454.CMB.1.raw
tcagtacgagtatgcacgaccggtgctcgatttagtacacacacttagggattgggggggggtctcaggaggcagcgctctcgggacgtctccaccatggcctgggctctgctattcctcaccctcctcactcagggcacgagggtcctgggcccagtctgccctgactcagcctgcctcgtgtctgggtctcctggacagtcgatcaccatcctcctgcacgtaggaaccagcagtgacggtttggtagttataactatcgtctcctacggtaccaacacgaccaccgaggaccaaaccgacccccaaactcagtagtatttatgtatcgtacaacgtaacgtccggtcccttacggtaacgggtttactaacgtccgtctttcgtcgtcggtacctaccgtaacggtccgttacgggacctaaaccgtacccgggtaccccttaccccggttacgaacccgttacgttccgttcggtccggggtacccttcccgggacgggtaccgtacgggtaacgggacgtacgggttccgtagttaacgtttaacgttaccgtcgtaccgtagtacctactaacgtaactaaccgtaacggtccccaaacccgtaaccgtacccgttaacccttacttaccgtttaagttccggttaccggttaacccggggttaaccgtaccggggtaaacccggttaaaccggttccccgaaaccccggtttaccgggtaaccggtacccgaacccggaaccccggtaaaccccggaaccccccgtaaacccccggttaccg

SEQ ID NO: 198826 - DNA, 734 bp, Homo sapiens
  misc_feature: GYAE6OF01D3ZY7.18.59.F04.1.454.CMB.1.raw
  modified_base (225)..(225): a, c, t, g, unknown or other
  misc_feature (225)..(225): n is a, c, g, or t
  modified_base (244)..(244): a, c, t, g, unknown or other
  misc_feature (244)..(244): n is a, c, g, or t
tcagtacgagtatgcacgaccggtgctcgatttagtacacacacttagggattggggggggtctcaggaggcagcgctctcgggacgtctccaccatggcctggctctgctattcctccaccctcctcactcgagggcacgagggtcctgggcccagtctcgccctgactcacgcctcgccctcgtgtcgtcgggtctccgtggacagtcatccgaccacttccncctagccacgtaggaaccngactaggttggtacgtttggtaggttaactactagttcgtcctccgttaggtaaccaacacggtaccaaccgaacggaccaaaaccggaccccccaaagttcaagtgttacttttaacgcgtattcgtacctacgttaacgtcccggtacccttacggtacgggtttactaacgtccgttaccgttccgtgtaccggtcctaaccgtacggttcgacggacctaacgtacccgtcccttacccgacgtacctcgttccgtacgtcggctaccgagtacgtagggacggtacgacggtacttagtacgtttaacgtaccgtagcctagtacgtctaacgtactaacgaacctacccgactacgtccttacgttccgttcgtactttcgttaccggtaccggtaacgggtccgtaaacccgtacggttaacccaccgggttccgtaaacggtcccgtaacccgaaccgtaacccggaaccctcccggtaacg

SEQ ID NO: 198827 - DNA, 723 bp, Homo sapiens
  misc_feature: GYAE6OF01ANIZ2.18.59.F04.1.454.CMB.1.raw
  modified_base (512)..(512): a, c, t, g, unknown or other
  misc_feature (512)..(512): n is a, c, g, or t
  modified_base (527)..(527): a, c, t, g, unknown or other
  misc_feature (527)..(527): n is a, c, g, or t
  modified_base (641)..(641): a, c, t, g, unknown or other
  misc_feature (641)..(641): n is a, c, g, or t
  modified_base (651)..(651): a, c, t, g, unknown or other
  misc_feature (651)..(651): n is a, c, g, or t
tcagtacgagtatgcacgaccggtgctcgatttagtacacacacttagggattgggggagcgtctgggagtaggagccccagccttgggattcccaagtgttttcattcagtgatcaggactgtaacacagaggactcaccatggagtttgggctgagctggctttcgtgctgtctatttaaaggtgtccagtgtggaggtgtcagcgtggtggagtcgtagggggaggtcgttacgggtaacgggtcccggggggttacccttaggtaacccgttcccccgttaggtaaccgtacgtcccgttacggttcgggtactttaccgtacttttaccggaaggttaaacgggcccgttagggacttcggtaaccgttcggggtcccgcgtaacgggcctaccggaaggggaacgggcgttagggacggttaggggttcggtaccgttaaactaaaacccgtaaagtcgtagtagggtcggaacaacgagacgtacgctgccgaccggtagaacgngtatacgtccactanactacgaacagtatacgtaacttaacgaaaacgtcaagtctagtactacgtgaactaaggtacgtaacctaggactaaggaaccgtaaacggacgaacctagccgtaccggttntaacgttacncgtaactacgaccttaccgagaactcgtaacctaccgttactacccgtacttacgtacgtcgtcgtaccggg

SEQ ID NO: 198828 - DNA, 735 bp, Homo sapiens
  misc_feature: GYAE6OF01BWCOE.18.59.F04.1.454.CMB.1.raw
  modified_base (159)..(159): a, c, t, g, unknown or other
  misc_feature (159)..(159): n is a, c, g, or t
  modified_base (274)..(274): a, c, t, g, unknown or other
  misc_feature (274)..(274): n is a, c, g, or t
  modified_base (724)..(724): a, c, t, g, unknown or other
  misc_feature (724)..(724): n is a, c, g, or t
  modified_base (728)..(728): a, c, t, g, unknown or other
  misc_feature (728)..(728): n is a, c, g, or t
  modified_base (733)..(733): a, c, t, g, unknown or other
  misc_feature (733)..(733): n is a, c, g, or t
  modified_base (735)..(735): a, c, t, g, unknown or other
  misc_feature (735)..(735): n is a, c, g, or t
tcagtacgagtatgcacgaccggtgctcgatttagtacacacacttagggagttgggggctttgcctgggtcctgggcccagtctgccctgactcgagcctgcctccgtgtctgggtctcctggacagtcatcaccatcctcctgcacgtacggaaccngcgagtcggtacggttggtaggttaactaacgtatcgtacctccgtaggtaaccaacgacggaccacccgtaggaaccaaaacccgtacccccaaaattcagttagtattttaancgattgtaccaactaacgtccggtccgtacggttagggtttacctagttccggtctttacgcgtggtaccctacgtaaggtccgtacggaactaacccgacggtccctaccgtacggaccttacgttccgtaccggcgggtacccttacgaaggtcgtaacgggaacgggtacgtacgttacgtagtactttaacgtctcgtacgtcggacttaacgtacgtaacaacgtaacgacctaacgacttctaacgtcgtactactcgttacgtaccgacgtacggaacgtacgtaccgtacggtactaccgtacgaacccgaccgtaaccgccctaacctcggtacttccgtactttcccggtacccgttccccgtacccttccgtaaccctagttacccgtctacggtccgaacgggtccgacggtacgacggtacgacgttacgacgtacnctancgtangn

SEQ ID NO: 198829 - DNA, 678 bp, Homo sapiens
  misc_feature: GYAE6OF01BEA5K.18.59.F04.1.454.CMB.1.raw
  modified_base (278)..(278): a, c, t, g, unknown or other
  misc_feature (278)..(278): n is a, c, g, or t
  modified_base (308)..(308): a, c, t, g, unknown or other
  misc_feature (308)..(308): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcaggcacagggtcctgggcccagtctgccctgactcagcctgcctcgtgtctgggtctcctggacagtcgatcaccatctcctgcactggaaccagtcagtgacgttggtgttaataactatgtctcctggtaccaactagccaccnggacaaacgccccaaactcatcgtatttangtactgtcactaacgtccggccctacgtagggttctaacgtcgtcttctcgtgtcctaccgtaagtccgacggacaaccgaccggtccctacccgtacaaccctacgtccgtcggtacgggtccttccggaacgggtcgtacgggaacgggtaccgtaggtacccgttagttagtttaaccgtttacgacggtcctacggtacctaacgttaacgtaacgtaaccgaacggaaccaccggttaacgacccttacgttaccttactacgttccgttacgttcccggtaaacggtccggtaacccgtaacggtccgtacccggtcgttaacggtcccaaccgtaccccgaaacggtccccctaacccgtacg

SEQ ID NO: 198830 - DNA, 877 bp, Homo sapiens
  misc_feature: GYAE6OF01B3Z35.18.59.F04.1.454.CMB.1.raw
  modified_base (699)..(699): a, c, t, g, unknown or other
  misc_feature (699)..(699): n is a, c, g, or t
  modified_base (835)..(835): a, c, t, g, unknown or other
  misc_feature (835)..(835): n is a, c, g, or t
tcagtacgagtatgcacgaccggtgctcgatttagtacacacacttagggattggggtctgggagaggagccccagccttgggattcccaagtgttttcattcagtgatcaggactgaacacagaggactcaccatggagtttggctgagctggtattttccttgctgtacttaatttaaaaggtgtccagtgtgaggtgcgagtcgtgggtggaggtcggtgggggtaggtcgttacggggtaaaccggggtcccgggggggtacccttacgtacccgtccccgtagtacgcgctcgtggtacttactacgtttacgaacggtaacggccgtaggagtagtaaccgttcggggtcccgccgtacgggccgtaccgggaagggggacggggtcgtaggggaggttcggggttacgggtaacccgttaaaacgttaaaaaaccgtaaaacgtaggtaacgggttggggtaacggtaaaccgaaacggtaaccgaaccgttaaccgcgtacgaacccggtaacccggtaaggaaaacggtcaacgtaccgttaacccaaccttacgtacctaagaacgaagtacttaagtaacgtaaacctaaaagcccgtaactacgttagttaactcgtaacgtaacgtaaagtaaccgtaacgtaaccgtaccggtaaagggaaccggtaaacccggaacggaacccncggttaaccggtacgttaacggttaacttacccgttacgtaaaccccctacgtacccggtaacccctaacggtaaaccggtaccttaaacccgtaacgtttaaccctaaccggttaaaccgttacccggggttaanaccccgggttaccggtaacggggtaacccgggtaaccccggg

SEQ ID NO: 198831 - DNA, 705 bp, Homo sapiens
  misc_feature: GYAE6OF01EPZIP.18.59.F04.1.454.CMB.1.raw
  modified_base (199)..(199): a, c, t, g, unknown or other
  misc_feature (199)..(199): n is a, c, g, or t
  modified_base (240)..(240): a, c, t, g, unknown or other
  misc_feature (240)..(240): n is a, c, g, or t
  modified_base (247)..(247): a, c, t, g, unknown or other
  misc_feature (247)..(247): n is a, c, g, or t
  modified_base (695)..(695): a, c, t, g, unknown or other
  misc_feature (695)..(695): n is a, c, g, or t
  modified_base (701)..(701): a, c, t, g, unknown or other
  misc_feature (701)..(701): n is a, c, g, or t
tcagtacgagtatgcacgaccggtgctcgattttagtacacacacttagggagttgggggctttgcctgggtcctgggcccagtctgccctgactcagcctgcctcgtgtctgggtctcctggacagtcgatccacatctcctgcactgaaccagcagtgtacggttggtgttaataatatgtcctcgtacgtaccaangaccaccgaggaccaacctaccccaatcgattagtattagngtacgtntactaactaacgtcccggaccgttaggtagggttttacacgtctcgttacttccgacgtactacgtagtctagaaccgtaccgaccgcccttaccgtacgacctacgtttccgacgtcggtaccgtcaggtcgtcggaaagccggatcctaaggttactttacggccgtagacgtacgtactaaccaattacaaaccgaccgtaaaccgaccgttaccgactttaaccggtaccttacggttacctacggttaacgtaaccgggtaaccgttaccggaacgtacgtaccggaccgttacgtaccgtaccgtacgacccgtacccgaacctaccctacgttacgtaccctacgttcccgttacccgttccctaccctcccttaaccgttactccgttagacccggttaacgccggtacgcggtacgaccggtagaccgactacggtacncatcgnagtc

SEQ ID NO: 198832 - DNA, 846 bp, Homo sapiens
  misc_feature: GYAE6OF01EXKQD.18.59.F04.1.454.CMB.1.raw
  modified_base (698)..(698): a, c, t, g, unknown or other
  misc_feature (698)..(698): n is a, c, g, or t
  modified_base (714)..(714): a, c, t, g, unknown or other
  misc_feature (714)..(714): n is a, c, g, or t
  modified_base (742)..(742): a, c, t, g, unknown or other
  misc_feature (742)..(742): n is a, c, g, or t
tcagtacgagtatgcacgaccggtgctcgatttagtacacacacttagggagttgggggggggtctcaggaggcagcgctctcgggacgtctccaccatggcctgggctctgctattcctcaccctcctcactcagggcacgagggttcctgggcccagttctcgccctgactcagccctgcccgtcgttgtccgtgggtcctaccgtggactggtcgtactccacctactccgtcctaggcctaaccgtacgggaaaccctaggtaccgtaaggtttggtaccgggttttgggtttaacggtttaaaacttaaaccgttagtttcgtttaccgttaccccgttacggtaaacccgtaacgaaccggcccgaacccggtaacggaacccgaaaaaccccggtaccccccccaaaaacgtttaccaacgtttaacgggttaacttttaacgtaagtacgtttacggtacctaaccgttaaacgttcccgggtaccccgttacggtacggttttacgtaacttccgttccttcgtccggtacgtccctacgttaacgtcgtacgaccgaacgtacccgggcccttcccgacgaccgtattcgtccgttacgggcccgttacgacggtttccgtaacggaaccgggtacggacggtacgttacgttaacggtttaaacttcgtacacggtactaccgttanacgtttaacaacgacncccgtaacgtccaacgttcctaccgttntacgggttccgttacgtaaccgggtaccgtcgggtaacgacggtccctaacccggtacgttaccggaccttaccgaaaccctacccggaacccctcgtaacccg

SEQ ID NO: 198833 - DNA, 570 bp, Homo sapiens
  misc_feature: GYAE6OF01CRZ2W.18.59.F04.1.454.CMB.1.raw
  modified_base (189)..(189): a, c, t, g, unknown or other
  misc_feature (189)..(189): n is a, c, g, or t
  modified_base (470)..(470): a, c, t, g, unknown or other
  misc_feature (470)..(470): n is a, c, g, or t
  modified_base (498)..(498): a, c, t, g, unknown or other
  misc_feature (498)..(498): n is a, c, g, or t
  modified_base (511)..(511): a, c, t, g, unknown or other
  misc_feature (511)..(511): n is a, c, g, or t
  modified_base (527)..(527): a, c, t, g, unknown or other
  misc_feature (527)..(527): n is a, c, g, or t
  modified_base (540)..(540): a, c, t, g, unknown or other
  misc_feature (540)..(540): n is a, c, g, or t
  modified_base (546)..(546): a, c, t, g, unknown or other
  misc_feature (546)..(546): n is a, c, g, or t
  modified_base (557)..(570): a, c, t, g, unknown or other
  misc_feature (557)..(570): n is a, c, g, or t
tcagtacgagtatgcacgaccggtgctcgatttagtacacacacttagggattgggggctttgtctgggtctcctggacagtcgatcaccatctcctgcactggaaccagcagtgacgttggtggttataactatgtctcctggtaccaacagcacccaggcaaacgcccccaaaactcatgtatttangatgtcactaatccggccctcgtaggggtttctaatcgtcttctctggtcctaccacgtcgtcggaccaaccgacccggccctccctcgacctacttccgtcgtcggggcctccgaggtcgtaggaacggacggaggtcctagtaactttaacttacgtcgcgtagtcctataataactaacaacgtaccaccgacgctacctctacttagtcgttccgtacgacgtacggacgtacggacctaccgtcgtacgtccgacgacccgaacgcccctaacccntcctccgtactccgtccccttacccccncctcctaaccctntacccgttcgtaccgnggccgggtccgancggganacgcagtatcnnnnnnnnnnnnnn

SEQ ID NO: 198834 - DNA, 829 bp, Homo sapiens
  misc_feature: GYAE6OF01BUIPV.18.59.F04.1.454.CMB.1.raw
  modified_base (120)..(120): a, c, t, g, unknown or other
  misc_feature (120)..(120): n is a, c, g, or t
  modified_base (248)..(248): a, c, t, g, unknown or other
  misc_feature (248)..(248): n is a, c, g, or t
  modified_base (620)..(620): a, c, t, g, unknown or other
  misc_feature (620)..(620): n is a, c, g, or t
tcagtacgagtatgcacgaccggtgctcgatttagtacacacacttagggattggggggggtctcaggaggcagcgctctcgggacgtctccaccatggcctgggctctgctattcctcnccctcctcactcgagggcacgagggtcctggggcccagtctcggccctgactcgacgcctgcctcccgtgtcgtgggttcctccgtggactaggtcgatccaccatcctcctgccacgtacggaaccngccgaggtcggtacggttggttagttaacgtaactacgttcgttctccgttaccggtaacctaaaccgacgtacccaaccgaacggaaccaaacccgtacccccctaaacttccgtaacgtaggttaacttttaacgtcggtaacgttaccggtaaccttaaaccgtaacggttccccggtaccccgttaccgggttttaacggggttttaacttaaccgtttccggtccttttccggtccgttacgtacccttacccggtaagtccggtacgaccgtaaccgtcccggtacccctccgtactacctacgttccctcgggccgtaccgcgaggtccgaggacgggacgcgtcgtattacgttactacggtcncgtacctacgtacgaacttacgtaacgtaccgacgaccgtaccgtacctaccgttcgttacctaccgttaccggttacgtaaccgggtaaccgttaccggggtaaacccgttacggggttaaaccccaccccgggtttaccgtaaacccggtacccggaaccccgttaaacccccggtacccggaacccccttaaaccccggttacccg

SEQ ID NO: 198835 - DNA, 749 bp, Homo sapiens
  misc_feature: GYAE6OF01A4U4J.18.59.F04.1.454.CMB.1.raw
  modified_base (195)..(195): a, c, t, g, unknown or other
  misc_feature (195)..(195): n is a, c, g, or t
  modified_base (249)..(249): a, c, t, g, unknown or other
  misc_feature (249)..(249): n is a, c, g, or t
  modified_base (305)..(305): a, c, t, g, unknown or other
  misc_feature (305)..(305): n is a, c, g, or t
  modified_base (356)..(356): a, c, t, g, unknown or other
  misc_feature (356)..(356): n is a, c, g, or t
  modified_base (737)..(737): a, c, t, g, unknown or other
  misc_feature (737)..(737): n is a, c, g, or t
tcagtacgagtatgcacgaccggtgctcgattttagtacacacacttagggagttgggggggggtctcaggaggcagcgctctcgggacgtctccaccattggcctgggcttctgcttatttcctccacccttcctccactacgaagggccacgtacggggttccgtcggggcccagttctcgcccgttgacctncgtctcgccttcgtgtcgtggtactcgtggcagtcgactcaccgtcttcgtccngtacctacgtaccggacagacggtacgttggtacggtttggtagttaattaacgtnttcgtacgtccgtagtaccacacaccgacgaacggaccaaccgaccctaanctagtacgttattagagtactacgtactacgtacgtccgttcgttagtacggtttactacgttccttcttcgtctaccgtacgtacgtcgtttacgcgtaaccgtaccgccccgttcgtaccggtctaccggtctccgtcgtacgtccgacgtcggtagaacggcgtcgtaagttacctatttacggttaccgatccgtagtacgtcctaaactttaagacccgttaaagaccccgagtaaccccgagtttcctaacggtttacccgtaatttacccggttacgggtacccgttaccgggaaaccggttccggtaaccgggtttacctaaccggttacgttcccgacggttaaccggaccccgaaacccgtaaccgtaccncccggtttaccg

SEQ ID NO: 198836 - DNA, 735 bp, Homo sapiens
  misc_feature: GYAE6OF01BTUZZ.18.59.F04.1.454.CMB.1.raw
  modified_base (338)..(338): a, c, t, g, unknown or other
  misc_feature (338)..(338): n is a, c, g, or t
  modified_base (467)..(467): a, c, t, g, unknown or other
  misc_feature (467)..(467): n is a, c, g, or t
tcagtacgagtatgcacgaccggtgctcgatttagtacacacacttagggattgggggctggggtctcaggaggcagcgctctcgggacgtctccaccatggcctgggctctgcttattcctcaccctcctcactcagggcacgagggtcctgggcccagtcctcgccctagactcacgcctcgccctccggtgtcgtcgggttcctccgtagggaccaggttacgactaccacctactcctccgtgaccgactacgggaaaccaggtccaaggtcggttacggtttaggggttacggttaacttaactagtcgttccgtaccgtacggtaaccaacnccgacccgtaaccgacggtaacccgaaaccggtaccccctaaaactctaagtagttaacttttagcgtagttacgtaactacgtaacgtccggtaccgtaggttacgggttacttaacgtcgtccgttntacgtcggctacgtacgtcgtacggaccaaccgtccggcctccgtacacctctcgtcgcgtccgtacgacggtcgacggaacggagacgggtagtagttacgttaagttccgacgtacgtaccgtactaacaactaacgtaacgtaacgacgacgaccgacgtaaccgtaccgtaacgtaccggttacgtaacggtaccggtacggtaaccgtacggtaccgaccgtacgtaccggaccgaaccgaacccgaaccggaccctaacccg

SEQ ID NO: 198837 - DNA, 319 bp, Homo sapiens
  misc_feature: GYAE6OF02HF5LT.18.59.F04.1.454.CMB.1.raw
  modified_base (317)..(319): a, c, t, g, unknown or other
  misc_feature (317)..(319): n is a, c, g, or t
tcagtacgagtatgcacgaccggtgctcgatttagtacacacacttagggattggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaacatcggaagtcagcccaaggctgcccctcggtcactctgttcccgccctcctccatactcgtactgagcgggctggcaaggcgcatagnnn

SEQ ID NO: 198838 - DNA, 320 bp, Homo sapiens
  misc_feature: GYAE6OF02HRWQG.18.59.F04.1.454.CMB.1.raw
  modified_base (190)..(190): a, c, t, g, unknown or other
  misc_feature (190)..(190): n is a, c, g, or t
  modified_base (315)..(320): a, c, t, g, unknown or other
  misc_feature (315)..(320): n is a, c, g, or t
tcagtacgagtatgcacgaccggtgctcgatttagtacacacacttagggattggggagagaagacaggattcaggacaatctccagcatggccggcttccctctcctcctcaccctcctcactcactgtgcagggtcctgggcccagtctgtgctgactcagccaccctcagcgtctgggacccccggnagagggtcaccatctcttgttctggaagcagctccaacatcggaagtcagcccaaggctgccccctcggtcactctgttcccgcctcctccatactcgtactgagcggctggcaaggcgcatagnnnnnn

SEQ ID NO: 198839 - DNA, 520 bp, Homo sapiens
  misc_feature: GYAE6OF02F5FSF.18.59.F04.1.454.CMB.1.raw
  modified_base (448)..(448): a, c, t, g, unknown or other
  misc_feature (448)..(448): n is a, c, g, or t
  modified_base (511)..(511): a, c, t, g, unknown or other
  misc_feature (511)..(511): n is a, c, g, or t
  modified_base (513)..(513): a, c, t, g, unknown or other
  misc_feature (513)..(513): n is a, c, g, or t
  modified_base (517)..(517): a, c, t, g, unknown or other
  misc_feature (517)..(517): n is a, c, g, or t
tcagtacgagtatgcacgaccggtgctcgatttagtacacacactttagggagttggggctttgcctgggtcctgggcccaggtctgccctgactcagcctgcctccgtgtctgggtctcctggacagtcgatcaccatctcctgcactggaaccagcagtgacgttggtggttataactatgtctcctggtaccaacagcacccaggcaaagccccaaactcatgatttatgatgtcactaatcggccctcacgggttctaatcgcttctctggctcaagtctaggcaacacggcctccctgaccatctctgggctccaggctgaggacgaggctgattattactgcagctcattacacaagcaccagcactctctatgtctcggaactggaccaggtcacgtctagtcacgccaacgccaccctactgtccacttcctcgttcccncccttccgtaccacgttacctcgtactgacgtccgggctaggaccgaacggtcgcaagtcgancnacgntcg

SEQ ID NO: 198840 - DNA, 502 bp, Homo sapiens
  misc_feature: GYAE6OF02HP1FJ.18.59.F04.1.454.CMB.1.raw
  modified_base (328)..(328): a, c, t, g, unknown or other
  misc_feature (328)..(328): n is a, c, g, or t
  modified_base (423)..(423): a, c, t, g, unknown or other
  misc_feature (423)..(423): n is a, c, g, or t
  modified_base (451)..(451): a, c, t, g, unknown or other
  misc_feature (451)..(451): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctnaggggtttctaatcgcttctctggctccaagtctggcaacacggcctcctgaccatctctgggctccgaggctgaggacgaggctgattattacngcagctacatatacaagcagcagcactnagtcttacggaactggaccaaggtcacgtctaggtcaggcccagccaaccc

SEQ ID NO: 198841 - DNA, 521 bp, Homo sapiens
  misc_feature: GYAE6OF02F4K4Z.18.59.F04.1.454.CMB.1.raw
  modified_base (500)..(500): a, c, t, g, unknown or other
  misc_feature (500)..(500): n is a, c, g, or t
  modified_base (509)..(509): a, c, t, g, unknown or other
  misc_feature (509)..(509): n is a, c, g, or t
  modified_base (515)..(517): a, c, t, g, unknown or other
  misc_feature (515)..(517): n is a, c, g, or t
  modified_base (520)..(521): a, c, t, g, unknown or other
  misc_feature (520)..(521): n is a, c, g, or t
tcagtacgagtatgcacgaccggtgctcgatttagtacacacacttagggattggggctttgcctgggtcctcgggcccaggtctgccctgacctcagcctgcctccgtgtctgggtctcctggacagtcgactcaccatctcctagcactggaaccagcagtgacgttggtcggttataactatgtctcctgggtaaccaacacgccacccaggcaaagccccaaactcatgatttatgatgtcactaatcggccctcaggggtttctaatcgcttctctggcctccaagtctggcaactacggccctccctgaccactctcgtcgggctccgaggctcgaggaccgaggtctgattattacgtgtcagctcatatacaagcacagcactctctatgtcttcggaactggtacaaggtctaccgtctaggtcagccaaggcccaacccactgtcacttctcgttcccaccctctccatactacgtactagacgcggtcnggcaagcgntatcgnnntcnn

SEQ ID NO: 198842 - DNA, 499 bp, Homo sapiens
  misc_feature: GYAE6OF02ITV5D.18.59.F04.1.454.CMB.1.raw
  modified_base (303)..(303): a, c, t, g, unknown or other
  misc_feature (303)..(303): n is a, c, g, or t
  modified_base (498)..(498): a, c, t, g, unknown or other
  misc_feature (498)..(498): n is a, c, g, or t
tcagtacgagtatgcacgaccggtgctcgatttagtacacacacttagggattggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttangatgtcactaatcggccctcagggtttctaatcgcttctctggctccaagtctggcaacacggcctccctgacccatctctgggctccaggctgaggacgaggctgattattactgcagctcatatacaagcaccagcactctctatgtcttcggaactggaccaggtcaccgtctaggtcagccaagccacccnc

SEQ ID NO: 198843 - DNA, 533 bp, Homo sapiens
  misc_feature: GYAE6OF02FSGKJ.18.59.F04.1.454.CMB.1.raw
  modified_base (447)..(447): a, c, t, g, unknown or other
  misc_feature (447)..(447): n is a, c, g, or t
  modified_base (453)..(453): a, c, t, g, unknown or other
  misc_feature (453)..(453): n is a, c, g, or t
tcagtacgagtatgcacgaccggtgctcgatttagtacacacacttaagggattgggggggtcggtcgagggaggcaggcgcttcgtcgggtacgttctccaccatggcctagggctctgcgtacttcctcaccctcctcgacgtcgacgggcgacgagggtcctgggacccagtctggccctgactccagcctgcctccgtgtctcgggtcctcctggacagtcgatcaccatctccgtgcgactgggaaccagcagtgacgttggtggttataactatgtctcctggtaccaacagcaccccaggcaaagcccccaaactcatgatttatgatgtcactaatcggccctcaggggttttctaatcgcttctctggctccaagtctggcaacacggcctccctgaccatctctgggctccaggctgaggcgaggctgattatactncagctnatatacaagcaccagcactctctatgtcttcggactgggaccacggtcaccgtcctaggtcacgtcccaaggccaccctc

SEQ ID NO: 198844 - DNA, 503 bp, Homo sapiens
  misc_feature: GYAE6OF02GREPU.18.59.F04.1.454.CMB.1.raw
tcagtacgagtatgcacgaccggtgctcgatttagtacacacacttagggattgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaaactcatgatttatgatgtcactaatcggccctcaggggtttctaatcgcttctctggctccaagtctggcaacacgcctccctgaccatctctgggctccaggctgaggacgaggctgattattactgcagctcatatacaagcaccagcactctctatgtcttcggaactgggaccaaggtcaccgtctaggtcagcccaaggccaacccac

SEQ ID NO: 198845 - DNA, 497 bp, Homo sapiens
  misc_feature: GYAE6OF02GGRCD.18.59.F04.1.454.CMB.1.raw
tcagtacgagtatgcacgaccggtgctcgatttagtacacacacttagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaatcatgatttatgatgtcactaatcggcctcagggtttctaatcgcttctctggctccaagtctggcaacacggcctccctgaccatctctggctcaggctgagacgagctgattatactgcagctcatatacaagcacagcactctctatgtcttcggaactggaccaaggtcaccgtctaggtcagcccaaggccaaccctacg

SEQ ID NO: 198846 - DNA, 320 bp, Homo sapiens
  misc_feature: GYAE6OF02F4744.18.59.F04.1.454.CMB.1.raw
  modified_base (317)..(320): a, c, t, g, unknown or other
  misc_feature (317)..(320): n is a, c, g, or t
tcagtacgagtatgcacgaccggtgctcgatttagtacacacacttagggattggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaacatcggaagtcagcccaaggctgccccctcggtcactctgttcccgcctcctccatactcgtactgagcgggctggcaaggcgcatagnnnn

SEQ ID NO: 198847 - DNA, 501 bp, Homo sapiens
  misc_feature: GYAE6OF02HK21W.18.59.F04.1.454.CMB.1.raw
  modified_base (323)..(323): a, c, t, g, unknown or other
  misc_feature (323)..(323): n is a, c, g, or t
  modified_base (364)..(364): a, c, t, g, unknown or other
  misc_feature (364)..(364): n is a, c, g, or t
tcagtacgagtatgcacgaccggtgctcgatttagtacacacacttagggattggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaaatcatgatttatgatgtcactaatcggccctnaggggtttctaatcgcttctctggctccaagtctggcaacncggcctcctgaccatctctgggctccaggctgaggacgaggctgattattactgcagctcatatacagcaccagcactctctatgtcttcggaactggaccaggtcaccgtctaggtcagcccaaggcccaaccctc

SEQ ID NO: 198848 - DNA, 320 bp, Homo sapiens
  misc_feature: GYAE6OF02FWW4C.18.59.F04.1.454.CMB.1.raw
  modified_base (317)..(320): a, c, t, g, unknown or other
  misc_feature (317)..(320): n is a, c, g, or t
tcagtacgagtatgcacgaccggtgctcgatttagtacacacacttagggattggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaacatcggaagtcagcccaaggctgccccctggtcactctgttcccaccctcctccatactcgtactgagcgggctggcaaggcgcatagnnnn

SEQ ID NO: 198849 - DNA, 509 bp, Homo sapiens
  misc_feature: GYAE6OF02HXF6V.18.59.F04.1.454.CMB.1.raw
  modified_base (507)..(509): a, c, t, g, unknown or other
  misc_feature (507)..(509): n is a, c, g, or t
tcagtacgagtatgcacgaccggtgctcgatttagtacacacacttagggattggggagagagacccctcccctgggatcctgggcccagtctgccctgactcagcctgcctccgtgtctgggtctcctggacagtcgatcaccatctcctgcactggaaccagcagtgacgttggtggttataactatgtctcctggtaccaacagcacccaggcaaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttacggaactgggaccaaggtccaccgtcctaggtcagcccaaggcccaacccatcgtcactctcgttccccgccctcctccatacctcgtactgcgcgggctggcaggcacatgnnn

SEQ ID NO: 198850 - DNA, 659 bp, Homo sapiens
  misc_feature: GYAE6OF02IC2L5.18.59.F04.1.454.CMB.1.raw
  modified_base (235)..(235): a, c, t, g, unknown or other
  misc_feature (235)..(235): n is a, c, g, or t
  modified_base (510)..(510): a, c, t, g, unknown or other
  misc_feature (510)..(510): n is a, c, g, or t
tcagtacgagtatgcacgaccggtgctcgatttagtacacacacttagggattgggggggtctcaggaggcagcgctctcgggacgtctccaccatggcctgggctctgctattcctcacccctctcactcgaggcacgacggtccgtcggcccagtctcgccctgacctcgacgtcctcgcccttccgtgtcgttcgggtcctccgtaggactcgtcgatccacctatcctccngctacgtacggaaccagctagtcgtacggtttgggttagttaactaaacttgtgttccttcgttacggtaaaccaacgacgccaaccgaggaaccaaacccgaccccaaactacagtacgttaatttagagtaattcgtacctaactaacgtccgtcctacggttacgggtttactagtccgtcttctcgtgctactagtcgtgacacgacgcctcctagactctctcgtggcctcgagtctaggacggtacgacgtctagtatttacgttacgngaccagtctacgtaattaactaacaacgtacccaaccggtacaccttaacctccttacttagttccgtacgttaccggtacgtacgggaaccgtaaggtccctaacccgtcgttacgaccgaccgaccccggaaccgacccaaccctcg

SEQ ID NO: 198851 - DNA, 521 bp, Homo sapiens
  misc_feature: GYAE6OF02G07X3.18.59.F04.1.454.CMB.1.raw
  modified_base (176)..(176): a, c, t, g, unknown or other
  misc_feature (176)..(176): n is a, c, g, or t
  modified_base (193)..(193): a, c, t, g, unknown or other
  misc_feature (193)..(193): n is a, c, g, or t
  modified_base (268)..(268): a, c, t, g, unknown or other
  misc_feature (268)..(268): n is a, c, g, or t
  modified_base (352)..(352): a, c, t, g, unknown or other
  misc_feature (352)..(352): n is a, c, g, or t
  modified_base (479)..(479): a, c, t, g, unknown or other
  misc_feature (479)..(479): n is a, c, g, or t
  modified_base (513)..(513): a, c, t, g, unknown or other
  misc_feature (513)..(513): n is a, c, g, or t
  modified_base (518)..(518): a, c, t, g, unknown or other
  misc_feature (518)..(518): n is a, c, g, or t
tcagtacgagtatgcacgaccggtgctcgatttagtacacacacttagggagttggggctttgcctggtcctgggcccagtctgccctgactcagcctgcctccgtgtctgggtctcctggacagtcgatcacatctcctgcactggaaccagcagtgacgttggtgttataactntgtctcctggtaccaangcacccaggcaaagccccaaatcatgatttatgatgtcagtaatcggcctcaggggtttctaaatcggctttacncttggctccaagtctggccaacacgggccctccctggacccagtcctctgggcctccaggctgaggcgaggctgattagttacngcagctcgatatacaagcagcagcactcaagtctacggaactgggactaagtcaccgtctagtcagcccaaggcccaacctactagtcaactcgtccgttccgcccttccgtcacgttactcgtacngacgtcggctggacaggcacgagtacgtcacgtngtagnacg

SEQ ID NO: 198852 - DNA, 319 bp, Homo sapiens
  misc_feature: GYAE6OF02GGHDI.18.59.F04.1.454.CMB.1.raw
  modified_base (317)..(319): a, c, t, g, unknown or other
  misc_feature (317)..(319): n is a, c, g, or t
tcagtacgagtatgcacgaccggtgctcgatttagtacacacacttagggattggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaacatcggaagtcagcccaaggctgccccctggtcactctgttcccgccctcctccatactcgtactgagcgggctggcaaggcgcatagnnn

SEQ ID NO: 198853 - DNA, 496 bp, Homo sapiens
  misc_feature: GYAE6OF02FXDDV.18.59.F04.1.454.CMB.1.raw
tcagtacgagtatgcacgaccggtgctcgatttagtacacacacttagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggcctcagggtttctaatcgcttctctggctcaagtctggcaacacggcctccctgaccatctctggctccaggctgaggacgaggctgattatactgctagctcatatacaagcacagcactctctatgtcttcggactgggaccaggtcaccgtctagtcagcccaaggcccacctc

SEQ ID NO: 198854 - DNA, 545 bp, Homo sapiens
  misc_feature: GYAE6OF02FT1XC.18.59.F04.1.454.CMB.1.raw
  modified_base (447)..(447): a, c, t, g, unknown or other
  misc_feature (447)..(447): n is a, c, g, or t
tcagtacgagtatgcacgaccggtgctcgatttagtacacacacttagggattggggagctctgggagaggagccccagccttgggattcccaagtgttttcattcagtgatcaggactgaacacagaggactcaccatggagtttgggctgagcgtgagtttcctaggctgctatttaaaggtgtccagtgtgaggtgcagctggtggagtctgggggaggcttggtaaagccggggggtcccttagactcccctgtacagcctctggattcactttcagtaaggcctggatgaactgggtccgccaggctccgagggagggctggagtgggtgccgtattaaaccaaactgatggtgggacaacagactacgctgcaccgtgaaaggcagattcaccatctcaaagagatagattacaaaaagcaacgctgtatctagacaaatnaacagacctgaacgaaccgagaacacgagccgtagtaattacgtagtaccacactccccagaacgcgtacactactactaactacggtatcgactcgg

SEQ ID NO: 198855 - DNA, 503 bp, Homo sapiens
  misc_feature: GYAE6OF02HMNL4.18.59.F04.1.454.CMB.1.raw
  modified_base (321)..(321): a, c, t, g, unknown or other
  misc_feature (321)..(321): n is a, c, g, or t
tcagtacgagtatgcacgaccggtgctcgatttagtacacacacttagggattgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcaccaggcaaagccccaaaactcatgatttatgatgtcactaatcggccctnagggtttctaatcgcttctctggctcaagtctggcaacacggcctccctgaccatctctgggctccaggctgaggacgaggctgattattactgcagctcatatacaagcaccagcactctctatgtcttcggaactgggaccaaggtcaccgtctacggtcagcccaaggcccaaccctac

SEQ ID NO: 198856 - DNA, 320 bp, Homo sapiens
  misc_feature: GYAE6OF02GIHUT.18.59.F04.1.454.CMB.1.raw
  modified_base (191)..(191): a, c, t, g, unknown or other
  misc_feature (191)..(191): n is a, c, g, or t
  modified_base (316)..(320): a, c, t, g, unknown or other
  misc_feature (316)..(320): n is a, c, g, or t
tcagtacgagtatgcacgaccggtgctcgatttagtacacacacttagggattggggagagaagacaggattcaggacaatctccagcatggccggcttccctctcctcctcaccctcctcactcactgtgcagggtcctgggcccagtctgtgctgactcagccaccctcagcgtctgggacccccgggnagagggtcaccatctcttgttctggaagcagctccaacatcggaagtcagcccaaggctgccccctggtcactctgttcccacctcctccatactcgtactgagcgggctggcaaggcgcatagnnnnn

SEQ ID NO: 198857 - DNA, 502 bp, Homo sapiens
  misc_feature: GYAE6OF02HJZDS.18.59.F04.1.454.CMB.1.raw
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgattatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaaccaggtcaccgtcaggtcagcccaggacccc

SEQ ID NO: 198858 - DNA, 500 bp, Homo sapiens
  misc_feature: GYAE6OF02GT56Q.18.59.F04.1.454.CMB.1.raw
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtacaaacagcacccaggcaaagcccccaaactcatgatttatgatgtcactaatcggccctcaggggtttctaatcgcttctctggctccaagtctggcaacacgacctccctgaccatctctgggctccaggctgaggacgaggctgattattactgcagctcatatacaagcaccagcactctctatgtcttcggaactgggaccaggtcaccgtctaggtcagcccagccc

SEQ ID NO: 198859 - DNA, 460 bp, Homo sapiens
  misc_feature: GYAE6OF02I49GY.18.59.F04.1.454.CMB.1.raw
  modified_base (451)..(460): a, c, t, g, unknown or other
  misc_feature (451)..(460): n is a, c, g, or t
tcagtacgagtatgcacgaccggtgctcgatttagtacacacacttagggattgggggctttgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtctaggtcagcccaaggccaacccactcgtcactctcgttcccaccctcctccatacctcgtactgacgcgggctggcaaggcgcatagnnnnnnnnnn

SEQ ID NO: 198860 - DNA, 470 bp, Homo sapiens
  misc_feature: GYAE6OF02HYENX.18.59.F04.1.454.CMB.1.raw
  modified_base (452)..(470): a, c, t, g, unknown or other
  misc_feature (452)..(470): n is a, c, g, or t
tcagtacgagtatgcacgaccggtgctcgatttagtacacacacttagggattgggggctttgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacagcaccagcactctctatgtcttcggaactgggaccaaggtcaccgtcctaggtcacgccaaggcccaacccactgtccactctcgttcccaccctcctccatacctcgtactgacgcgggctggcaaggcgcatagnnnnnnnnnnnnnnnnnnn

SEQ ID NO: 198861 - DNA, 581 bp, Homo sapiens
  misc_feature: GYAE6OF02IXNYL.18.59.F04.1.454.CMB.1.raw
  modified_base (417)..(417): a, c, t, g, unknown or other
  misc_feature (417)..(417): n is a, c, g, or t
tcagtacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggatttccttgctgctatttaaaggtgtccagtgtgaggtgcagctggtggagtcgtgggggaggcgttggtaaaggccgggggggttcccttaggaccttcccctgtacagcctctggattcactttcagtaacggcctggatgaactgggtccgccaggctccgagggaggggctggagtgggttggccgtataaaaccaaatgatggtggacacagactacgctgcaccgtgaaaggcagattcaccatctacaaganatgataacaaaagcacgctagtactctagacaaagtgaacagcctaggaaccgaaaccggaggaaccaacgaccggtccgtaggttaaacttaccgtactacccactaaccgtcccgtaagaaccgtctacaactaactactacgtacgtatacgacctacggg

SEQ ID NO: 198862 - DNA, 507 bp, Homo sapiens
  misc_feature: GYAE6OF02GC273.18.59.F04.1.454.CMB.1.raw
tcagtacgagtatgcacgaccggtgctcgatttagtacacacacttagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcagggtttctaatcgcttctctggctccaagtctggcaacacggcctccctgaccatctctgggctccaggctgaggacgaggctgattatactgcagctcatatacaagcaccagcactctctatgtcttcggaactgggaccaaggtccaccgtctaggtcagcccaaggccccaaccctcg

SEQ ID NO: 198863 - DNA, 497 bp, Homo sapiens
  misc_feature: GYAE6OF02HHT2U.18.59.F04.1.454.CMB.1.raw
  modified_base (417)..(417): a, c, t, g, unknown or other
  misc_feature (417)..(417): n is a, c, g, or t
  modified_base (496)..(496): a, c, t, g, unknown or other
  misc_feature (496)..(496): n is a, c, g, or t
tcagtacgagtatgcacgaccggtgctcgatttagtacacacacttagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggcctcaggggtttctaatcgcttctctggctccaagtctggcaacacggcctcctgaccatctctgggctccaggctgaggacgaggctgattattacngcagctcatatacaagcaccagcactctctatgtcttggactgggaccaggtcacgtcaggtcagcccagcccaacccnc

SEQ ID NO: 198864 - DNA, 523 bp, Homo sapiens
  misc_feature: GYAE6OF02GSOJD.18.59.F04.1.454.CMB.1.raw
  modified_base (448)..(448): a, c, t, g, unknown or other
  misc_feature (448)..(448): n is a, c, g, or t
  modified_base (513)..(514): a, c, t, g, unknown or other
  misc_feature (513)..(514): n is a, c, g, or t
  modified_base (516)..(517): a, c, t, g, unknown or other
  misc_feature (516)..(517): n is a, c, g, or t
  modified_base (520)..(520): a, c, t, g, unknown or other
  misc_feature (520)..(520): n is a, c, g, or t
tcagtacgagtatgcacgaccggtgctcgatttagtacacacacttagggagttggggctttgcctggtcctgggcccagtctgccctggtacgtcgagcctgcctccgtgtctgggtctcctggacagtcgatcaccactctcctgccactggaaccagcagtgacgttggtggttataactatgtctcctggtaccaacagcacccaggccaaacgcccccaaactcatgactttatgatgtcagtaatcggccctcaggggtttctaatcgcttctctggcttccaagtctggcaacacggcctccctgacccatctctgggcctccaggctcgaggacgaggctgatttattaactgtcagctcatagtaccaagcagcagcactcaagtcttcggaactgggaccaaggtcaccgtcctaggtcagcccaaggcccaacccgntcgcactctcgtcccaccctctccatacctcgtactgacgcggctggaccaagggcgcgatacgnngnngtngag

SEQ ID NO: 198865 - DNA, 542 bp, Homo sapiens
  misc_feature: GYAE6OF02J07CU.18.59.F04.1.454.CMB.1.raw
  modified_base (290)..(290): a, c, t, g, unknown or other
  misc_feature (290)..(290): n is a, c, g, or t
  modified_base (300)..(300): a, c, t, g, unknown or other
  misc_feature (300)..(300): n is a, c, g, or t
  modified_base (524)..(524): a, c, t, g, unknown or other
  misc_feature (524)..(524): n is a, c, g, or t
  modified_base (538)..(538): a, c, t, g, unknown or other
  misc_feature (538)..(538): n is a, c, g, or t
  modified_base (540)..(542): a, c, t, g, unknown or other
  misc_feature (540)..(542): n is a, c, g, or t
tcagtacgagtatgcacgaccggtgctcgatttagtacacacacttagggattggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggcctcaggggtttctaatcgcttctctggctccaagtctggcaacncggcctcccngaccatctctgggctccaggctgaggcgaggctgattattactgcagctcaatatacaagcaaccagccaacttctctatcgtcttacggactcgggaaccaaggtccaccgtctacggtcacgcccaaggcccaacccactcgtaccacctcctcgttcccctaccctcctacctactaccttacgtaccgtcgacggtccgggcttcggacctaacgggccncgaattacgctacncnnn

SEQ ID NO: 198866 - DNA, 547 bp, Homo sapiens
  misc_feature: GYAE6OF02I1W9K.18.59.F04.1.454.CMB.1.raw
  modified_base (371)..(371): a, c, t, g, unknown or other
  misc_feature (371)..(371): n is a, c, g, or t
  modified_base (539)..(539): a, c, t, g, unknown or other
  misc_feature (539)..(539): n is a, c, g, or t
  modified_base (541)..(541): a, c, t, g, unknown or other
  misc_feature (541)..(541): n is a, c, g, or t
  modified_base (544)..(544): a, c, t, g, unknown or other
  misc_feature (544)..(544): n is a, c, g, or t
tcagtacgagtatgcacgaccggtgctcgatttagtacacacacttagggattgggggctttgcctgggtcctgggcccagtctgccctgactcagacctgcctccgtgtctgggtctcctggacagtcgatcgaccatctcctgcactgggaaccagcagtgacgttggtaggttataacctatcgtctcctggtaccaacgagcacccaggcgaaagcccccaaaacgtcaatggactttagtcgatgtcactaatcggcctcaggggttctaatcggtccttctacttggctccaagtctgggcaacacggcctcccctgaccatacgtctgggctccgaggctgaggacgaggctagattaattacngcagctcgatatacaagcaccagcactctctatgtcgttccggaactgggaccaaggtcaccgtcctaggtcaggcccaaggcccaaacccatcgtcaacttcctgttccccaccctcctccataccttcgtactgacggcgggctcggacaaggcgacgaagtcggntnatnatc

SEQ ID NO: 198867 - DNA, 507 bp, Homo sapiens
  misc_feature: GYAE6OF02JC53W.18.59.F04.1.454.CMB.1.raw
  modified_base (307)..(307): a, c, t, g, unknown or other
  misc_feature (307)..(307): n is a, c, g, or t
  modified_base (422)..(422): a, c, t, g, unknown or other
  misc_feature (422)..(422): n is a, c, g, or t
  modified_base (444)..(444): a, c, t, g, unknown or other
  misc_feature (444)..(444): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaatcatgatttangatgtcactaatcggccctcaggggtttctaatcgcttctctggctccaagtctggcaacacggcctccctgaccatctctgggctccaggctggagacgaggctgattattacngcagctcatatacaagcaaccngcatctctatcgtcttcggaactgggacctaggtccaccgtctaggtcacgcccaaggacccc

SEQ ID NO: 198868 - DNA, 508 bp, Homo sapiens
  misc_feature: GYAE6OF02GFGMQ.18.59.F04.1.454.CMB.1.raw
tcagtacgagtatgcacgaccggtgctcgatttagtacacacacttagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattatactgcagctcatatacaagcaccagcactctctatgtcttcggaactgggaccaaggtcaccgtctaggtcacgcccaaggcccaaccctacg

SEQ ID NO: 198869 - DNA, 508 bp, Homo sapiens
  misc_feature: GYAE6OF02GNLXG.18.59.F04.1.454.CMB.1.raw
  modified_base (323)..(323): a, c, t, g, unknown or other
  misc_feature (323)..(323): n is a, c, g, or t
tcagtacgagtatgcacgaccggtgctcgatttagtacacacacttagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaatcatgatttatgatgtcactaatcggccctnaggggtttcaatcgcttctctggctccaagtctggcaacacggcctccctgaccatctctgggcctccaggctggaggacgaggctgattatactgcagctcatatacaagcaccagcactctctatgtcttcggaactgggacctaaggtcaccgtcaggtcacgacccgaggcccaaccctcg

SEQ ID NO: 198870 - DNA, 549 bp, Homo sapiens
  misc_feature: GYAE6OF02JZ41D.18.59.F04.1.454.CMB.1.raw
tcagtacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggatttccttgctgctattttaaaggtgtccagtgtgaggtgcagctggtggagtctgggggaggcttggtaaagccggggggtcccttaggactcccctgtacagcctctggattcactttcagtaaggcctggatgaactgggtccgccaggctccgagggaagggctggagtgggtggccgtataaaaccaaactgatggtggacaacagactacgctgcacccgtgaaaggcagattcaccatctcaagagatgattcaaaagcacgctgtatctagacaaatgaacagcctagacgaaccgaggaccacagacccgtagtaacttactcgtaccactactcccctagaaacgccgtacaactactactactacggtatcggacctcgg

SEQ ID NO: 198871 - DNA, 320 bp, Homo sapiens
  misc_feature: GYAE6OF02FYAZ1.18.59.F04.1.454.CMB.1.raw
  modified_base (318)..(320): a, c, t, g, unknown or other
  misc_feature (318)..(320): n is a, c, g, or t
tcagtacgagtatgcacgaccggtgctcgatttagtacacacacttagggattggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaacatcggaagtcagcccaaggctgccccctcggtcactctgttccccgcctcctccatactcgtactgagcgggctggcaaggcgcatagnnn

SEQ ID NO: 198872 - DNA, 503 bp, Homo sapiens
  misc_feature: GYAE6OF02GJU9A.18.59.F04.1.454.CMB.1.raw
  modified_base (369)..(369): a, c, t, g, unknown or other
  misc_feature (369)..(369): n is a, c, g, or t
tcagtacgagtatgcacgaccggtgctcgatttagtacacacacttagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcagggttctaatcgcttctctggctcaagtctggcacacgcctccngaccatctctgggctccaggctgaggacgaggctgattatactgcagctcatatacagcacagcactctctatgtcgttcgaactgggaccaaggtccaccgtcgtaggtccagcccaaggcccaacccctacg

SEQ ID NO: 198873 - DNA, 507 bp, Homo sapiens
  misc_feature: GYAE6OF02HA661.18.59.F04.1.454.CMB.1.raw
  modified_base (423)..(423): a, c, t, g, unknown or other
  misc_feature (423)..(423): n is a, c, g, or t
  modified_base (447)..(447): a, c, t, g, unknown or other
  misc_feature (447)..(447): n is a, c, g, or t
tcagtacgagtatgcacgaccggtgctcgatttagtacacacacttagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggcctcaggggtttctaatcgcttctctggctccaagtctggcaacacggcctccctgaccatctctgggctccaggctgaggcgaggctgattatactgcagctnatatacaagcaccagcactctctntgtcttcggaactgggacctaggtcaccgtctaggtcacgcccaacggcccaaccctacg

SEQ ID NO: 198874 - DNA, 522 bp, Homo sapiens
  misc_feature: GYAE6OF02GZMVL.18.59.F04.1.454.CMB.1.raw
  modified_base (248)..(248): a, c, t, g, unknown or other
  misc_feature (248)..(248): n is a, c, g, or t
  modified_base (253)..(253): a, c, t, g, unknown or other
  misc_feature (253)..(253): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttanaactntgtctcctggtaccaacagcaccaggcaaacgcccccaaactcatgatttatgatgtcagtaatcgcctcagggtttctaagtcgcttctctggctcaagtctggcaacacgcctccctgaccatctctggctccgaggctgaggacgaggctgattattactgcagctacatatacaagcacagcactctactatcgttcttacggaacgtcgggacctaaggtccaaccgttccgtacggtcacgaccccaaggccccaacccgtcg

SEQ ID NO: 198875 - DNA, 503 bp, Homo sapiens
  misc_feature: GYAE6OF02GJOZV.18.59.F04.1.454.CMB.1.raw
  modified_base (303)..(303): a, c, t, g, unknown or other
  misc_feature (303)..(303): n is a, c, g, or t
  modified_base (444)..(444): a, c, t, g, unknown or other
  misc_feature (444)..(444): n is a, c, g, or t
  modified_base (500)..(500): a, c, t, g, unknown or other
  misc_feature (500)..(500): n is a, c, g, or t
tcagtacgagtatgcacgaccggtgctcgatttagtacacacacttagggattggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttangatgtcactaatcggccctcgagggtttctaatcgcttctctgctccaagtctggcaacacgcctccctgaccatctctgggctccaggctgaggacgaggctgatttattactgcagctcatatacaagcagcagcactnaagtctacggaactgggaccaaggtcaccgtctaggtcagcccaaggcccaacccntcg

SEQ ID NO: 198876 - DNA, 510 bp, Homo sapiens
  misc_feature: GYAE6OF02HKNYX.18.59.F04.1.454.CMB.1.raw
  modified_base (324)..(324): a, c, t, g, unknown or other
  misc_feature (324)..(324): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcctggtaccaacagcacccaggcaaagcccccaaactcatgatttatgatgtcactaatcggccctnagggtttctaatcgcttctctggctccaagtctggcaacacggcctccctgaccatctctgggctccaggctggaggacgaggctgatttatactgcagctcatatacagcaccagccactctctatgtcttacggacgtgggaccaaggtccaccgtctaggtcacgcccaacggcccaaccctc

SEQ ID NO: 198877 - DNA, 747 bp, Homo sapiens
  misc_feature: GYAE6OF02JYKCW.18.59.F04.1.454.CMB.1.raw
  modified_base (320)..(320): a, c, t, g, unknown or other
  misc_feature (320)..(320): n is a, c, g, or t
tcagtacgagtatgcacgaccggtgctcgatttagtacacacacttagggagttcgggggctggggtctccaggaggcagccgctctcgggacgtctccaccatggcctgggctctgctattcctcaccctctcactcagggcacagggtcctgggcccagtcctgccctgactcagcctgcctccggtgtctgggtctaccgtggaccaggtccgatcaccattcctcctgcactggaaccagcagtgacgttggtgttataactatgtctcgtggtaccaacagccacccaggcaaacgccccaaatcgatgatttangatgacaactaagtccggcccctacgtaggggttttacctaacgtccgtcgttcctcgtcgggtacctttaccgtaacgttccgttacgggtaccaaacccgtacccgggtcccttaccccgttacggaaccctaacttccgtttaccggttcggggtcccctacccgagggtccgttacggaacggggtaccggtacgggactttacgggtaaactttttaacgttaaccggttcggacgtaacgggtaccttacgttaacgttaaccgttacgtaaacggtccctaaccgacggtccctaaacgttccggtttacaacgtttcggttacgttacccggggtaacgttccggggtaacccggtaacgggttcccgtaacccggttcgttaacggtaccgaccggtaccccgaacggtaaccccccg

SEQ ID NO: 198878 - DNA, 321 bp, Homo sapiens
  misc_feature: GYAE6OF02G6C0N.18.59.F04.1.454.CMB.1.raw
  modified_base (191)..(191): a, c, t, g, unknown or other
  misc_feature (191)..(191): n is a, c, g, or t
  modified_base (318)..(321): a, c, t, g, unknown or other
  misc_feature (318)..(321): n is a, c, g, or t
tcagtacgagtatgcacgaccggtgctcgatttagtacacacacttagggattggggagagaagacaggattcaggacaatctccagcatggccggcttccctctcctcctcaccctcctcactcactgtgcagggtcctgggcccagtctgtgctgactcagccaccctcagcgtctgggacccccgggnagagggtcaccatctcttgttctggaagcagctccaacatcggaagtcagcccaaggctgccccctggtcactctgttccccgccctcctccatactcgtactgagcgggctggcaaggcgcatagnnnn

SEQ ID NO: 198879 - DNA, 512 bp, Homo sapiens
  misc_feature: GYAE6OF02IMCE7.18.59.F04.1.454.CMB.1.raw
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggcctcaggggtttcaatcgcttctctggctcaagtctggcaacacggcctccctgaccatctctgggctccgaggctgaggacgaggctgattattactgcagctacatatacaagcagcagcactcagttcttacggaactcgggaacaaggtcaccgtacctaggtccacgcccgacgcccaaccccg

SEQ ID NO: 198880 - DNA, 518 bp, Homo sapiens
  misc_feature: GYAE6OF02IIWZB.18.59.F04.1.454.CMB.1.raw
  modified_base (432)..(432): a, c, t, g, unknown or other
  misc_feature (432)..(432): n is a, c, g, or t
  modified_base (514)..(514): a, c, t, g, unknown or other
  misc_feature (514)..(514): n is a, c, g, or t
tcagtacgagtatgcacgaccggtgctcgatttagtacacacacttagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcctggtaccaacagcacccaggacaaacgcccccaaactcatgatttatgatgtcactaatcgccctcgtagggttctaatcgcttctctgtctccaagtctggcaacacgcctccctgaccatctcgtcgggctccgagctggaggacgaggctgattattactgcagctcatanacagcagcagcactacaagtctacggaactgggaaccaacggtcaaccgtccgtaggtcacggacccaacggcccaaccccntacg

SEQ ID NO: 198881 - DNA, 505 bp, Homo sapiens
  misc_feature: GYAE6OF02HB0G0.18.59.F04.1.454.CMB.1.raw
  modified_base (390)..(390): a, c, t, g, unknown or other
  misc_feature (390)..(390): n is a, c, g, or t
  modified_base (499)..(499): a, c, t, g, unknown or other
  misc_feature (499)..(499): n is a, c, g, or t
  modified_base (504)..(505): a, c, t, g, unknown or other
  misc_feature (504)..(505): n is a, c, g, or t
tcagtacgagtatgcacgaccggtgctcgatttagtacacacacttagggattggggagagagacccctcccctgggatcctgggcccagtctgccctgactcagcctgcctccgtgtctgggtctcctggacagtcgatcaccatctcctgcactggaaccagcagtgacgttggtggttataactatgtctcctggtaccaacagcacccaggcaaaagcccccaaaatcaatgatttatgatgtcactaatcggccctcaggggtttctaatcgcttctctggctccaagtctggcaacacggcctccctgaccatctctgggctccaggctgaggacgaggctgattatactgcagctcaatatacaagcaccagcactctctatntcttcgaactggaccaaggtcaccgtctagtcacgccaaggccaacccactcgtcactctcgttcccgcctcctccacttactcgtactgacgcggactggacaggcgnatgcnn

SEQ ID NO: 198882 - DNA, 524 bp, Homo sapiens
  misc_feature: GYAE6OF02IS1GC.18.59.F04.1.454.CMB.1.raw
  modified_base (380)..(380): a, c, t, g, unknown or other
  misc_feature (380)..(380): n is a, c, g, or t
  modified_base (483)..(483): a, c, t, g, unknown or other
  misc_feature (483)..(483): n is a, c, g, or t
  modified_base (521)..(521): a, c, t, g, unknown or other
  misc_feature (521)..(521): n is a, c, g, or t
  modified_base (523)..(524): a, c, t, g, unknown or other
  misc_feature (523)..(524): n is a, c, g, or t
tcagtacgagtatgcacgaccggtgctcgatttagtacacacacttagggattggggcgtttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaaagccccccaaactcatgatttatgatgtcactaatcggccctcaggggtttctaatcgcttctctggcctccaagtctggcaacacggcctccctgacccatctctgggctccgaggcctgaggacgaggctgacttatactgcagctcatatacaagcaccagcactcnctatgtcttcggaactgggaccaaggtccaccgtctaggtcacgcccaaacggcccaacccatcgtcaccttctccgttcccgccctcctccatcctcgtacngacgccgggctcgggactaacggccgacactagcgcancnn

SEQ ID NO: 198883 - DNA, 542 bp, Homo sapiens
  misc_feature: GYAE6OF02I94DO.18.59.F04.1.454.CMB.1.raw
  modified_base (305)..(305): a, c, t, g, unknown or other
  misc_feature (305)..(305): n is a, c, g, or t
  modified_base (444)..(444): a, c, t, g, unknown or other
  misc_feature (444)..(444): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttangatgtcactaatcggccctcgaggggtttctaatcgcttctctggctccaagtctggacaacacggccctccctgacctatctcgtcgggcctccgaggctaggaggacgaggtctagtatttagttactgacagtctnatatacaagcaccagcaactcaagtcttacggactcggaccgaacggtccaccgtacctaggtccacggccctaacggacccaacccgtactcgtacc

SEQ ID NO: 198884 - DNA, 480 bp, Homo sapiens
  misc_feature: GYAE6OF02ICT3K.18.59.F04.1.454.CMB.1.raw
  modified_base (460)..(480): a, c, t, g, unknown or other
  misc_feature (460)..(480): n is a, c, g, or t
tcagtacgagtatgcacgaccggtgctcgatttagtacacacacttagggattgggggctttgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtccaccgtctaggtcagcccaaggcccaacccactcgtccactcctgttccccgccctcctccatacctcgtactgacgcgggctcggcaacgggcgacagtagnnnnnnnnnnnnnnnnnnnnn

SEQ ID NO: 198885 - DNA, 511 bp, Homo sapiens
  misc_feature: GYAE6OF02HYJ73.18.59.F04.1.454.CMB.1.raw
  modified_base (304)..(304): a, c, t, g, unknown or other
  misc_feature (304)..(304): n is a, c, g, or t
tcagtacgagtatgcacgaccggtgctcgatttagtacacacacttagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaaatcatgatttangatgtcactaatcggccctcgagggtttcaatcgctttctctggctccaagtctggcaacacgcctccctgacccatctctgggctccgaggctgaggacgaggctgattattactgcagctcatatacaagcaccagcactctatatgtcttcggaactgggaccaaggtccaccgtctaggtcacgacccaaggccccaaccacg

SEQ ID NO: 198886 - DNA, 504 bp, Homo sapiens
  misc_feature: GYAE6OF02ILAIP.18.59.F04.1.454.CMB.1.raw
  modified_base (500)..(504): a, c, t, g, unknown or other
  misc_feature (500)..(504): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaaagccccccaaaactcatgatttatgatgtcactaatcggccctcaggggtttctaatcgcttctctggctccaagtctggcaacacggcctccctgaccatctctgggctccaggctgaggacgaggctgattatactgcagctcatatacaagcaccagccactctctatgtctcggaactgggaccaaggtcaccgtcctaggtcagcccaagcccaaccccactcgtcactctcgttcccaccctcctccatactcgtactgacgcggctggcaaggcgacatagcnnnnn

SEQ ID NO: 198887 - DNA, 520 bp, Homo sapiens
  misc_feature: GYAE6OF02FHO6V.18.59.F04.1.454.CMB.1.raw
  modified_base (231)..(231): a, c, t, g, unknown or other
  misc_feature (231)..(231): n is a, c, g, or t
  modified_base (391)..(391): a, c, t, g, unknown or other
  misc_feature (391)..(391): n is a, c, g, or t
  modified_base (428)..(428): a, c, t, g, unknown or other
  misc_feature (428)..(428): n is a, c, g, or t
  modified_base (459)..(459): a, c, t, g, unknown or other
  misc_feature (459)..(459): n is a, c, g, or t
  modified_base (463)..(463): a, c, t, g, unknown or other
  misc_feature (463)..(463): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtggttataactatgtctcctggtaccaacagcaccccaggccaaagccccccaaactcatgatttatgatgtcactaatcggccctcaggggtttctaatcgcttctctggctccaagtctggcaacacggcctccctgacccatcnctgggcctccaggctgaggacgaggctgatttatacngcagctcatactacaagcaccagcaacttcnctangtcttacggactcgggaaccaaggtccaccgttcctaggtcacggacccaggacccc

SEQ ID NO: 198888 - DNA, 604 bp, Homo sapiens
  misc_feature: GYAE6OF02JRPYP.18.59.F04.1.454.CMB.1.raw
  modified_base (230)..(230): a, c, t, g, unknown or other
  misc_feature (230)..(230): n is a, c, g, or t
  modified_base (252)..(252): a, c, t, g, unknown or other
  misc_feature (252)..(252): n is a, c, g, or t
  modified_base (300)..(300): a, c, t, g, unknown or other
  misc_feature (300)..(300): n is a, c, g, or t
tcagtacgagtatgcacgaccggtgctcgatttagtacacacacttagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcgaccatctcctgccacgtggaaccngcagtgacgttggtgtatactntgtctctgtacacagcaccaggcaaacgcccccaaactcatgtattangatgtacactaatccggccctacgtaggggtttactaatcgtacttctctggtctacctaagtctggacaacgaccgcctcctgaccatctacgtcgggcctccgacggctaggaacgggacggtaacggcctagtaactttacgttacgtgtaccagtacctactaagtaactaacgaacgtacacgtacacgtacacgtaccaaggttcctaccgggaacttacggggaacctaagggtccctaaccgtacccggttaggacccgtaacggaccccgaaggtacccctaaccccgagttccg

SEQ ID NO: 198889 - DNA, 498 bp, Homo sapiens
  misc_feature: GYAE6OF02GVEFE.18.59.F04.1.454.CMB.1.raw
  modified_base (367)..(367): a, c, t, g, unknown or other
  misc_feature (367)..(367): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcagggtttctaatcgcttctctggctcaagtctggcaacncggcctcctgaccatctctgggctccaggctgaggacgaggctgatttattactgcagctcatatacaagcaccagcactctctatgtctcggaactgggaccaggtcacgtctaggtcagcccaagcccc

SEQ ID NO: 198890 - DNA, 568 bp, Homo sapiens
  misc_feature: GYAE6OF02JZ44C.18.59.F04.1.454.CMB.1.raw
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgcccccaaactcatgatttatgatgtcactaactcggccctcgtacggggtttactaatcgtcttctctggctccaagtctggacaacgaccggcctaccctgacctatcgtctgggctccaggctggacggacgaggctgtattatactgacagctatatatacaagccaacacgacacctctactatcgttaccttacggaacgtcgggaaccgtaacggttcccaacccggttccgtaacggtaccgaccgaaccccgaacggtaccccaaccccgtacg

SEQ ID NO: 198891 - DNA, 590 bp, Homo sapiens
  misc_feature: GYAE6OF02H2DHP.18.59.F04.1.454.CMB.1.raw
  modified_base (268)..(268): a, c, t, g, unknown or other
  misc_feature (268)..(268): n is a, c, g, or t
  modified_base (431)..(431): a, c, t, g, unknown or other
  misc_feature (431)..(431): n is a, c, g, or t
tcagtacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcgttgggtaaaggccggggggtcccttaggacctcccctgtacngcctctggattccacttttcagtaacggcctggatgaactgggtccgccgaggcctccgaggggaaggggctgggagtgggttggccgtaattaaaaccgaaacgtgatgggtaggacaacagactacgctgacaccgtgaagcagattcacatctacaaganatgaattacaaaaagcaacgctagtactctagactaaatgaacagcctagaacgaaccgaggaacacgacgccgtagtacttacgtgtacccaactctaccccgagaaacgtcgtacaacctacttaacctaccgttacggtactacggaccctacggg

SEQ ID NO: 198892 - DNA, 558 bp, Homo sapiens
  misc_feature: GYAE6OF02HGU2B.18.59.F04.1.454.CMB.1.raw
  modified_base (228)..(228): a, c, t, g, unknown or other
  misc_feature (228)..(228): n is a, c, g, or t
  modified_base (427)..(427): a, c, t, g, unknown or other
  misc_feature (427)..(427): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataactatgtctctggtaccaacagcaccaggcaaacgcccccaaaactcatgatttatgatgtcactaatcgccctgtagggtttctaatcgacttctctgtctcaagtctggcaacacgcctccctgaccatctctcgggctccgaggcctgacggacgacggctgtaattaatttacgngcagctcataataacacgacaccgagccacgtccttactatccgttcgttacggaaccgtcgggaacctaagggtaccacccggttacgtacgggtacctacgaccccgtaacggacccctaaccctaccg

SEQ ID NO: 198893 - DNA, 493 bp, Homo sapiens
  misc_feature: GYAE6OF02JGXWP.18.59.F04.1.454.CMB.1.raw
  modified_base (457)..(457): a, c, t, g, unknown or other
  misc_feature (457)..(457): n is a, c, g, or t
  modified_base (464)..(464): a, c, t, g, unknown or other
  misc_feature (464)..(464): n is a, c, g, or t
  modified_base (487)..(487): a, c, t, g, unknown or other
  misc_feature (487)..(487): n is a, c, g, or t
  modified_base (492)..(492): a, c, t, g, unknown or other
  misc_feature (492)..(492): n is a, c, g, or t
tcagtacgagtatgcacgaccggtgctcgatttagtacacacacttagggattggggagagagacccctccctgggatcctgggcccagtctgccctgactcagcctgcctccgtgtctggatctcctggacagtcgatcaccatctcctgcactggaaccagcagtgacgttggtggttataactatgtctcctggtaccaacagcacccaggcaaagccccaaatcatgatttatgatgtcactaatcggcctcaggggtttctaatcgcttctctggctccaagtctggcaacacggcctcctgaccatctctgggctccaggctgaggacgaggctgattattactgcagctcatatacaagcaccagcactctctatgtctcggaactgggaccaaggtcacgtcctaggtcagcccaagccaacccatcgtcactctcgttcccgccctcnccatacncgtactgacgcggctggcaggcncatgnc

SEQ ID NO: 198894 - DNA, 519 bp, Homo sapiens
  misc_feature: GYAE6OF02IR6IM.18.59.F04.1.454.CMB.1.raw
  modified_base (252)..(252): a, c, t, g, unknown or other
  misc_feature (252)..(252): n is a, c, g, or t
  modified_base (321)..(321): a, c, t, g, unknown or other
  misc_feature (321)..(321): n is a, c, g, or t
  modified_base (358)..(358): a, c, t, g, unknown or other
  misc_feature (358)..(358): n is a, c, g, or t
  modified_base (435)..(435): a, c, t, g, unknown or other
  misc_feature (435)..(435): n is a, c, g, or t
  modified_base (449)..(449): a, c, t, g, unknown or other
  misc_feature (449)..(449): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactntgtctctggtaccaacagcaccaggcaaagcccccaaactcatgatttatgatgtcactaatcgccctnagggtttctaatcgcttctctgctcagtctggcaacncggcctcctgacctatctcgtcgggcctccgaggctggacggacgaggctgtattatactgcagctcatactaacancaaccagcactctntatgtcttacgacgtcgggaccaaggtccaccgtccgtaggtccacgacccgaacggacccaaccctacg

SEQ ID NO: 198895 - DNA, 501 bp, Homo sapiens
  misc_feature: GYAE6OF02HKV63.18.59.F04.1.454.CMB.1.raw
  modified_base (496)..(501): a, c, t, g, unknown or other
  misc_feature (496)..(501): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtctaggtcagcccaaggccaacccactcgtcactctcgttcccgccctcctccactacctcgtactgagccgggctggcaggcgcatagnnnnnn

SEQ ID NO: 198896 - DNA, 502 bp, Homo sapiens
  misc_feature: GYAE6OF02GR5MY.18.59.F04.1.454.CMB.1.raw
  modified_base (489)..(489): a, c, t, g, unknown or other
  misc_feature (489)..(489): n is a, c, g, or t
  modified_base (496)..(502): a, c, t, g, unknown or other
  misc_feature (496)..(502): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtctaggtcagcccaaggcccaaccccactcgtccactcctcgttccccgccctcctccactactcgtactgagcggctggcaggcncagtagnnnnnnn

SEQ ID NO: 198897 - DNA, 503 bp, Homo sapiens
  misc_feature: GYAE6OF02IN80M.18.59.F04.1.454.CMB.1.raw
  modified_base (325)..(325): a, c, t, g, unknown or other
  misc_feature (325)..(325): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcaccaggcaaacgccccaaactcatgatttatgatgtcactaatcgcctnagggttcaatcgctctctgctcagtctgcaacacgcctccctgaccatctctgggctccgaggctggaggacgaggctgattattactgcagctcatatacaagcaccagcactctctatgtcttcggaactgggtaaccaaggtcctaccgtcctaggtccacggacccaggacccc

SEQ ID NO: 198898 - DNA, 502 bp, Homo sapiens
  misc_feature: GYAE6OF02IHNOQ.18.59.F04.1.454.CMB.1.raw
  modified_base (324)..(324): a, c, t, g, unknown or other
  misc_feature (324)..(324): n is a, c, g, or t
  modified_base (414)..(414): a, c, t, g, unknown or other
  misc_feature (414)..(414): n is a, c, g, or t
  modified_base (421)..(421): a, c, t, g, unknown or other
  misc_feature (421)..(421): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaatcatgatttatgatgtcactaatcggccctnagggtttcaatcgcttctctgctccaagtctggcaacacgcctcctgaccatctctgggctccgaggctgagacgaggctgatttatacngcagctnatatacagcacagccatctctatcgtctcggactgggaaccaggtccaccgtctaggtcacgacccaaggcccaaccctcg

SEQ ID NO: 198899 - DNA, 628 bp, Homo sapiens
  misc_feature: GYAE6OF02HPUY4.18.59.F04.1.454.CMB.1.raw
  modified_base (251)..(251): a, c, t, g, unknown or other
  misc_feature (251)..(251): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcaggcacagggtcctgggcccagtctgccctgactcagcctgcctccgtgtctgggtctcctggacagtcgatcaccatctcctgcactggaaccagcagtgacgttggtgttataactntgtctctggtacaacagcaccaggcaaacgccccaaactcatgatttatgatgtcactaactcgccctgtagggtttctaatcgtcttctcgtggtctaccaagttctaggccaacgaccggtccctcccgtcgaacctacttcctcgtcgggcctaccgaggtcgtaggacggacggaggtcttaggtaactttaacttacgtgactacgtcctactaataactaacgaacgaccaaccgacgtacctaacttccgtacttacgttcgttaccgttaacgggtaacggtccgggtaacccgtaacggtcccgtaacccggtaccgttacgggtaccgaaccggtaccccggaaacggtacccctaaccccgtaccg

SEQ ID NO: 198900 - DNA, 575 bp, Homo sapiens
  misc_feature: GYAE6OF02HXPL2.18.59.F04.1.454.CMB.1.raw
  modified_base (228)..(228): a, c, t, g, unknown or other
  misc_feature (228)..(228): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtggttataactatgtctcctggtaccaacagcaccaggcaaacgcccccaaactcatgatttatgatgtcactaatccggccctcgtaggggtttctaatcgtcttctctggctcaagtctggcaacacgcctccctgaccatcctcgtcgggccttccgaggctaggacggacgaggctagatttattactgcagctcaatactaacaagaccaaccagacctactactacctagtcgttccgttacggtaccgtacgggaccctaagggtcccgtaacccgttaccgtacggtaccaccggaccccgaacggaccccctaaccccgttaccc

SEQ ID NO: 198901 - DNA, 573 bp, Homo sapiens
  misc_feature: GYAE6OF02IG00N.18.59.F04.1.454.CMB.1.raw
  modified_base (417)..(417): a, c, t, g, unknown or other
  misc_feature (417)..(417): n is a, c, g, or t
tcagtacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggattttccttgctgctatttaaaggtgtccagtgtgaggtgcagctggtggagtcgtgggggagcgttgggtaaaggccggggggtcccttaggacctcccctgtaccagcctctggattcactttcagtaaggcctaggatgaacgtgggtccgccgaggcctccgaggggacggggctgggaggtgggtggaccgtaagttaaaaccaaacgtgatgggtagggaacaacacgactacgctgcgaccgtagaacgganagtattcaccatctacaagagatagattacaaaaagcaacgctagtattctagacaaatgaacagctagaagaccgagacacgagccgtagtactactcgtaccacactcccagaacgctacaactactactacgtacgtactcggtacctaccgg

SEQ ID NO: 198902 - DNA, 535 bp, Homo sapiens
  misc_feature: GYAE6OF02G9A7J.18.59.F04.1.454.CMB.1.raw
  modified_base (248)..(248): a, c, t, g, unknown or other
  misc_feature (248)..(248): n is a, c, g, or t
  modified_base (306)..(306): a, c, t, g, unknown or other
  misc_feature (306)..(306): n is a, c, g, or t
  modified_base (374)..(374): a, c, t, g, unknown or other
  misc_feature (374)..(374): n is a, c, g, or t
  modified_base (430)..(430): a, c, t, g, unknown or other
  misc_feature (430)..(430): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttanaactatgtctcctggtaccaacagcaccaggacaaacgcccccaaactcatgatttangatgtcagtaatcggccctgagggtttctaatcgcttctctggctccagtctggcaacacgcctcccngacctatcctcgtcggctccgaggctggagacggaggctgattattactgcagctnatatacagcacagcactctctatcgttactcggtaccgtgggaaccctagggtcctacccgtccgttaggaccaccggaccccgaacgggccccaaccccgtacg

SEQ ID NO: 198903 - DNA, 456 bp, Homo sapiens
  misc_feature: GYAE6OF02FNAYW.18.59.F04.1.454.CMB.1.raw
  modified_base (385)..(385): a, c, t, g, unknown or other
  misc_feature (385)..(385): n is a, c, g, or t
  modified_base (442)..(442): a, c, t, g, unknown or other
  misc_feature (442)..(442): n is a, c, g, or t
  modified_base (448)..(456): a, c, t, g, unknown or other
  misc_feature (448)..(456): n is a, c, g, or t
tcagtacgagtatgcacgaccggtgctcgatttagtacacacacttagggattgggggctttgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaaccagcactctctatgtctcggaactgggaccaggtcaccgtctagtcagcccaaggcccaacccntcgtcactctcgttcccgccctcctccatacctcgtactgacgcgggctggcaggcncatagnnnnnnnnn

SEQ ID NO: 198904 - DNA, 539 bp, Homo sapiens
  misc_feature: GYAE6OF02GUZEE.18.59.F04.1.454.CMB.1.raw
  modified_base (254)..(254): a, c, t, g, unknown or other
  misc_feature (254)..(254): n is a, c, g, or t
  modified_base (333)..(333): a, c, t, g, unknown or other
  misc_feature (333)..(333): n is a, c, g, or t
tcagtacgagtatgcacgaccggtgctcgatttagtacacacacttagggagttgggggggtctcaggaggcagcgctctcgggacgtctccaccatggcctgggctctgctattcctctaccctcctcactcagggcacagggtcctgggccctagtctgcccttgacgtcagcctgcctccgtgtactgggtctcctggacagtcgatcaccatctcctgccactggaaccagcagtgacgttggtggttanaactagtgtctcctaggtaccaacagcacccaggcaaagcccccaaactcatgatttatgatgtcactaatcggccctnaggggtttctaatcgcttctctggctccaagtctggcaacacggcctccctgaccatctctcgggctcgaggctgaggacgaggctgattattactgcagctacatataacaagccacagcactctactatcgttcttacggaacgtgggaacctaagggtccaccgttacctaggtccacgccccgaacggtcccaacccctacg

SEQ ID NO: 198905 - DNA, 500 bp, Homo sapiens
  misc_feature: GYAE6OF02INKEV.18.59.F04.1.454.CMB.1.raw
  modified_base (312)..(312): a, c, t, g, unknown or other
  misc_feature (312)..(312): n is a, c, g, or t
  modified_base (349)..(349): a, c, t, g, unknown or other
  misc_feature (349)..(349): n is a, c, g, or t
  modified_base (356)..(356): a, c, t, g, unknown or other
  misc_feature (356)..(356): n is a, c, g, or t
  modified_base (477)..(477): a, c, t, g, unknown or other
  misc_feature (477)..(477): n is a, c, g, or t
  modified_base (489)..(489): a, c, t, g, unknown or other
  misc_feature (489)..(489): n is a, c, g, or t
  modified_base (495)..(500): a, c, t, g, unknown or other
  misc_feature (495)..(500): n is a, c, g, or t
tcagtacgagtatgcacgaccggtgctcgatttagtacacacacttagggattgggggctttgcctgggtcctgggcccagtctgccctgactcagcctgcctccgtgtctgggtctccctggacagtcgatcaccatctcctgcactggaaccagcagtgacgttggtggttataactatgtctcctggtaccaacagcacccaggcaaagccccccaaaatcatgatttatgatgtcactaatcggccctcaggggtttctaatcgcttctctggctccaagtctggcaacacggcctccctgaccatcnctgggctccgaggctgaggacgaggctgattattacngcagctnatatacaagcaccagcactctctatgtctcggaactggaccaggtcaccgtctaggtcagcccaagcccaacccactgtcactctgttcccaccctcctccatactcgtactgagccgggntcggcaacggcncatagnnnnnn

SEQ ID NO: 198906 - DNA, 508 bp, Homo sapiens
  misc_feature: GYAE6OF02FQF8K.18.59.F04.1.454.CMB.1.raw
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagccccccaaatcatgatttatgatgtcactaatcggccctcaggggtttctaatcgcttctctggctccaagtctggcaacacggcctccctgaccatctctgggctccgaggctgaggacgaggctgattatactgcagctcatatacaagcaccagcactctctatgtcttcggaactgggaccaaggtccaccgtctaggtcagcccaaggcccaaccctc

SEQ ID NO: 198907 - DNA, 509 bp, Homo sapiens
  misc_feature: GYAE6OF02FHHOX.18.59.F04.1.454.CMB.1.raw
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgagacgaggctgattattactgcagctcatatacaagcaccagcactctctatgtcttcggactgggaccaaggtccaccgtctaggtcacgcccaaggcccaaccctacg

SEQ ID NO: 198908 - DNA, 527 bp, Homo sapiens
  misc_feature: GYAE6OF02I1QDG.18.59.F04.1.454.CMB.1.raw
tcagtacgagtatgcacgaccggtgctcgatttagtacacacacttagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggacaaacgccccaaactcatgatttatgatgtcactaatcgccctcagggtttctaatcgcttctctggctcaagtctggcaacacgcctccctgaccatctcgtgggctccaggctgaggacgaggctgattattactgcagctcatatacaagcaagcaagcactacgaagtccttacggaactcgggaaccaacggtcaacccgtccgtaaggtccaacggccccaaggccccaacccacttaccg

SEQ ID NO: 198909 - DNA, 493 bp, Homo sapiens
  misc_feature: GYAE6OF02INQVJ.18.59.F04.1.454.CMB.1.raw
tcagtacgagtatgcacgaccggtgctcgatttagtacacacacttagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcagggtttctaatcgcttctctggctccaagtctggcaacacgcctcctgaccatctctggctcagctgagacgaggctgattatactgcagctcatatacagcacagcactctctatgtctcgaactggaccaaggtccacgtctaggtcagcccaagcccaaccctac

SEQ ID NO: 198910 - DNA, 451 bp, Homo sapiens
  misc_feature: GYAE6OF02FQ9VR.18.59.F04.1.454.CMB.1.raw
  modified_base (385)..(385): a, c, t, g, unknown or other
  misc_feature (385)..(385): n is a, c, g, or t
  modified_base (442)..(442): a, c, t, g, unknown or other
  misc_feature (442)..(442): n is a, c, g, or t
  modified_base (444)..(444): a, c, t, g, unknown or other
  misc_feature (444)..(444): n is a, c, g, or t
  modified_base (447)..(451): a, c, t, g, unknown or other
  misc_feature (447)..(451): n is a, c, g, or t
tcagtacgagtatgcacgaccggtgctcgatttagtacacacacttagggattgggggctttgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattatactgcagctcatatacaagcagcagcactctctatgtcttcggaactgggaccaaggtcaccgtctaggtcagcccaagcccaacccnctgcactctcgttccccgccctcctccattacctcgtactgacgcggctggcaggcnanagnnnnn

SEQ ID NO: 198911 - DNA, 504 bp, Homo sapiens
  misc_feature: GYAE6OF02I7HQ9.18.59.F04.1.454.CMB.1.raw
  modified_base (365)..(365): a, c, t, g, unknown or other
  misc_feature (365)..(365): n is a, c, g, or t
  modified_base (384)..(384): a, c, t, g, unknown or other
  misc_feature (384)..(384): n is a, c, g, or t
  modified_base (423)..(423): a, c, t, g, unknown or other
  misc_feature (423)..(423): n is a, c, g, or t
  modified_base (449)..(449): a, c, t, g, unknown or other
  misc_feature (449)..(449): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcaccaggcaaagccccaaactcatgatttatgatgtcactaatcggcctcaggggtttctaatcgcttctctggctcaagtctggcaacncggcctcctgaccatctcnggctccaggctgaggacgaggctgattattctgcagctnatatacaagtcaacctagacactctntattgtacttcggaactcgggacacggtcaccgtcctaggcacgccaaggacccc

SEQ ID NO: 198912 - DNA, 506 bp, Homo sapiens
  misc_feature: GYAE6OF02IYDGN.18.59.F04.1.454.CMB.1.raw
  modified_base (309)..(309): a, c, t, g, unknown or other
  misc_feature (309)..(309): n is a, c, g, or t
  modified_base (432)..(432): a, c, t, g, unknown or other
  misc_feature (432)..(432): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagccacccaggcaaagcccccaaactcatgatttangatgtcactaatcggcctcaggggtttcaatcgcttctctggctcaagtctggcaacacggcctccctgaccatcctctgggctccgaggctggaggacgaggctgatttattactgcagctnatatacaagcaccagccactctctatgtcttcggaactgggaaccaggtcaccgtcgtaggtcagcccaggccc

SEQ ID NO: 198913 - DNA, 505 bp, Homo sapiens
  misc_feature: GYAE6OF02IE058.18.59.F04.1.454.CMB.1.raw
  modified_base (319)..(319): a, c, t, g, unknown or other
  misc_feature (319)..(319): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagccccaaactcatgatttatgatgtcactaancggcctcagggtttctaatcgcttctctggctcaagtctggcaacacggcctccctcgaccatctctggctccagctgaggacgaggctgattattactgcagctcatatacaagcaccagcactctctatcgttacttcggactcgggacctaaggtctaccgtctacggtcacgcccagacccc

SEQ ID NO: 198914 - DNA, 496 bp, Homo sapiens
  misc_feature: GYAE6OF02IMOAJ.18.59.F04.1.454.CMB.1.raw
  modified_base (324)..(324): a, c, t, g, unknown or other
  misc_feature (324)..(324): n is a, c, g, or t
tcagtacgagtatgcacgaccggtgctcgatttagtacacacacttagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctnagggtttcaatcgcttctctgctccaagtctggcaacacggcctccctgaccatctctgggctccagctgagacgaggctgattattactgcagctcatatacaagcaccagcactctctatgtcttcggactggaccaggtccaccgtctagtcagcccaagccaaccctc

SEQ ID NO: 198915 - DNA, 508 bp, Homo sapiens
  misc_feature: GYAE6OF02JB1M4.18.59.F04.1.454.CMB.1.raw
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatttcctgcactggaaccagcagtgacgttggtggttataactatgtctcctggtaccaacagcacccaggcaaagccccaaactcatgatttatgatgtcactaatcggccctcaggggtttctaatcgtcttctctggctccaagtctggcaacacggcctcctgaccatctctgggctccaggctgagacgaggctgattattactgcagctcatatacaagcaccagcactctctatgtcttcggaacttgggaccaaggtcaccgtcctaggtcagcccaggccaaccccg

SEQ ID NO: 198916 - DNA, 514 bp, Homo sapiens
  misc_feature: GYAE6OF02I7K8U.18.59.F04.1.454.CMB.1.raw
  modified_base (431)..(431): a, c, t, g, unknown or other
  misc_feature (431)..(431): n is a, c, g, or t
  modified_base (440)..(440): a, c, t, g, unknown or other
  misc_feature (440)..(440): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagccctgcctccgtgtctggggtctcctggacagtcgatcaccatctcctgcactggaaccagcagtgacgttggtggttataactatgtctcctggtaccaacagcacccaggcaaacgccccaaactcatgatttatgatgtcactaatcggccctcgaggggtttctaatcgcttctctggctccaagtctggcaacacggccctccctgaccatctctgggcctcacggctgaggacgaggctgattatactgcagctnatatacaancacagcactctcatgtcttcggactgggaaccaggtccaccgtcctaggtccacgcccgacgacccaccctacg

SEQ ID NO: 198917 - DNA, 567 bp, Homo sapiens
  misc_feature: GYAE6OF02IBQ90.18.59.F04.1.454.CMB.1.raw
  modified_base (228)..(228): a, c, t, g, unknown or other
  misc_feature (228)..(228): n is a, c, g, or t
  modified_base (309)..(309): a, c, t, g, unknown or other
  misc_feature (309)..(309): n is a, c, g, or t
  modified_base (449)..(449): a, c, t, g, unknown or other
  misc_feature (449)..(449): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataactatgtcctctggtaccaacagccaccaggacaaacgcccccaaaactcatgtattttangatgtcaactaatccggccctcgtagggttttctaagtcgtcttctcgtggcctaccaagtctggaccaacgaccgcctccctcgaccatcctcgtcgggcctccgaggctaggacggacggaggctagtaattattacngcagcatatatacaacgcaccacgcaccttctacttagttcgttaccgttacggaaccgtcgggaacctaggtccctaccgttcgtacggccacgaccccgaacggccccaaccctcg

SEQ ID NO: 198918 - DNA, 499 bp, Homo sapiens
  misc_feature: GYAE6OF02I6BUH.18.59.F04.1.454.CMB.1.raw
  modified_base (346)..(346): a, c, t, g, unknown or other
  misc_feature (346)..(346): n is a, c, g, or t
  modified_base (444)..(444): a, c, t, g, unknown or other
  misc_feature (444)..(444): n is a, c, g, or t
  modified_base (493)..(496): a, c, t, g, unknown or other
  misc_feature (493)..(496): n is a, c, g, or t
  modified_base (498)..(499): a, c, t, g, unknown or other
  misc_feature (498)..(499): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattacngcagctcatatacaagcagcagcactcaagtcttcggaactgggaccaaggtcaccgtctaggcagcccaaggccaacccactcgcactctcgtcccnccctcctccatacctcgtactgacgcggcgtggccaaggcgcagtacgnnnncnn

SEQ ID NO: 198919 - DNA, 538 bp, Homo sapiens
  misc_feature: GYAE6OF02H0NS7.18.59.F04.1.454.CMB.1.raw
  modified_base (302)..(302): a, c, t, g, unknown or other
  misc_feature (302)..(302): n is a, c, g, or t
  modified_base (360)..(360): a, c, t, g, unknown or other
  misc_feature (360)..(360): n is a, c, g, or t
tcagtacgagtatgcacgaccggtgctcgatttagtacacacacttagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtaggttataactatgtctcctgtaccaacagcaccaggacaagcccccaaatcatgatttangatgtcactaatcgcctgagggttcatcgcttctctgctcagtctgcacacgcctccngaccatctctcggctccgagctggaggacgaggctgattacgttactgctagctacaattactaacaagccacagaccactctctagtacgttacgttcggaacgtcgggaaccctaagggtcccaaccgttcccgtagggtccaccggtaccccgaacggtaccccaacccctaacg

SEQ ID NO: 198920 - DNA, 603 bp, Homo sapiens
  misc_feature: GYAE6OF02JCQ9O.18.59.F04.1.454.CMB.1.raw
  modified_base (268)..(268): a, c, t, g, unknown or other
  misc_feature (268)..(268): n is a, c, g, or t
tcagtacgagtatgcacgaccggtgctcgatttagtacacacacttaggaggttgggggggtctcaggaggcagcgctcgtcgggacgtctccaccatggccgtggctctgctattcctccaccctcctcactcagggcacgagggtcctcgggcccagtctcgccctgactcagcctgcctccgtgtcgtgggtcctcctggacagtcgatcaccatcctcctgccacgtcggaacccagcagtgaccgttggtaggttaataactntgtctccttggtaccaacagacacccaggacaaacgacccccaaactcatcgtatttatgatgtcaactaatccggtccctcgtacgggtttactaatcgtctttctcgtggctaccaagtctggcaacgaccgccctccctcgacctacttctcgtcggcctccgaggctgacggacgagcgtagtactttacttactgcagtcctacgtaatataacagacgagacagcaccgtactacgttccgtaccggaacgtcggaaccgtaacggtccgtacccggttaccgttacggacaccggacccgaaccggacccaaccccgtccgttacccg

SEQ ID NO: 198921 - DNA, 519 bp, Homo sapiens
  misc_feature: GYAE6OF02IUG1V.18.59.F04.1.454.CMB.1.raw
  modified_base (242)..(242): a, c, t, g, unknown or other
  misc_feature (242)..(242): n is a, c, g, or t
  modified_base (418)..(418): a, c, t, g, unknown or other
  misc_feature (418)..(418): n is a, c, g, or t
  modified_base (450)..(450): a, c, t, g, unknown or other
  misc_feature (450)..(450): n is a, c, g, or t
  modified_base (497)..(497): a, c, t, g, unknown or other
  misc_feature (497)..(497): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggnggttataactatgtctcctggtaccaacagcacccaggcaaagcccccaaactcatgatttatgatgtcactaatcggccctcaggggtttctaatcgcttctctggctcaagtctggcaacacggcctccctgaccatctctggctccaggctgaggacgaggctgattattacngcagctacatactacaacgcaccagcactctntatgtcttcggaactcgggaacctagggtccaccgttcgtacggtcncgacccaacggcccaccctacg

SEQ ID NO: 198922 - DNA, 327 bp, Homo sapiens
  misc_feature: GYAE6OF02IC5LH.18.59.F04.1.454.CMB.1.raw
  modified_base (191)..(191): a, c, t, g, unknown or other
  misc_feature (191)..(191): n is a, c, g, or t
  modified_base (230)..(230): a, c, t, g, unknown or other
  misc_feature (230)..(230): n is a, c, g, or t
  modified_base (319)..(327): a, c, t, g, unknown or other
  misc_feature (319)..(327): n is a, c, g, or t
tcagtacgagtatgcacgaccggtgctcgatttagtacacacacttagggattggggagagaagacaggattcaggacaatctccagcatggccggcttccctctcctcctcaccctcctcactcactgtgcagggtcctgggcccagtctgtgctgactcagccaccctcagcgtctgggacccccgggnagagggtccaccatctcttgttctggaagcagctccaanagtcggaagtcagcccaaggctgcccccctggtcactctgttcccacccctcctcatacctgtactgagcggctggcaggcacatacgnnnnnnnnn

SEQ ID NO: 198923 - DNA, 500 bp, Homo sapiens
  misc_feature: GYAE6OF02FU731.18.59.F04.1.454.CMB.1.raw
  modified_base (490)..(490): a, c, t, g, unknown or other
  misc_feature (490)..(490): n is a, c, g, or t
  modified_base (495)..(500): a, c, t, g, unknown or other
  misc_feature (495)..(500): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggttcctaatcgcttctctggctccaagtctggcaacacggcctccctgaccatctctgggctccaggctgaggacaggctgattatactgcagctcatatacaagcaccagcactctctatgtcttcggaactgggaccaaggtcaccgtcctaggtcagcccaaggcccaacccactgtccactctcgttccccgccctcctccatcctcgtactgacgcgggctggcaaggcncatgnnnnnn

SEQ ID NO: 198924 - DNA, 508 bp, Homo sapiens
  misc_feature: GYAE6OF02I8MPX.18.59.F04.1.454.CMB.1.raw
  modified_base (346)..(346): a, c, t, g, unknown or other
  misc_feature (346)..(346): n is a, c, g, or t
  modified_base (496)..(496): a, c, t, g, unknown or other
  misc_feature (496)..(496): n is a, c, g, or t
  modified_base (502)..(503): a, c, t, g, unknown or other
  misc_feature (502)..(503): n is a, c, g, or t
  modified_base (505)..(508): a, c, t, g, unknown or other
  misc_feature (505)..(508): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattacngcagctcatatacaagcaccagcactctctatgtcttcggactgggaccaagtcaccgtctaggtcacgcccaacggcccaaccccactcgcacctcctcgttcccaccctcctccactacctcgtactgacgcgggctcggcgaaggcnactagnngnnnn

SEQ ID NO: 198925 - DNA, 649 bp, Homo sapiens
  misc_feature: GYAE6OF02J2MVL.18.59.F04.1.454.CMB.1.raw
  modified_base (257)..(257): a, c, t, g, unknown or other
  misc_feature (257)..(257): n is a, c, g, or t
  modified_base (316)..(316): a, c, t, g, unknown or other
  misc_feature (316)..(316): n is a, c, g, or t
tcagtacgagtatgcacgaccggtgctcgatttagtacacacacttagggattgggggggtcgtcgaggaggcgagcgctctcgggacgtctccaccatggcctgggctctgctattcctcaccctcctcactcagggcacagggtcctgggcccagtctgcccctgactcagcctgcctccgtgtctgggtctcctggacagtcgatcaccatctcctgcactggaaccagccagtgacgttggtggttataactntgtctcctggtaccacagcacccgaggacaaacgccccccaaaactccatcgattttangatgtaccactaatccgggacccctcgtaggggttttacctaatccgtcttcgtccttgggctaccgtaagtcgtcggccaaaccacgggtccccttacccgtcgacccattccctcgttcgggcctccgacggcgtagacggacggtagggctggatttacttactgcagtcctactaactataaccgagacccacctagacctaccgtccttacttagttacgttccgtttacggtaaccggtcgggttaacccgtaaagggtccccgttaacccggtcgtttaaccggtcaacccggtccccgaaacgggaccccctaacccccgtaccg

SEQ ID NO: 198926 - DNA, 495 bp, Homo sapiens
  misc_feature: GYAE6OF02FFZU2.18.59.F04.1.454.CMB.1.raw
  modified_base (485)..(485): a, c, t, g, unknown or other
  misc_feature (485)..(485): n is a, c, g, or t
  modified_base (490)..(495): a, c, t, g, unknown or other
  misc_feature (490)..(495): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagccccaaactcatgatttatgatgtcactaatcggccctcaggggtttctaatcgcttctctggctccaagtctggcaacacggcctccctgaccatctctgggctccaggctgaggacgaggctgattatactgcagctcatatacaagcaccagcactctctatgtcttcggaactgggaccaaggtcaccgtctaggtcagcccaaggccaaccccatgtcactctgttcccacccttcctccatactcgtactgagcgggctggcaaggcnatagnnnnnn

SEQ ID NO: 198927 - DNA, 514 bp, Homo sapiens
  misc_feature: GYAE6OF02INPZQ.18.59.F04.1.454.CMB.1.raw
  modified_base (328)..(328): a, c, t, g, unknown or other
  misc_feature (328)..(328): n is a, c, g, or t
  modified_base (367)..(367): a, c, t, g, unknown or other
  misc_feature (367)..(367): n is a, c, g, or t
  modified_base (425)..(425): a, c, t, g, unknown or other
  misc_feature (425)..(425): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcaccccaggcaaagccccccaaaactcatgatttatgatgtcactaatcggccctnagggtttcaatcgcttctctggctccaagtctggcaacncggcctcctgaccatctctgggctccgaggctgaggacgaggctgatttatactgcanctcatataacagcaccagccactctctatgttccttacggactgggaaccaggtccaccgtctaggtcacgcccaaggcccaccctacg

SEQ ID NO: 198928 - DNA, 547 bp, Homo sapiens
  misc_feature: GYAE6OF02GVIWE.18.59.F04.1.454.CMB.1.raw
  modified_base (306)..(306): a, c, t, g, unknown or other
  misc_feature (306)..(306): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcaccaggacaaacgcccccaaactcatgatttangatgtcagtaactccggcctgtagggtttctaagtcgcttctctcggctacaagtctggaccaacgaccggtccctcccgtgacctatcctacgtcgggtcctccgaggtcgtaggacggacgacggtctagtactttagtactgacagtctacatacgtaacagcagacagcctactacgaagtcgttacgacgtggaacctagtccaccgtctaggcacggaccacgcccaccctgtcg

SEQ ID NO: 198929 - DNA, 525 bp, Homo sapiens
  misc_feature: GYAE6OF02ICU8G.18.59.F04.1.454.CMB.1.raw
  modified_base (328)..(328): a, c, t, g, unknown or other
  misc_feature (328)..(328): n is a, c, g, or t
  modified_base (426)..(426): a, c, t, g, unknown or other
  misc_feature (426)..(426): n is a, c, g, or t
  modified_base (432)..(432): a, c, t, g, unknown or other
  misc_feature (432)..(432): n is a, c, g, or t
  modified_base (440)..(440): a, c, t, g, unknown or other
  misc_feature (440)..(440): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgccccaaactcatgatttatgatgtcagtaatcggccctnaggggtttctaatcgcttctctggctccaagtctggcaacacggccctccctgaccatctcgtcgggctccgaggctggaggacgaggtctgtaattnttaacngcagctanatataacaagcagcagcactcagtcttacggaactcggacctaaggtccacggtcctaggtccacgacccaacggcccaaccccg

SEQ ID NO: 198930 - DNA, 517 bp, Homo sapiens
  misc_feature: GYAE6OF02HMN0W.18.59.F04.1.454.CMB.1.raw
  modified_base (304)..(304): a, c, t, g, unknown or other
  misc_feature (304)..(304): n is a, c, g, or t
  modified_base (423)..(423): a, c, t, g, unknown or other
  misc_feature (423)..(423): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaatcatgatttangatgtcactaatcggccctcgaggggtttctaatcgcttctctggctccaagtctggacaacacggcctccctgaccatctctcgggctccaggctggaggacgaggctgattattacngcagctcatatacagcaaccagcactctctatgtcttacggaacgtggaccaaggtccaccgtcgtaggtcaccgcccaaggcccaaccctacg

SEQ ID NO: 198931 - DNA, 464 bp, Homo sapiens
  misc_feature: GYAE6OF02GALM6.18.59.F04.1.454.CMB.1.raw
  modified_base (439)..(439): a, c, t, g, unknown or other
  misc_feature (439)..(439): n is a, c, g, or t
  modified_base (445)..(464): a, c, t, g, unknown or other
  misc_feature (445)..(464): n is a, c, g, or t
tcagtacgagtatgcacgaccggtgctcgatttagtacacacacttagggattgggggctttgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcacgtctaggtcagcccaagccaacccactgtcactctgttcccaccctcctccatactcgtactgagcgggctggcaaggcncatagnnnnnnnnnnnnnnnnnnnn

SEQ ID NO: 198932 - DNA, 571 bp, Homo sapiens
  misc_feature: GYAE6OF02IIUHN.18.59.F04.1.454.CMB.1.raw
  modified_base (248)..(248): a, c, t, g, unknown or other
  misc_feature (248)..(248): n is a, c, g, or t
  modified_base (308)..(308): a, c, t, g, unknown or other
  misc_feature (308)..(308): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttanaactatgtctcctggtaaccaacagcacccaggacaaacgcccccaaaatcatgatttangatgtcactaatcggccctgagggtttctaatcgtcttctctggcttacaagtctggaccaacgacgccctcctagaccattctcgtgggcctacgaggtctggaacgggacgaggcttagaatttatacgtgctagctcaattactaacacgccaaccacgctaaccttctacgtaattgttaccgttacggaaacgtcggggaaccaaggtccctaaccgtccgttagtccaacgtccccgaaacggtccccaacccgtac

SEQ ID NO: 198933 - DNA, 525 bp, Homo sapiens
  misc_feature: GYAE6OF02GA9S0.18.59.F04.1.454.CMB.1.raw
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgcccccaaactcatgatttatgatgtcactaatcggccctcgagggtttctaatcgcttctctggctccaagtctggcaacacgcctccctgaccatctcgtgggcctccaggctgaggacgaggctgattattactgcagctacatatacaagcaccagcactctactatgtcttacggaacgtcgggaaccaggtccaccgttccgtaggtccacgcccaacggacccaacccctacg

SEQ ID NO: 198934 - DNA, 542 bp, Homo sapiens
  misc_feature: GYAE6OF02G4WRR.18.59.F04.1.454.CMB.1.raw
  modified_base (311)..(311): a, c, t, g, unknown or other
  misc_feature (311)..(311): n is a, c, g, or t
  modified_base (408)..(408): a, c, t, g, unknown or other
  misc_feature (408)..(408): n is a, c, g, or t
  modified_base (507)..(507): a, c, t, g, unknown or other
  misc_feature (507)..(507): n is a, c, g, or t
tcagtacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggattttccttgctgctattttaaaggtgtccagtgtgaggtgcagctggtggagtcgtgggggaggcttgggtaaaggccgggggggtcccttaggacctcccctgtacagcctctggattcactttcagtaaggcctggatgaactgggtccnccaggctccgagggagggctggagtgggtgccgtaataaaaccaaatgagtggtaggacaacagactacgctgcaccgtgaaagcagatcacatcanaagagatgattacaaaagcaacgctgtatcgtgacaaatgaacagcctagaacgaccgagacacagccgtagtactactgtaccacacgtcccagaacncgtacactactactactacggtctacggacctcgg

SEQ ID NO: 198935 - DNA, 507 bp, Homo sapiens
  misc_feature: GYAE6OF02GN74B.18.59.F04.1.454.CMB.1.raw
  modified_base (228)..(228): a, c, t, g, unknown or other
  misc_feature (228)..(228): n is a, c, g, or t
  modified_base (323)..(323): a, c, t, g, unknown or other
  misc_feature (323)..(323): n is a, c, g, or t
  modified_base (426)..(426): a, c, t, g, unknown or other
  misc_feature (426)..(426): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataactatgtctcctggtaccaacagcacccaggcaaagcccccaaatcatgatttatgatgtcactaatcggccctnaggggtttctaatcgcttctctgctcaagtctggcacacgcctccctgaccatctctgggcctccgaggctgaggacgaggctgattatactgcagctcatanacagcaccagcactctctatgtcttcggaactcgggacctaaggtccaccgtctaggccagcccaacggcccaaccctacg

SEQ ID NO: 198936 - DNA, 515 bp, Homo sapiens
  misc_feature: GYAE6OF02HGGL9.18.59.F04.1.454.CMB.1.raw
  modified_base (440)..(440): a, c, t, g, unknown or other
  misc_feature (440)..(440): n is a, c, g, or t
  modified_base (511)..(511): a, c, t, g, unknown or other
  misc_feature (511)..(511): n is a, c, g, or t
tcagtacgagtatgcacgaccggtgctcgatttagtacacacacttagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaacagtgacgttggtggttataactatgtctcctggtaccaacagcacccaggcaaagcccccaaactcatgattatgatgtcagtaatcggccctcagggtttctaatcgcttctctggctccaagtctggcaacacggcctccctgaccatctctgggcctccgaggctgaggacgaggctgattattactgcagctcatatacaagcaccngcactctctatgtctcgaactcgggaacctaggtccacccgtacctaggtcacgcccaaggcccaaccccntacg

SEQ ID NO: 198937 - DNA, 508 bp, Homo sapiens
  misc_feature: GYAE6OF02HATVA.18.59.F04.1.454.CMB.1.raw
  modified_base (353)..(353): a, c, t, g, unknown or other
  misc_feature (353)..(353): n is a, c, g, or t
  modified_base (434)..(434): a, c, t, g, unknown or other
  misc_feature (434)..(434): n is a, c, g, or t
  modified_base (496)..(496): a, c, t, g, unknown or other
  misc_feature (496)..(496): n is a, c, g, or t
  modified_base (503)..(508): a, c, t, g, unknown or other
  misc_feature (503)..(508): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctnatatacaagcaccagcactctctatgtcttcggaactgggaccaaggtcaccgtcctaggtcagcccaaggcccaaccccnctcgccactctcgttccccacccttcctccactacctcgtactgacgcgggctggcaaggcncgatagnnnnnn

SEQ ID NO: 198938 - DNA, 528 bp, Homo sapiens
  misc_feature: GYAE6OF02H3H5W.18.59.F04.1.454.CMB.1.raw
  modified_base (239)..(239): a, c, t, g, unknown or other
  misc_feature (239)..(239): n is a, c, g, or t
  modified_base (524)..(524): a, c, t, g, unknown or other
  misc_feature (524)..(524): n is a, c, g, or t
  modified_base (527)..(527): a, c, t, g, unknown or other
  misc_feature (527)..(527): n is a, c, g, or t
tcagtacgagtatgcacgaccggtgctcgatttagtacacacacttagggattggggagagagacccctcccctgggatcctgggcccagtctgccctgactcagcctgcctccgtgtctgggtctcctggacagtcgatcaccatctcctgcactggaaccagcagtgacgttggtggttataactatgtctcctggtaccaacagcacccaggcaaaagccccaaatcatgatttangatgtcataatcggccctcaggggtttctaatcgcttctctggctccaagtctggcaaccgacggcctccctgacctatctctgggctccaggctgaggacgaggctgatttatactgcagctcatatacaagcagcagcactcaagtctggaactgggaccaaggtcaccgttctaggtcacgccaaggcccaacccgactcgtccaccttcctccgttccccaccctctccctatacctccgtactgacggtccgggctcggaccaagggccacgacttacgnctnc

SEQ ID NO: 198939 - DNA, 475 bp, Homo sapiens
  misc_feature: GYAE6OF02G39I6.18.59.F04.1.454.CMB.1.raw
  modified_base (388)..(388): a, c, t, g, unknown or other
  misc_feature (388)..(388): n is a, c, g, or t
  modified_base (454)..(475): a, c, t, g, unknown or other
  misc_feature (454)..(475): n is a, c, g, or t
tcagtacgagtatgcacgaccggtgctcgatttagtacacacacttagggattgggggctttgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtctaggtcacgcccaaggcccaacccnctcgtcactctcgttcccaccctcctcccatacctcgtacgagccgggctggcgaaggcacatagnnnnnnnnnnnnnnnnnnnnnn

SEQ ID NO: 198940 - DNA, 590 bp, Homo sapiens
  misc_feature: GYAE6OF02HFVWO.18.59.F04.1.454.CMB.1.raw
  modified_base (367)..(367): a, c, t, g, unknown or other
  misc_feature (367)..(367): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcctggtaccaacagcaccaggcaaacgcccccaaactcatgatttatgatgtcactaatcggccctcgtaggggtttctaatcgtcttctctggctccaagtctggcaanaccggccctcctgacccatcctcgtgggctccgaggctgacggacgaggctgatttattactgcagtctacgtatactaacgaacgcctaaccgagtaccacttctaccttacttggttacccgttacgggaaccgtcgggaaccctaaaggggttccctaacccggtcccgttaacgggtccaaccggtacccccgaaagggtcccccaaacccccgtacgg

SEQ ID NO: 198941 - DNA, 530 bp, Homo sapiens
  misc_feature: GYAE6OF02GIN0R.18.59.F04.1.454.CMB.1.raw
  modified_base (247)..(247): a, c, t, g, unknown or other
  misc_feature (247)..(247): n is a, c, g, or t
  modified_base (303)..(303): a, c, t, g, unknown or other
  misc_feature (303)..(303): n is a, c, g, or t
  modified_base (423)..(423): a, c, t, g, unknown or other
  misc_feature (423)..(423): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttanaactatgtctcctggtaccaacagcaccaggcaaagcccccaaactcatgatttangatgtcactaatcggccctgtaggggtttctaatcgctttctctggctccaagtctggcaacacggcctccctgaccatctcgtgggctccaggctggaggacgaggctgtattattacngcagtctacataatacaagcaaccgtagcctaactctactatgttccttacggaacgtgggaaccaaggtcaccggtctaggtcacgcccaacggcccaaccctacg

SEQ ID NO: 198942 - DNA, 324 bp, Homo sapiens
  misc_feature: GYAE6OF02H9QIN.18.59.F04.1.454.CMB.1.raw
  modified_base (192)..(192): a, c, t, g, unknown or other
  misc_feature (192)..(192): n is a, c, g, or t
  modified_base (319)..(324): a, c, t, g, unknown or other
  misc_feature (319)..(324): n is a, c, g, or t
tcagtacgagtatgcacgaccggtgctcgatttagtacacacacttagggattggggagagaagacaggattcaggacaatctccagcatggccggcttccctctcctcctcaccctcctcactcactgtgcagggtcctgggcccagtctgtgctgactcagccaccctcagcgtctcgggacccccgggnagagggtcaccatctctgttctggaagcagctccaacatcggaagtcagccaaggctcgccccctcggtcactctcgttcccgccctcctccatactcgtactgagcgggctggcaaggcgcatagnnnnnn

SEQ ID NO: 198943 - DNA, 468 bp, Homo sapiens
  misc_feature: GYAE6OF02HZZO8.18.59.F04.1.454.CMB.1.raw
  modified_base (451)..(468): a, c, t, g, unknown or other
  misc_feature (451)..(468): n is a, c, g, or t
tcagtacgagtatgcacgaccggtgctcgatttagtacacacacttagggattgggggctttgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcgaggggtttctaatcgcttctctggctccaagtctggcaacacggcctccctgaccatcctctgggctccaggctgaggacgaggctgattattactgcagctcatatacaagcagcagcatcaagtcttcggaactgggaccaaggtcaccgtctaggtcagcccaaggcccaacccactcgtcactctcgttcccaccctcctccatactcgtactgacgcggctggcgaaggccacagtagnnnnnnnnnnnnnnnnnn

SEQ ID NO: 198944 - DNA, 454 bp, Homo sapiens
  misc_feature: GYAE6OF02HO5TF.18.59.F04.1.454.CMB.1.raw
  modified_base (246)..(246): a, c, t, g, unknown or other
  misc_feature (246)..(246): n is a, c, g, or t
  modified_base (439)..(439): a, c, t, g, unknown or other
  misc_feature (439)..(439): n is a, c, g, or t
  modified_base (444)..(454): a, c, t, g, unknown or other
  misc_feature (444)..(454): n is a, c, g, or t
tcagtacgagtatgcacgaccggtgctcgatttagtacacacacttagggattgggggctttgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttcaatcgcttctctggctccaagtctggcaacncggcctccctgaccatctctgggctccaggctgaggacgaggctgattatactgcagctcatatacaagcaccagcactctctatgtcttcggaactgggaccaaggtcaccgtctagtcagcccaaggccaacccactgtccactctcgttccccgccctcctccatactcgtactgagcggctggcaggcncatgnnnnnnnnnnn

SEQ ID NO: 198945 - DNA, 493 bp, Homo sapiens
  misc_feature: GYAE6OF02HIUAX.18.59.F04.1.454.CMB.1.raw
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttgggtggttataactatgtctcctggtaccaacagcaccaggcaaagcccccaaactcatgatttatgatgtcactaatcggcctcaggggttctaatctcttctctggctcaagtctggcaacacgcctcctgaccatctctgggctccaggctgaggacgaggctgattattactgcagctcatatacaagcacagcactctctatgtctcggactgggacaagtccacgtctcgtcagcccaagccacccac

SEQ ID NO: 198946 - DNA, 551 bp, Homo sapiens
  misc_feature: GYAE6OF02FF2TO.18.59.F04.1.454.CMB.1.raw
  modified_base (543)..(543): a, c, t, g, unknown or other
  misc_feature (543)..(543): n is a, c, g, or t
tcagtacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttgggtaaagccgggggggtcccttagactcccctgtacagcctctggattcactttcagtaaggcctggatgaactgggtccgcaggctccgagggaaggggctggagtggttggccgtattaaaaccaaaactgatggtgggacaacagactacgctgcaccgtgaaaggcagattcaccatctcaagagatgattcaaaaagcacgctgtatctgcaaatgaacagcctagagaaccgaggaccacgagccgtagtattactgtaccactactcccctagaaacgcgtacaactactactactacggtatggacctcgngggtaccg

SEQ ID NO: 198947 - DNA, 505 bp, Homo sapiens
  misc_feature: GYAE6OF02GR9V8.18.59.F04.1.454.CMB.1.raw
  modified_base (495)..(495): a, c, t, g, unknown or other
  misc_feature (495)..(495): n is a, c, g, or t
  modified_base (501)..(503): a, c, t, g, unknown or other
  misc_feature (501)..(503): n is a, c, g, or t
  modified_base (505)..(505): a, c, t, g, unknown or other
  misc_feature (505)..(505): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaaccaggtccaccgtctaggtcacgcccaaggcccaacccactcgtcacttctcgttcccgccctcctccactactcgtactgacgcgggctggacaaggcncatcgnnncn

SEQ ID NO: 198948 - DNA, 538 bp, Homo sapiens
  misc_feature: GYAE6OF02JCHQ6.18.59.F04.1.454.CMB.1.raw
  modified_base (304)..(304): a, c, t, g, unknown or other
  misc_feature (304)..(304): n is a, c, g, or t
tcagtacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggattttccttgctgctatttaaaggtgtccagtgtgaggtgcagctggtggagtctgggggaggcttggtaaagccggggggtcccttagactcccctgtacagcctctggattcactttcagtaaggcctggatgaactgggtccncaggctccgagggaggggctggagtgggttggccgtataaaccaaatgatggtggacaacgagactacgctgcaccgtgaaagcagattcaccatctcaagagatgattacaaaaagcaacgctagtactctgacaaatgaacagcctagacgaaccgagacacgagccgtagtatactgtaccacactccctagaacgcgtacaactactactactacggtatcggacctcgg

SEQ ID NO: 198949 - DNA, 496 bp, Homo sapiens
  misc_feature: GYAE6OF02H5Z4P.18.59.F04.1.454.CMB.1.raw
  modified_base (427)..(427): a, c, t, g, unknown or other
  misc_feature (427)..(427): n is a, c, g, or t
  modified_base (437)..(437): a, c, t, g, unknown or other
  misc_feature (437)..(437): n is a, c, g, or t
  modified_base (485)..(485): a, c, t, g, unknown or other
  misc_feature (485)..(485): n is a, c, g, or t
  modified_base (490)..(496): a, c, t, g, unknown or other
  misc_feature (490)..(496): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagccccaaactcatgatttatgatgtcagtaatcggccctcaggggtttctaatcgcttctctggctccaagtctggcaacacggcctccctgaccatctctgggctccaggctgaggacgaggctgattatactgcagctcatatacaagcagcagcactcaagtcttcggaactgggaccaaggtcaccgtctaggtcagcccaaggcccaacccnctgtcactcncgttcccgccctcctccactactcgtactgagcgggctggccaaggcnatagnnnnnnn

SEQ ID NO: 198950 - DNA, 550 bp, Homo sapiens
  misc_feature: GYAE6OF02IUTSL.18.59.F04.1.454.CMB.1.raw
  modified_base (252)..(252): a, c, t, g, unknown or other
  misc_feature (252)..(252): n is a, c, g, or t
  modified_base (372)..(372): a, c, t, g, unknown or other
  misc_feature (372)..(372): n is a, c, g, or t
  modified_base (404)..(404): a, c, t, g, unknown or other
  misc_feature (404)..(404): n is a, c, g, or t
  modified_base (417)..(417): a, c, t, g, unknown or other
  misc_feature (417)..(417): n is a, c, g, or t
  modified_base (452)..(452): a, c, t, g, unknown or other
  misc_feature (452)..(452): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactntgtctcctggtaccaacagcaccaggcaaacgcccccaaaactcatgatttatgatgtcactaactccggccctcgtagggtttctaatcgtcttctctggctccaagtctggaccaacncggccctccctcgaccatctcgtggcctccgnggctggaggacgngctagtaatttattactgcagtctacatatacaanccacacgctaactcctatattcgttcgtacggtaacgtcgggtaacctacggtcccaccgttacctacggtcacgacccgaacgaccccaaccctacg

SEQ ID NO: 198951 - DNA, 558 bp, Homo sapiens
  misc_feature: GYAE6OF02HAW79.18.59.F04.1.454.CMB.1.raw
  modified_base (491)..(491): a, c, t, g, unknown or other
  misc_feature (491)..(491): n is a, c, g, or t
  modified_base (549)..(549): a, c, t, g, unknown or other
  misc_feature (549)..(549): n is a, c, g, or t
tcagtacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcttggtaaagccgggggggtcccttagactcccctgtacagcctctggattcactttcagtaaggcctggatgaactgggtccgcaggctccagggaaggggctggagtgggtggccgtattaaaaccaaaactgatggtgggacaacagactacgctgcacccgtgaaaggcagattcaccatctcaagagatagaattacaaaaagcacgctgtatctagacaaatgaacagcctagacgaaccgaggacacgagccgtgtacttacngtaccacactcccgtagaacgcgtacaactactaactactacggtatacggacctcgngggtaaccg

SEQ ID NO: 198952 - DNA, 568 bp, Homo sapiens
  misc_feature: GYAE6OF02JBVOM.18.59.F04.1.454.CMB.1.raw
  modified_base (199)..(199): a, c, t, g, unknown or other
  misc_feature (199)..(199): n is a, c, g, or t
  modified_base (228)..(228): a, c, t, g, unknown or other
  misc_feature (228)..(228): n is a, c, g, or t
  modified_base (253)..(253): a, c, t, g, unknown or other
  misc_feature (253)..(253): n is a, c, g, or t
  modified_base (305)..(305): a, c, t, g, unknown or other
  misc_feature (305)..(305): n is a, c, g, or t
  modified_base (368)..(368): a, c, t, g, unknown or other
  misc_feature (368)..(368): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacngtcgatcaccatctcctgcactggaaccngcagtgacgttggtggttataactntgtctcctgtaccaacagcacccaggcaaacgcccccaaactcatgatttangatgtcactaatcggccctcgtagggtttctaatcgtcttctctgctccaagtctcggcaacncggcctcctgaccatctcgtggcctccgaggtctggacggacggaggctgtaattattaccgtgaccagtctacaatatacaagcctaaccgagtaccaactccgttactacttcgtcctttacggaacgtcgggaacccgtaaggtccaacccgtttccgacgggtcaccggtacccaacggtaccccaaccccgtacg

SEQ ID NO: 198953 - DNA, 501 bp, Homo sapiens
  misc_feature: GYAE6OF02FXM0L.18.59.F04.1.454.CMB.1.raw
  modified_base (253)..(253): a, c, t, g, unknown or other
  misc_feature (253)..(253): n is a, c, g, or t
  modified_base (306)..(306): a, c, t, g, unknown or other
  misc_feature (306)..(306): n is a, c, g, or t
  modified_base (429)..(429): a, c, t, g, unknown or other
  misc_feature (429)..(429): n is a, c, g, or t
  modified_base (451)..(451): a, c, t, g, unknown or other
  misc_feature (451)..(451): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactntgtctcctggtaccaacagcacccaggcaaacgcccccaaactcatgatttangatgtcactaatcgcctcgagggtttctaatcgcttctctgctccaagtctggcaacacgcctccctgaccatctcgtggctccgagtctgaggacgaggctagtattacttactgcagctanatatacagaccacagcactctntatgtctcgacgtcggaccagtccacgtctagcacgccacggccaccctc

SEQ ID NO: 198954 - DNA, 515 bp, Homo sapiens
  misc_feature: GYAE6OF02FR3K5.18.59.F04.1.454.CMB.1.raw
  modified_base (365)..(365): a, c, t, g, unknown or other
  misc_feature (365)..(365): n is a, c, g, or t
tcagtacgagtatgcacgaccggtgctcgatttagtacacacacttagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatccggccctcaggggtttctaatcgcttctctggctccaagtctgcaacncggccctccctgaccatctcgtgggctccaggctgaggacgaggctgattattactgcagctcaattataacagcaccagccactctactatcgttcttcggaactgggaccaaggtccaccgtctaggtcacgcccaggcccaccctcg

SEQ ID NO: 198955 - DNA, 508 bp, Homo sapiens
  misc_feature: GYAE6OF02GT9D1.18.59.F04.1.454.CMB.1.raw
  modified_base (307)..(307): a, c, t, g, unknown or other
  misc_feature (307)..(307): n is a, c, g, or t
  modified_base (365)..(365): a, c, t, g, unknown or other
  misc_feature (365)..(365): n is a, c, g, or t
  modified_base (451)..(451): a, c, t, g, unknown or other
  misc_feature (451)..(451): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaatcatgatttangatgtcactaatcggccctcagggtttcaatcgcttctctggctcaagtctggcaacncggcctccctgaccatcctcgtgggctcgaggctggaggacgaggctggattattactgcagctcatatacaagcacagcactctntatgtcttcggaacttgggaacctaggtcaccgtcctaggtccagtcccaggacccc

SEQ ID NO: 198956 - DNA, 548 bp, Homo sapiens
  misc_feature: GYAE6OF02F77QZ.18.59.F04.1.454.CMB.1.raw
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcaccaggcaaacgcccccaaactcatgatttatgatgtcagtaactcggccctcgtaggggtttctaatcgtcttctctggctaccaagtctggcaacacggcctccctgacccatctcgtgggctccgaggctaggacggacggacggcgttagtaatttagtttaccgtgacacgtctacattaactaacaagccaaccagcaactctctatgtaccttcggaactcgggaacctaaggtccaccgtctacggtcacgacccacggacccc

SEQ ID NO: 198957 - DNA, 500 bp, Homo sapiens
  misc_feature: GYAE6OF02F8U6S.18.59.F04.1.454.CMB.1.raw
  modified_base (432)..(432): a, c, t, g, unknown or other
  misc_feature (432)..(432): n is a, c, g, or t
  modified_base (469)..(469): a, c, t, g, unknown or other
  misc_feature (469)..(469): n is a, c, g, or t
  modified_base (494)..(500): a, c, t, g, unknown or other
  misc_feature (494)..(500): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatcctctgggctccaggctgaggacgaggctgattatactgcagctcatatacaagcagcagcactcaagtcttcggaactgggaccaaggtcaccgtcctaggtcacgcccaacggcccaacccntcgcactctcgtcccaccctcctccactactcgtacngacgcggctggcaaggcacagtagnnnnnnn

SEQ ID NO: 198958 - DNA, 572 bp, Homo sapiens
  misc_feature: GYAE6OF02GT98X.18.59.F04.1.454.CMB.1.raw
  modified_base (239)..(239): a, c, t, g, unknown or other
  misc_feature (239)..(239): n is a, c, g, or t
  modified_base (357)..(357): a, c, t, g, unknown or other
  misc_feature (357)..(357): n is a, c, g, or t
tcagtacgagtatgcacgaccggtgctcgatttagtacacacacttagggattggggagagagacccctcccctgggatcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaatcatgatttangatgtcactaatcggccctcaggggtttctaatcgcttctctggctccaagtctggcaacacggccctccctgaccatctctgggctccaggctggaggacgaggctgatttattacngcagctcatatacagcacagcactctctatcgtcttacggaacgtcggaccgaacggtccgtacccgtaccgttacggtccgacgacccgaaccggacccaaccccgtacctcgtacctacctccttccgttcccctacccctccctacctaccttacctccgtacgtcggacggccgggtccgtcggaccgaacgggccgacgacgtacgcagc

SEQ ID NO: 198959 - DNA, 664 bp, Homo sapiens
  misc_feature: GYAE6OF02IGN9K.18.59.F04.1.454.CMB.1.raw
  modified_base (228)..(228): a, c, t, g, unknown or other
  misc_feature (228)..(228): n is a, c, g, or t
  modified_base (475)..(475): a, c, t, g, unknown or other
  misc_feature (475)..(475): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccngcagtgacgttggtggttataactatgtctcctggtaccaacagcacccaggacaaacgcccccaaatcatgatttatgatgtcagtaatccggccctacgtaggggttttactaatcgtcttctctggtctcccgaaagtcttaggactaaacagtcggtccctcccgtacgacctaactccttcgtcgggccttcccgagggtccgtaggacgggaccggtaaggctagtaagttaactttacgngacctagctacaagttaactaacgaaacgaccaaccagtacctaaaccgttcttaccgttaattccggttaccgtttaccgggaacgttaacggggtaaccctaaacgggttaccctaacccggttaacccgttacgggttacccgaaccggacccccgaaaacggtccccccaaaccccgttaacccg

SEQ ID NO: 198960 - DNA, 532 bp, Homo sapiens
  misc_feature: GYAE6OF02IY4WC.18.59.F04.1.454.CMB.1.raw
  modified_base (230)..(230): a, c, t, g, unknown or other
  misc_feature (230)..(230): n is a, c, g, or t
  modified_base (362)..(362): a, c, t, g, unknown or other
  misc_feature (362)..(362): n is a, c, g, or t
  modified_base (371)..(371): a, c, t, g, unknown or other
  misc_feature (371)..(371): n is a, c, g, or t
  modified_base (378)..(378): a, c, t, g, unknown or other
  misc_feature (378)..(378): n is a, c, g, or t
  modified_base (384)..(384): a, c, t, g, unknown or other
  misc_feature (384)..(384): n is a, c, g, or t
  modified_base (417)..(417): a, c, t, g, unknown or other
  misc_feature (417)..(417): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccngcagtgacgttggtggttataactatgtctcctggtaccaacagcacccaggcaaacgcccccaaactcatgatttatgatgtcactaatcggcctcgagggtttcaatcgcttctctgctcagtctgcacncgcctcctncatctcnggctcnggctgacgacgagctgtattatctgcagtctanatatacaagcaccagctactctcttagtcgttccgttacggaacctcggggtaacccaaggttccctaacccggttaccgttacgggtacccacggtaccccgaaggtacccccc

SEQ ID NO: 198961 - DNA, 556 bp, Homo sapiens
  misc_feature: GYAE6OF02G36NC.18.59.F04.1.454.CMB.1.raw
tcagtacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccggggggtccttagactcccctgtacagcctctggattcactttcagtaaggcctggatgaactgggtccgccaggctccagggaagggctggagtgggttggccgtataaaaccgaaaactgatggtggacaacagactacgctgcacccgtgaaaggcagattcaccatcacgaagagatgaattacaaaaagcaacgctagtatctagacaaagtgaacagcctagaagaaccgaggacacgagccgtagtattacgagtaccacactcccgtagaacgcgtacaactactactacgtacgtagtcggactcgtgggacccg

SEQ ID NO: 198962 - DNA, 597 bp, Homo sapiens
  misc_feature: GYAE6OF02GLERE.18.59.F04.1.454.CMB.1.raw
  modified_base (228)..(228): a, c, t, g, unknown or other
  misc_feature (228)..(228): n is a, c, g, or t
  modified_base (305)..(305): a, c, t, g, unknown or other
  misc_feature (305)..(305): n is a, c, g, or t
  modified_base (378)..(378): a, c, t, g, unknown or other
  misc_feature (378)..(378): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtggttataactatgtctcctggtaccaacagcacccaggcaaacgcccccaaatcatgatttangatgtcactaatcggccctcgtagggtttctaatcgtcttctctggctccaagtctggacacgacgccctccngacctatctctcgggcctccgaggtctggaacggacgaggctaggtaatttacgttactggaccagtcctactattaactaacgaacgccaacccgagcctacctcttctactcgttaccgttacggaaccgttcggggaaccctaagggttcccgaacccgtttcccgtaacgggttcccaacggtcccccgaaacgggaccccctaaaccccgtacg

SEQ ID NO: 198963 - DNA, 505 bp, Homo sapiens
  misc_feature: GYAE6OF02IUUXX.18.59.F04.1.454.CMB.1.raw
  modified_base (241)..(241): a, c, t, g, unknown or other
  misc_feature (241)..(241): n is a, c, g, or t
  modified_base (322)..(322): a, c, t, g, unknown or other
  misc_feature (322)..(322): n is a, c, g, or t
  modified_base (424)..(424): a, c, t, g, unknown or other
  misc_feature (424)..(424): n is a, c, g, or t
tcagtacgagtatgcacgaccggtgctcgatttagtacacacacttagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggngttataactatgtctcctggtaccaacagcacccaggcaaagcccccaaatcatgatttatgatgtcactaatcggccctnagggtttctaatcgcttctctggctccaagtctggcaacacgcctccctgacccatctctgggctccaggctgaggacgtaggcctgattatactgcagctnatatacaagcacagcactctctatgtcttcggaactgggaaccaggtcaccgtctaggtcacgccaacggcccaccctacg

SEQ ID NO: 198964 - DNA, 665 bp, Homo sapiens
  misc_feature: GYAE6OF02IA7ZT.18.59.F04.1.454.CMB.1.raw
  modified_base (216)..(216): a, c, t, g, unknown or other
  misc_feature (216)..(216): n is a, c, g, or t
  modified_base (540)..(540): a, c, t, g, unknown or other
  misc_feature (540)..(540): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctccngcactggaaccagcagtgacgtttggtgttataactatgtctctggtaccaacagcaccaggacaaacgccccaaactcatgtaatttatgatgtacactaactccggaccctcgtagggtttactaagttcgtcttctcgttggacctactaagtctcggacaaccgtaccggcccttccctacgacctacttcgtcgtcgggcctcccgaaggtccgtaggaacgggacggacggtccttaggtaacttttaactttaaccgtgaccgaagtcctacgtaactttaacgaaccaacggccaaaccgacgtaccacctttacnctttaacgtcggttaccgttaccgggaacgttacggggaaacctaacgggtacccgtaaccggttacccgttaacgggttaccaacccggtaaccccgtaaacgggccccctaaaccccgtaccg

SEQ ID NO: 198965 - DNA, 542 bp, Homo sapiens
  misc_feature: GYAE6OF02FVS3Q.18.59.F04.1.454.CMB.1.raw
tcagtacgagtatgcacgaccggtgctcgatttagtacacacacttagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggcctcagtcgtcgacaacgcgcctcctcgaccatctcgtcggctccgaggtctggaggacgaggtctagtattatactgcagtctacatacacacgcaccgagcctactctactagttcgttcgtacgtacgtcggaacctacggtaccctaccgtcgtacggtcgaccgacccgaacgaccccaacccgtaccg

SEQ ID NO: 198966 - DNA, 642 bp, Homo sapiens
  misc_feature: GYAE6OF02IDFA4.18.59.F04.1.454.CMB.1.raw
  modified_base (635)..(635): a, c, t, g, unknown or other
  misc_feature (635)..(635): n is a, c, g, or t
  modified_base (637)..(637): a, c, t, g, unknown or other
  misc_feature (637)..(637): n is a, c, g, or t
  modified_base (640)..(640): a, c, t, g, unknown or other
  misc_feature (640)..(640): n is a, c, g, or t
tcagtacgagtatgcacgaccggtgctcgatttagtacacacacttagggagttgggggctttgcctgggtcctgggtcccagtctgcccttagactccagcctgcctccgtgtctgggtctcctggacgagtcgatcaccatcgtcctgcactggaaccagcagtgacgttggtggttataacttatgtctcctggtaccaacagcacccagggccaaacgcccccaaactccaagtggatttatgatgtcaactaatcggacctcgaggggtttctaatcgcttactctggctccaagtcgtgggcctaacacggcctccctgaccatctctgggctccaggctgaggacgaggctagattatactgccagctacatactacaagccaaccagctactctctaatgtaccttccggaaacgttgggaaccctaacgggttccacccggttcttaacggtcctaacgtacccgaaaccgggtacccaaaccccgacttcggtacctaaccgttcccgttaccgttcccccgtccccttacccttcccgtaacttaacccgttaccggtaacctcgggacccggtcccgggtccgttaccgggcccgtaacgggtccgactacggtacggctacncncancg

SEQ ID NO: 198967 - DNA, 614 bp, Homo sapiens
  misc_feature: GYAE6OF02IP7FH.18.59.F04.1.454.CMB.1.raw
  modified_base (254)..(254): a, c, t, g, unknown or other
  misc_feature (254)..(254): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatntctcctgtaccaacagcacccagacaaacgccccaaactcatgtatttatgatgtctactaactccggccctcgtagggtttctaatcgtcttctctggtcctccaagtctacggaccaaacgaccggtccctaccctcgaccctacttcctcgtcgggtcctaccgacggtcgtacggacgggacggagggtccttagtactttaattactgcagtctacataatacaagccaaccgacgacctacttctacttagtcgttacgttacggtaacgtcggggtaacccgtaacggtccgtacccggttaccgttacggttaccgaccggtaccccgaaccggaccccctaaccccgtacg

SEQ ID NO: 198968 - DNA, 520 bp, Homo sapiens
  misc_feature: GYAE6OF02FZ3CU.18.59.F04.1.454.CMB.1.raw
  modified_base (253)..(253): a, c, t, g, unknown or other
  misc_feature (253)..(253): n is a, c, g, or t
  modified_base (430)..(430): a, c, t, g, unknown or other
  misc_feature (430)..(430): n is a, c, g, or t
  modified_base (438)..(438): a, c, t, g, unknown or other
  misc_feature (438)..(438): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactntgtctcctggtaccaacagcacccaggcaaagcccccaaatcatgatttatgatgtcactaatccggcctcgagggtttctaatcgcttctctgctcagtctgcaacacggcctcctgacctatctctgggcctcgacgctagacggcgaggctagatttatactgcagctacatanacagcacngcactctctattcgtcttacggaacgttcgggacctaacggtccaccgtcgtacgtcacgacccgacgaccctaccctaccg

SEQ ID NO: 198969 - DNA, 463 bp, Homo sapiens
  misc_feature: GYAE6OF02IOSMZ.18.59.F04.1.454.CMB.1.raw
  modified_base (385)..(385): a, c, t, g, unknown or other
  misc_feature (385)..(385): n is a, c, g, or t
  modified_base (451)..(463): a, c, t, g, unknown or other
  misc_feature (451)..(463): n is a, c, g, or t
tcagtacgagtatgcacgaccggtgctcgatttagtacacacacttagggattgggggctttgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggactgggacaaggtcacgtctaggtcagcccaaggcccaaccccnctcgtcactctcgttcccaccctcctccatacttcgtactgacgcgggctggcaaggccgcatagnnnnnnnnnnnnn

SEQ ID NO: 198970 - DNA, 520 bp, Homo sapiens
  misc_feature: GYAE6OF02JU1MJ.18.59.F04.1.454.CMB.1.raw
  modified_base (224)..(224): a, c, t, g, unknown or other
  misc_feature (224)..(224): n is a, c, g, or t
  modified_base (307)..(307): a, c, t, g, unknown or other
  misc_feature (307)..(307): n is a, c, g, or t
  modified_base (425)..(425): a, c, t, g, unknown or other
  misc_feature (425)..(425): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacnggaaccagcagtgacgttggtggttataactatgtctcctggtaccaacagcacccaggcaaagcccccaaatcatgatttangatgtcactaatcggccctgaggggtttctaatcgcttctctggctacaagtctggcaacacggcctcctgaccatctctgggcctccgaggctggaggacgaggctagattattacngcagctcatataacaagccaccagcactctctatcgtcgttacggaactcgggaaccaaggtccaccgtcgtacgtcacggacccaacggacccc

SEQ ID NO: 198971 - DNA, 585 bp, Homo sapiens
  misc_feature: GYAE6OF02F58QS.18.59.F04.1.454.CMB.1.raw
  modified_base (254)..(254): a, c, t, g, unknown or other
  misc_feature (254)..(254): n is a, c, g, or t
  modified_base (444)..(444): a, c, t, g, unknown or other
  misc_feature (444)..(444): n is a, c, g, or t
  modified_base (473)..(473): a, c, t, g, unknown or other
  misc_feature (473)..(473): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacgagggtcctgggcccagtctgccctgactcagcctgcctccgtgtctgggtctcctggacagtcgatcaccatctcctgcactggaaccagcagtgacgttggtagttataactntgtctcctggtaccaacagcacccaggacaaacgccccccaaaactcactgtatttactgatgtcaactaatccggccctcgtaggggttttctaagtcgtcttctcgtcggctccaagtctgcaacacgcctccctgaccatcctcgtcggctccgaggtctggacggacgaggctgtaattattacgngcctagctacatactaacgagtccaaccngaccacgttctacttatcgttacttaccggacgtcgggaacctaacgggtcccgtaacccgttccgttacggttaccgaccgaccccgaacgggtacccccaacccgtaccg

SEQ ID NO: 198972 - DNA, 535 bp, Homo sapiens
  misc_feature: GYAE6OF02JFTXR.18.59.F04.1.454.CMB.1.raw
  modified_base (232)..(232): a, c, t, g, unknown or other
  misc_feature (232)..(232): n is a, c, g, or t
  modified_base (335)..(335): a, c, t, g, unknown or other
  misc_feature (335)..(335): n is a, c, g, or t
  modified_base (348)..(348): a, c, t, g, unknown or other
  misc_feature (348)..(348): n is a, c, g, or t
  modified_base (523)..(523): a, c, t, g, unknown or other
  misc_feature (523)..(523): n is a, c, g, or t
  modified_base (527)..(527): a, c, t, g, unknown or other
  misc_feature (527)..(527): n is a, c, g, or t
  modified_base (533)..(533): a, c, t, g, unknown or other
  misc_feature (533)..(533): n is a, c, g, or t
tcagtacgagtatgcacgaccggtgctcgatttagtacacacacttagggagttgggggctttgcctgggtcctgggcccagtctgccctgactcagcctgcctccgtgtctgggtctcctggacagtcgatcaccatctcctgcactggaaccagcagtgaccgttggtggttataactatgtctcctggtaccaacagcacccaggcaaagcccccaaatcatgatttangatgtcactaatcggccctcgaggggtttctaatcgcttctctggctccaagtctggcaacacggcctccctgaccatctctgggctccgaggctggaggacnggctgattatacngcagtctacatatacaagcaccagcactctctatcgtctacggaactcggaccaaggtccaccgtccgtaggtcacgacccgaacgccctaaccccacttcgtccacctcttaccgttcccctccctcctcctacctcgtactcgagccggtctcggcaaggccgacgagtacgnacgntcgatncg

SEQ ID NO: 198973 - DNA, 510 bp, Homo sapiens
  misc_feature: GYAE6OF02I7PSE.18.59.F04.1.454.CMB.1.raw
  modified_base (251)..(251): a, c, t, g, unknown or other
  misc_feature (251)..(251): n is a, c, g, or t
  modified_base (470)..(470): a, c, t, g, unknown or other
  misc_feature (470)..(470): n is a, c, g, or t
  modified_base (503)..(505): a, c, t, g, unknown or other
  misc_feature (503)..(505): n is a, c, g, or t
  modified_base (507)..(508): a, c, t, g, unknown or other
  misc_feature (507)..(508): n is a, c, g, or t
tcagtacgagtatgcacgaccggtgctcgatttagtacacacacttagggattgggggctttgcctgggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctnaggggtttctaatcgcttctctggctccagtctggcaacacggcctccctgaccatctctgggctccaggctgaggacgaggctgattatactgcagctcatatacaagcagcagcactctctatgtcttcggaactggaccaggtcaccgtctaggtcacgcccaaggcccaacccactcgtccacctctcgttcccgccctcctccactctcgtacncgcgtccgggctcggcaacggcgacacgtacgnnngnngc

SEQ ID NO: 198974 - DNA, 565 bp, Homo sapiens
  misc_feature: GYAE6OF02FI55S.18.59.F04.1.454.CMB.1.raw
tcagtacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttgggtaaagccgggggggtcccttagactcccctgtacagcctctggattcactttcagtaaggcctggatgaactgggtccgccaggctccgaggggaaggggctggagtgggttggccgtattaaaaccaaactgatggtagggacaacagactacgctgcacccgtgaaaggcagattcaccatctcaagagatgattacaaaagcaacgctagtatctgacaaatgaacagacctgaacgaaccgagacacagccgtagtacttactgtaccacactcccctagaaacgtccgtaccaacttactaactacgtaacggtactggacctcgtgggacccg

SEQ ID NO: 198975 - DNA, 557 bp, Homo sapiens
  misc_feature: GYAE6OF02HDYBA.18.59.F04.1.454.CMB.1.raw
  modified_base (304)..(304): a, c, t, g, unknown or other
  misc_feature (304)..(304): n is a, c, g, or t
  modified_base (445)..(445): a, c, t, g, unknown or other
  misc_feature (445)..(445): n is a, c, g, or t
  modified_base (449)..(449): a, c, t, g, unknown or other
  misc_feature (449)..(449): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcaccaggcaaacgccccaaactcatgatttangatgtacactaatcggccctcgtagggtttctaatcgtcttctctggctaccaagtctcggcaacgaccggccctccgtgaccctatctcgtcggcctccgaggctggagacggaggctagtattagttactgacagctanatanacacgcacacgctactcttctattcgtcttacggtaacgtcgggaaccgtaacggtcccaccggttccgtacggttacaccggacccgaacggaccccaaccctaccg

SEQ ID NO: 198976 - DNA, 511 bp, Homo sapiens
  misc_feature: GYAE6OF02F5UEL.18.59.F04.1.454.CMB.1.raw
  modified_base (448)..(448): a, c, t, g, unknown or other
  misc_feature (448)..(448): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccgaggctgaggacgaggctgatttatactgcagctcatatacagcacagcactctntatgtcttcggaacttgggacctaaggtccaccgtctaggcagcccaaggcccaacccctacg

SEQ ID NO: 198977 - DNA, 634 bp, Homo sapiens
  misc_feature: GYAE6OF02JHT30.18.59.F04.1.454.CMB.1.raw
  modified_base (383)..(383): a, c, t, g, unknown or other
  misc_feature (383)..(383): n is a, c, g, or t
  modified_base (401)..(401): a, c, t, g, unknown or other
  misc_feature (401)..(401): n is a, c, g, or t
tcagtacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggattttccttgctgctatttaaaggtgtccagtgtgaggtgcagctggtggagtctgggggaggcttggtaagccgggggggtcccttagactcccctgtacagcctctggattcactttcagtaaggcctggatgaacgtgggtccgccaggctccgagggaggggctgggagtgggtggccgtattaaacaaactgagtggtggacacagactagctgcaccgngataggacagattcaccntctacaagagactgaattacaaaaacgtcacgactagtactctacgacaaagtacgtaacacgtaccgtagaacggaaccggaacggaaccgacgaacggtaccggttacgttaactttaaccgttacgttaacccgacctaaccgttacccccgtaaggtaaaccggtaccgttaaccaaccgttaaccgttaacccttaacggttaaccggttaccgtaggttaaccccgg

SEQ ID NO: 198978 - DNA, 498 bp, Homo sapiens
  misc_feature: GYAE6OF02H5R7Y.18.59.F04.1.454.CMB.1.raw
  modified_base (374)..(374): a, c, t, g, unknown or other
  misc_feature (374)..(374): n is a, c, g, or t
  modified_base (447)..(447): a, c, t, g, unknown or other
  misc_feature (447)..(447): n is a, c, g, or t
  modified_base (490)..(491): a, c, t, g, unknown or other
  misc_feature (490)..(491): n is a, c, g, or t
  modified_base (496)..(497): a, c, t, g, unknown or other
  misc_feature (496)..(497): n is a, c, g, or t
tcagtacgagtatgcacgaccggtgctcgatttagtacacacacttagggattgggggctttgcctgggtcctgggcccagtctgcctgactcagcctgcctccgtgtctgggtctcctggacagtcgatcaccatctcctgcactggaaccagcagtgacgttggtggttataactatgtctcctggtaccaacagcacccaggcaaagccccaaactcatgatttatgatgtcactaatcggccctcaggggtttctaatcgcttctctggctccaagtctggcaacacggcctccctgaccatctctggctccaggctgagacgaggctgattatactgcagctcatatacaagcaccagcactctctatntcttcggaactgggacaaggtcacgtcaggtcagcccaagccaacccactgtcactctcgttcccacccttcnccatacctcgtactcgagtccggctggcaacggcgcatacggnngactnnc

SEQ ID NO: 198979 - DNA, 734 bp, Homo sapiens
  misc_feature: GYAE6OF02G4A99.18.59.F04.1.454.CMB.1.raw
  modified_base (227)..(227): a, c, t, g, unknown or other
  misc_feature (227)..(227): n is a, c, g, or t
  modified_base (251)..(251): a, c, t, g, unknown or other
  misc_feature (251)..(251): n is a, c, g, or t
  modified_base (307)..(307): a, c, t, g, unknown or other
  misc_feature (307)..(307): n is a, c, g, or t
tcagtacgagtatgcacgaccggtgctcgatttagtacacacacttagggagttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctctgcactggaaccngcagtgacgttggtgttataactntgtctcctggtaccaacagcacccaggaccaaacgcccccaaactcatgtatttangatgtcaactaagtccggccctcgtaggggtttctaacgtcgtactttctcgtcggtccttaccaagttcctggaccaacgaccggtcccctacccgtacggaccctacttccttaccggtcgggtaccctcccggtaacgggtccgttacgggaacgggaacgggtacgggtaccgttaggtaacgtttaacgtttaaccgtcggacctacggtaccttaccgtaattaacgtaaaccgaaaccgtacctaacccgaacggtaccctaaccttaccttaccgttaacgttacggtttaccgtttaaccgggtaacggttaccggggaaaccctaacggggttacccctaacccgggtttaccggtaacgggttacccgaaaccggtacccccggaaaccggtacccccgtaaaccccgttacccgg

SEQ ID NO: 198980 - DNA, 537 bp, Homo sapiens
  misc_feature: GYAE6OF02JFWE3.18.59.F04.1.454.CMB.1.raw
  modified_base (304)..(304): a, c, t, g, unknown or other
  misc_feature (304)..(304): n is a, c, g, or t
  modified_base (325)..(325): a, c, t, g, unknown or other
  misc_feature (325)..(325): n is a, c, g, or t
tcagtacgagtatgcacgaccggtgctcgatttagtacacacacttagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgcccccaaatcatgatttangatgtcactaatccggccctnaggggtttctaatcgcttctctggctccaagtctggcaacacggcctcctgaccatctcgtgggcctccgaggctgacggacgaggctagattattacgtgcagtctcatataacaagtccaaccagaccacttctacttatcgttcttacggacgtgggaaccaaggttccaccgttccgtaggtccacgaccccaaggcccaacccctcg

SEQ ID NO: 198981 - DNA, 509 bp, Homo sapiens
  misc_feature: GYAE6OF02FFV5H.18.59.F04.1.454.CMB.1.raw
  modified_base (388)..(388): a, c, t, g, unknown or other
  misc_feature (388)..(388): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctgctccaagtctggcaacacggcctccctgaccatctctganctccaggctgaggacgaggctgattattactgcagctcatatacaagcaccagcactctctatgtctcggaactcggaccaaggtccaccgtcctaggtccagtccccgaggcccaacccc

SEQ ID NO: 198982 - DNA, 465 bp, Homo sapiens
  misc_feature: GYAE6OF02JGQJK.18.59.F04.1.454.CMB.1.raw
  modified_base (249)..(249): a, c, t, g, unknown or other
  misc_feature (249)..(249): n is a, c, g, or t
  modified_base (389)..(389): a, c, t, g, unknown or other
  misc_feature (389)..(389): n is a, c, g, or t
  modified_base (434)..(434): a, c, t, g, unknown or other
  misc_feature (434)..(434): n is a, c, g, or t
  modified_base (442)..(442): a, c, t, g, unknown or other
  misc_feature (442)..(442): n is a, c, g, or t
  modified_base (449)..(465): a, c, t, g, unknown or other
  misc_feature (449)..(465): n is a, c, g, or t
tcagtacgagtatgcacgaccggtgctcgatttagtacacacacttagggagttgggggctttgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcgaggggtttctaatcgcttctctggctccaagtctggcaacncggcctccctgacccatctctgggcctccaggctgaggacgaggctgattatacgtgcagctcagtatacaagcacagcactctctatgtcttcggaactgggaccaggtcacgtctaggtcagcccaacgccaaccctngtcactctcgtacccaccctcctcactactctactgacgcggtcnggcaggcncatagcnnnnnnnnnnnnnnnnn

SEQ ID NO: 198983 - DNA, 561 bp, Homo sapiens
  misc_feature: GYAE6OF02IFGHF.18.59.F04.1.454.CMB.1.raw
  modified_base (310)..(310): a, c, t, g, unknown or other
  misc_feature (310)..(310): n is a, c, g, or t
  modified_base (526)..(526): a, c, t, g, unknown or other
  misc_feature (526)..(526): n is a, c, g, or t
  modified_base (553)..(553): a, c, t, g, unknown or other
  misc_feature (553)..(553): n is a, c, g, or t
  modified_base (556)..(556): a, c, t, g, unknown or other
  misc_feature (556)..(556): n is a, c, g, or t
  modified_base (560)..(561): a, c, t, g, unknown or other
  misc_feature (560)..(561): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggcctcaggggtttctaatcgcttctctggctccaagtctggcaacacggccctccctgaccatcncgtgggctccaggtctgaggacgaggctgattattactgcagctcaatactaacaagccaacagaccactctactatcgtcgttacggaacgttgggaaccaaggtccaccgttcgtacggtcacgacccaaccgggacccaaaccccgtacttacgttacctccgtccgttcccccacccttcctacccacttacctccgtactgacggtccggngtcggacgtacgggccacgtagtagcngtnagcnn

SEQ ID NO: 198984 - DNA, 725 bp, Homo sapiens
  misc_feature: GYAE6OF02HQFDE.18.59.F04.1.454.CMB.1.raw
  modified_base (305)..(305): a, c, t, g, unknown or other
  misc_feature (305)..(305): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctctggtaccaacagcacccaggcaaacgcccccaaaactcatgatttangatgtacactaatccggcccttcgaggggtttactaagtccgcttctcgtcggtcttccaagttcgtcggacaaaccgaccgggcccttcccgtacgaaccctacttccgtccgtcggggcctcccgagggtccgtaggaacgggaaccggagggccgttaggtaactttaacgttttaaccgtcggtacacggtccttacaattaaacttaaccgaaacggtacccaaacccgaacggtaccctaacctttcctaacctttaacgttcgtttacccggtttaccggtaaaacccgggttacggggaaacccgttaaacggggttaccctaaccccgggtttacccgtttaacggggtaccccgtaaaccggaaccccccgtaaaaccggggtaccccccaaaacccccccgttaaccgg

SEQ ID NO: 198985 - DNA, 598 bp, Homo sapiens
  misc_feature: GYAE6OF02HRG1B.18.59.F04.1.454.CMB.1.raw
  modified_base (305)..(305): a, c, t, g, unknown or other
  misc_feature (305)..(305): n is a, c, g, or t
  modified_base (453)..(453): a, c, t, g, unknown or other
  misc_feature (453)..(453): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcctggtaccaacagcaccaggacaaacgcccccaaactcatgatttangatgtcagtaatcgcctgtagggtttctaatcgtcttctcgtcggtctccgtaagtctcggaccaaaccgaccggtccctcccgtcgacctaacgttcctcgtcgggcctccgaggtctggaggacgagggctagtatttaattaccngaccagtctacataactaacaagcagacacgctaactactaagttccgttacggaacgtcggggaacctaacggttccaacccggttaccgtaacgggtaccaccggaccccgaaacgggtaccccaaacccccgtacgtaccgg

SEQ ID NO: 198986 - DNA, 530 bp, Homo sapiens
  misc_feature: GYAE6OF02GU1C9.18.59.F04.1.454.CMB.1.raw
  modified_base (428)..(428): a, c, t, g, unknown or other
  misc_feature (428)..(428): n is a, c, g, or t
  modified_base (525)..(525): a, c, t, g, unknown or other
  misc_feature (525)..(525): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcaccaggacaaacgcccccaaactcatgatttatgatgtacactaatcggccctcgtaggggtttctaatcgcttctctggctcaagtctggcaacacgcctcctgaccatctctcgggctcgagctgaggacgagctgtattattactgcagctnatatacagcagcagctactacaacgttcgttacggaacgtacgggaacctaaggtccaccgtaccgtaggtacacgacccgaaggaccccaacccgntaccg

SEQ ID NO: 198987 - DNA, 477 bp, Homo sapiens
  misc_feature: GYAE6OF02FF0FQ.18.59.F04.1.454.CMB.1.raw
  modified_base (467)..(477): a, c, t, g, unknown or other
  misc_feature (467)..(477): n is a, c, g, or t
tcagtacgagtatgcacgaccggtgctcgatttagtacacacacttagggattgggggctttgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattatactgccagtcctatgacactaatctcagtggtctgggggtcttcggcgggagggaccaggctgaccggtcgtggggtcagcccaaggcctcgccccctcgggtccacttctcgttccccaccctccctcccatacctcgttactgacgcgggctggcaagggcgcatagnnnnnnnnnnn

SEQ ID NO: 198988 - DNA, 500 bp, Homo sapiens
  misc_feature: GYAE6OF02FKJ1B.18.59.F04.1.454.CMB.1.raw
  modified_base (357)..(357): a, c, t, g, unknown or other
  misc_feature (357)..(357): n is a, c, g, or t
  modified_base (457)..(457): a, c, t, g, unknown or other
  misc_feature (457)..(457): n is a, c, g, or t
  modified_base (489)..(489): a, c, t, g, unknown or other
  misc_feature (489)..(489): n is a, c, g, or t
  modified_base (495)..(496): a, c, t, g, unknown or other
  misc_feature (495)..(496): n is a, c, g, or t
  modified_base (498)..(500): a, c, t, g, unknown or other
  misc_feature (498)..(500): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatanacaagcaccagcactctactatgtcttcggactgggaccaggtccaccgtctaggtcacgccaaggcccaacccactgtcactctcgttcccaccctccncactacctctactgagcgggctggccaaggcncatagnncnnn

SEQ ID NO: 198989 - DNA, 588 bp, Homo sapiens
  misc_feature: GYAE6OF02ITARV.18.59.F04.1.454.CMB.1.raw
  modified_base (245)..(245): a, c, t, g, unknown or other
  misc_feature (245)..(245): n is a, c, g, or t
  modified_base (256)..(256): a, c, t, g, unknown or other
  misc_feature (256)..(256): n is a, c, g, or t
  modified_base (455)..(455): a, c, t, g, unknown or other
  misc_feature (455)..(455): n is a, c, g, or t
  modified_base (462)..(462): a, c, t, g, unknown or other
  misc_feature (462)..(462): n is a, c, g, or t
tcagtacgagtatgcacgaccggtgctcgatttagtacacacacttagggagttggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaggtgacgttggnggttataactntgtctcctggtaccaacagcaccaggacaaaccgccccaaaactccatacgtatttatagatgtactaactaacgtccggccctacgagggtttactaagtcgtcttctctacggtctcaagtctggacaacgacgcctccagacctatctcgtggcctcgagtcgtgagggtacgaggctagtaattacttacgtcgnacgctanagtaactacaacgtacacgacgacctactactctaattcgttacgttacggtaaccgtcggtaaaccacgggtaccctaccggttaccgtacgtccaacggtacccgaacggtaccctaacccgtc

SEQ ID NO: 198990 - DNA, 540 bp, Homo sapiens
  misc_feature: GYAE6OF02I7M5G.18.59.F04.1.454.CMB.1.raw
  modified_base (228)..(228): a, c, t, g, unknown or other
  misc_feature (228)..(228): n is a, c, g, or t
  modified_base (364)..(364): a, c, t, g, unknown or other
  misc_feature (364)..(364): n is a, c, g, or t
  modified_base (396)..(396): a, c, t, g, unknown or other
  misc_feature (396)..(396): n is a, c, g, or t
  modified_base (432)..(432): a, c, t, g, unknown or other
  misc_feature (432)..(432): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataactatgtctctggtaccaacagcacccaggcaaacgcccccaaactcatgatttatgatgtcactaatcggccctgtagggtttctaatcgtcttctctggctcagtctggcaacncgcctcctgacctatctcgtcgggcctaccgnggtctggacggacgtaggctaggtatttagttacgngcagctacatatacagcagcacgcactcgaagttcgtacggaacgtcgggaacctacggtaccaccgttccgtagtccgacgacccgaacgcccctaacccgcgtccg

SEQ ID NO: 198991 - DNA, 567 bp, Homo sapiens
  misc_feature: GYAE6OF02H6XST.18.59.F04.1.454.CMB.1.raw
  modified_base (369)..(369): a, c, t, g, unknown or other
  misc_feature (369)..(369): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgtgctgacgcagcctgcctccgtgtctgggtctcctggacagtcgatcaccatctcctgcactggaaccagcagtgacgttggtgttataactatgtctcctggtaccaacagcacccaggacaaacgccccccaaaatcatgatttatgatgtacactaatcggccctcgtagggtttctaatcgtcttctctgctcagtctgcacncgcctcctgaccatcacgtggctcgagctgagatggagctagacttatactcgacctacgtcctagtcgactagtagacggtctaggtaggttcggttacgtagtttcggttcgtttacgggacttccggttacgggaacccgttaagggttaccctaacccggttacccgttaaggttccccgaggtaaccccccgg

SEQ ID NO: 198992 - DNA, 525 bp, Homo sapiens
  misc_feature: GYAE6OF02HKPCU.18.59.F04.1.454.CMB.1.raw
  modified_base (302)..(302): a, c, t, g, unknown or other
  misc_feature (302)..(302): n is a, c, g, or t
  modified_base (419)..(419): a, c, t, g, unknown or other
  misc_feature (419)..(419): n is a, c, g, or t
tcagtacgagtatgcacgaccggtgctcgatttagtacacacacttagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataacgtatgtctctggtaccaacagcaccaggcaaacgccccaaactcatgatttangatgtcactaatcggcctcgtacgggtttctaatcgtcttctctggctcaagtctggcaacacgtcctcctgaccatctctgggctcaggctgaggacgaggctggattacgttacngcagctacattacacaagcaacctagctactcactatcgtcttacggacgtcggacctaggtcctaccgtctacggctacgacccgtaacggccccaacccgtacg

SEQ ID NO: 198993 - DNA, 664 bp, Homo sapiens
  misc_feature: GYAE6OF02JPSIB.18.59.F04.1.454.CMB.1.raw
  modified_base (200)..(200): a, c, t, g, unknown or other
  misc_feature (200)..(200): n is a, c, g, or t
  modified_base (213)..(213): a, c, t, g, unknown or other
  misc_feature (213)..(213): n is a, c, g, or t
  modified_base (227)..(227): a, c, t, g, unknown or other
  misc_feature (227)..(227): n is a, c, g, or t
  modified_base (233)..(233): a, c, t, g, unknown or other
  misc_feature (233)..(233): n is a, c, g, or t
  modified_base (250)..(250): a, c, t, g, unknown or other
  misc_feature (250)..(250): n is a, c, g, or t
  modified_base (264)..(264): a, c, t, g, unknown or other
  misc_feature (264)..(264): n is a, c, g, or t
  modified_base (301)..(301): a, c, t, g, unknown or other
  misc_feature (301)..(301): n is a, c, g, or t
  modified_base (372)..(372): a, c, t, g, unknown or other
  misc_feature (372)..(372): n is a, c, g, or t
tcagtacgagtatgcacgaccggtgctcgatttagtacacacacttagggagttgggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacngtcgatcacatcnctgcactggaaccngcagtnacgttggtgtataactntgtctctgtaccanagcaccaggcaaacgcccccaaactcactgactttangatgtcaactaatcggaccctgaggggtttactaatcgtacttctctggtcctcaagttcgtacgctaacncgtcccttaccctagaccctattcctacgtcgggtacctccggtaacgtcgttcgaacgggtaaccgaacgggtctcgggttaactttaacgtttacgtacggacctaacgcctttaccaagtttaacttaaccggaaacaccgtaaccctaaggaccttaaaccgttcctaccttaagttacgtttcccgttaaacggtaaccgtacggggaacctaacggggttaccctaacccggttacgttaacggtcccgaaaccgttccccggaaaccggcccctaacccccgtag

SEQ ID NO: 198994 - DNA, 645 bp, Homo sapiens
  misc_feature: GYAE6OF02GS5FD.18.59.F04.1.454.CMB.1.raw
  modified_base (211)..(211): a, c, t, g, unknown or other
  misc_feature (211)..(211): n is a, c, g, or t
  modified_base (229)..(229): a, c, t, g, unknown or other
  misc_feature (229)..(229): n is a, c, g, or t
  modified_base (267)..(267): a, c, t, g, unknown or other
  misc_feature (267)..(267): n is a, c, g, or t
  modified_base (298)..(298): a, c, t, g, unknown or other
  misc_feature (298)..(298): n is a, c, g, or t
  modified_base (479)..(479): a, c, t, g, unknown or other
  misc_feature (479)..(479): n is a, c, g, or t
tcagtacgagtatgcacgaccggtgctcgatttagtacacacacttagggagttggggggggtctcaggaggcagcgctctcgaggacgtctccaccatggccgtggctctgctattcctcaccctcctcactcagggcacagggtcctgggcccagtctgccctgactcagcctgcctccgtgtctgggtctcctggacagtcgatcacntctctgcacgtcgaaccngcagtgacgttggtgttatactatgtctctgtacacancaccagacaaacgccccaatcatgtatttangatcgtacaactaacgtccggtcccttaggttacggggtttactaacgtccgtcttctctcggtcctactagtcgtacggaccaacgccgtccctccgtacgaacctacgtccgttcggtcggtcctaccggacggtcgtacggaacgggacgtacggtctagttaactttacgtttacgngactacgtcctactaagttaacgttaacgaagtccctaacgtacgtcttaccttcgttactacggttcgtaccgttacgggtaacgttacgggtaacccgtaacggttacccgtaccgttaccgtacggtaccgacccggtacccgaaccggtcccctaaccccgg

SEQ ID NO: 198995 - DNA, 675 bp, Homo sapiens
  misc_feature: GYAE6OF02I5GTO.18.59.F04.1.454.CMB.1.raw
  modified_base (233)..(233): a, c, t, g, unknown or other
  misc_feature (233)..(233): n is a, c, g, or t
  modified_base (259)..(259): a, c, t, g, unknown or other
  misc_feature (259)..(259): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcaggcacagggtcctgggcccagtctgccctgtacctcagtccttgccttccgtgtctgggtctccgtggacagtcgatcaccatctcctgcactggaaccnggcagtgacgttggtggttataactntgtctcctggtaccaactagcacccaggcaaacgccccaaactcatgatttatgagtgtcaactaatcggccctcgtagggtttctaatcgctttctcgtggcctaccaagtctggacaaccgcggcctaccctcgaacctacttctaccgttcggtcctaccgacggtacctacggacgggaaccgaagggtcctacgttaatttaacgttacgttcgactagcttaccaattaatacgaaacgccaaaccgtacgaccgtaccttcctttacgttaactttccgtttacgttaccgggtaaccgtacggggtaaaccccgtaagggttccccgtaaccccggttaccggttaacggggttcccgaaaccggacccccggtaaacgggtaccccccgttaaaccccgtaacccgg

SEQ ID NO: 198996 - DNA, 640 bp, Homo sapiens
  misc_feature: GYAE6OF02HP5XN.18.59.F04.1.454.CMB.1.raw
  modified_base (300)..(300): a, c, t, g, unknown or other
  misc_feature (300)..(300): n is a, c, g, or t
  modified_base (453)..(453): a, c, t, g, unknown or other
  misc_feature (453)..(453): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctcctgcactggaccagcagtgacgttggtgttataactatgtctctgtaccaacagcaccagacaaacgcccccaaactcatgatttangatgtcactaatccggcctagtacgggtttactaatcgtcttctctggctccaagttcgtacggcaacgaccggtccctcccgtgacctacttctcgtcgggacctccgacggcgttaggacgggacggacggccttaggtacttacgttacncgtacacgtctacaagttaactaacgaacgtaccaaccaacgcctaacgttcctacgttaacgtcgtttaccgttacgggtaaaccgtcggggaaccctaacgggttacccgtacccggttacccgttaacgggttacccgaacccggtaaccccggaaaccggacccccgtaaacccccgtaccgg

SEQ ID NO: 198997 - DNA, 976 bp, Homo sapiens
  misc_feature: GYAE6OF02GH5UY.18.59.F04.1.454.CMB.1.raw
  modified_base (302)..(302): a, c, t, g, unknown or other
  misc_feature (302)..(302): n is a, c, g, or t
tcagtacgagtatgcacgaccggtgctcgatttagtacacacacttagggattgggggggtctcaggaggcagcgctctcgggacgtctccaccatggccgtgggctctgctattcctccaccctcctcactcgagggcacgacgggtccgtcgggcccaggtctcgccctgacctcacgcctcgcctccgtgtcgtgggtcctccgtggacagtcgatccaccattcctcctgcctacgtacgggaaacccaggctaaggttcggtacggttttggggttacggttttaaataaaccgttnttcggttccttcccgttacgggtaaacccaaacgacggacccaaccccgaaggaaccgaaaaccggacccccccctaaaaacttacctaacgttacggttaaactttttacgtaggtaacttcggttacctaaaccttaaaccgtccccgggtaccccttacgggttaacgggggtttttactaaacgttcccggttcctttccgttccggttacgggtcccttaaccggtaacggtttcgtacgggaaccaaaacccgtccggtcccccttcccgtacgtaacccctacgttcccgtcggttaccgggtacccttaccgggacggtccggttacgggaaaccggggtaaccgggtacgggtaccgttagggttaaactttttaacgtttaaccggttcggacccgtaacgggtacccttaacgtaacttaaacgttaaaccccgaacgttaccccaaacccggtaaccgtacccttaaccgtttaccgtacctttaacgttccggtttttacccggttaacccgggtaaaccgggtttaacggggtaaacccccggttaaacgggttaccccgtaaacccccgggtttaccggttttaaaccggggtcccctaaaacccggggtaaccccccggttaaaaccgggaacccccccgtaaacccccttaacccgg

SEQ ID NO: 198998 - DNA, 497 bp, Homo sapiens
  misc_feature: GYAE6OF02FWFKZ.18.59.F04.1.454.CMB.1.raw
  modified_base (485)..(485): a, c, t, g, unknown or other
  misc_feature (485)..(485): n is a, c, g, or t
  modified_base (491)..(493): a, c, t, g, unknown or other
  misc_feature (491)..(493): n is a, c, g, or t
  modified_base (495)..(497): a, c, t, g, unknown or other
  misc_feature (495)..(497): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattatactgcagctcatatacaagcagcagcactcaagtcttcggaactgggaccaggtcaccgtctaggtcagcccaaggcccaacccactcgtcactctcgttcccgccttcctccatacctcgtactgacgcggctggcaaggcncatcgnnncnnn

SEQ ID NO: 198999 - DNA, 546 bp, Homo sapiens
  misc_feature: GYAE6OF02HWRDZ.18.59.F04.1.454.CMB.1.raw
  modified_base (466)..(466): a, c, t, g, unknown or other
  misc_feature (466)..(466): n is a, c, g, or t
  modified_base (474)..(474): a, c, t, g, unknown or other
  misc_feature (474)..(474): n is a, c, g, or t
tcagtacgagtatgcacgaccggtgctcgatttagtacacacacttagggattgggggggagaggagccccagccttgggattcccaagtgttttcattcagtgatcaggactgaacacagaggactcaccatggagtttgggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccgagggaagggcctgggagtggatctcacttattatagtggtggtaccacatactacacagactcgtgaaggccattccacatctcagaacgacaacttccaaggaacacattgtatcttacaaatgaataactgagagcgagacacggcatgtattacngtgtgggntatttactggacccgtggggacccgggtacccgtggtccaccgtccctccccaccctcccgacccgaaccgg

SEQ ID NO: 199000 - DNA, 542 bp, Homo sapiens
  misc_feature: GYAE6OF02JP1S6.18.59.F04.1.454.CMB.1.raw
  modified_base (252)..(252): a, c, t, g, unknown or other
  misc_feature (252)..(252): n is a, c, g, or t
  modified_base (365)..(365): a, c, t, g, unknown or other
  misc_feature (365)..(365): n is a, c, g, or t
  modified_base (432)..(432): a, c, t, g, unknown or other
  misc_feature (432)..(432): n is a, c, g, or t
  modified_base (536)..(536): a, c, t, g, unknown or other
  misc_feature (536)..(536): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactntgtctcctggtaccaacagcacccaggcaaacgcccccaaactcatgatttatgatgtcactaatcggccctgagggtttctaatcgtcttctctggctcaagtctggcaacncgccctcctagaccatcctcgtcgggctccgaggcttggacggacggaggcctggtacttagttacngcagctacatatacgagtcaggcagcactacgtaagttcttaccggaagtccggaacgtaacgtccgaccgtcgtaggtcacggaccccgaaggccctaacccngtaccg

SEQ ID NO: 199001 - DNA, 511 bp, Homo sapiens
  misc_feature: GYAE6OF02JA26Y.18.59.F04.1.454.CMB.1.raw
  modified_base (253)..(253): a, c, t, g, unknown or other
  misc_feature (253)..(253): n is a, c, g, or t
  modified_base (305)..(305): a, c, t, g, unknown or other
  misc_feature (305)..(305): n is a, c, g, or t
  modified_base (373)..(373): a, c, t, g, unknown or other
  misc_feature (373)..(373): n is a, c, g, or t
  modified_base (442)..(442): a, c, t, g, unknown or other
  misc_feature (442)..(442): n is a, c, g, or t
  modified_base (451)..(451): a, c, t, g, unknown or other
  misc_feature (451)..(451): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactntgtctcctggtaccaacagcacccaggcaaacgcccccaaatcatgatttangatgtcactaatcgccctcgagggtttcaatcgcttctctggctccaagtctggcacacggcctcccngaccatctctgggctcgaggctgaggacgaggctgtattattactgctagctcaatactacagcaaccngccactctntatgtctacggacgtcggaacctaggtccaccgtcgtacgcagtcccaagcccacctacg

SEQ ID NO: 199002 - DNA, 592 bp, Homo sapiens
  misc_feature: GYAE6OF02I4PV3.18.59.F04.1.454.CMB.1.raw
  modified_base (205)..(205): a, c, t, g, unknown or other
  misc_feature (205)..(205): n is a, c, g, or t
  modified_base (242)..(242): a, c, t, g, unknown or other
  misc_feature (242)..(242): n is a, c, g, or t
  modified_base (331)..(331): a, c, t, g, unknown or other
  misc_feature (331)..(331): n is a, c, g, or t
tcagtacgagtatgcacgaccggtgctcgatttagtacacacacttagggattggggagagagacccctcccctgggatcctgggcccagtctgccctgactcagcctgcctccgtgtctgggtctcctggacagtcgatcaccatctcctgcactggaaccagcagtgacgttggtggttataactatgtctcctggtaccaanagcacccaggcaaaacgcccccaaactcatgatttangattgtacactaatccggcctcgtaggggtttctaatcgcttctctcggtctcaagtctggaccaaacgccggcctccctgacccatcncgttcgggcctccgaggtctagggacggacgaggctgtaatttacttactgcagctacatatacaagtcaccagctactctctatgtcttcggaactgggaaccacgtccgaccgtctcgtacacgcccaacgcccacccgtactcgtacctaccttactccgttacccctacccgtcctaccacttacctacgttaaccgtcggtaacggcccgggttaccgtacggaccgaacggccggtacctagtaacggtcctgac

SEQ ID NO: 199003 - DNA, 588 bp, Homo sapiens
  misc_feature: GYAE6OF02I71SM.18.59.F04.1.454.CMB.1.raw
  modified_base (227)..(227): a, c, t, g, unknown or other
  misc_feature (227)..(227): n is a, c, g, or t
  modified_base (246)..(246): a, c, t, g, unknown or other
  misc_feature (246)..(246): n is a, c, g, or t
  modified_base (303)..(303): a, c, t, g, unknown or other
  misc_feature (303)..(303): n is a, c, g, or t
  modified_base (430)..(430): a, c, t, g, unknown or other
  misc_feature (430)..(430): n is a, c, g, or t
tcagtacgagtatgcacgaccggtgctcgatttagtacacacacttagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttanaactatgtctcctggtaccaacagcaccaggcaaacgccccaaaactcatgatttangatgtacactaatcgccctctagggtttctaagtcgtcttctctcggctccaagtctggacaacacggcctccctcgaccactctctcgggcctccgaggcttgacggacgacggctgattattacngccagctacatactacgaacacctacaacgcaactcgttcctagtacgttccgttaacggtacctcggggaacccgtaaacgggttccaaccccggtttaccgtaacggtaccgtaacccgtaccccggaaaccggtaccccaaaccccgttaaccgg

SEQ ID NO: 199004 - DNA, 520 bp, Homo sapiens
  misc_feature: GYAE6OF02FR9XR.18.59.F04.1.454.CMB.1.raw
  modified_base (364)..(364): a, c, t, g, unknown or other
  misc_feature (364)..(364): n is a, c, g, or t
  modified_base (435)..(435): a, c, t, g, unknown or other
  misc_feature (435)..(435): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcaccaggcaaagcccccaaactcatgatttatgatgtcactaatcgccctcgaggggtttctaatcgcttctctgctccaagtctgcaacncggcctccctgacccatctcgtcggcctccgaggctggaggacgaggctgtatttatactgcagctcatanacaagcaacagcactctctatcttctcggaacgtgggaaccaggtcctaccgtcgtaggtccacgcccaacggcccaaccctacg

SEQ ID NO: 199005 - DNA, 645 bp, Homo sapiens
  misc_feature: GYAE6OF02I6FXM.18.59.F04.1.454.CMB.1.raw
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagccaccaggacaaacgccccaaactcatgatttatgatgtcactaactccggcctgtacgggtttctaacgtcgtcttctctggctaccgaagttctcggaccaaccgaccggtccctccctacgaccctacttccgtacgtcgggcctccgacggtcgtaggacgggaccggacggtctagtactttaacttacgtcgactacgctactaattactaacaagtacccaaccaagtccctaacgttccttacttacgtcgttacccggtttacgggaaccgttacggggaaacccgtaacgggttacccgtaacccggttaccggttaaccgggtaccgtaacccggtaccccgaaaccggtaaccccccg

SEQ ID NO: 199006 - DNA, 531 bp, Homo sapiens
  misc_feature: GYAE6OF02IV4GL.18.59.F04.1.454.CMB.1.raw
  modified_base (228)..(228): a, c, t, g, unknown or other
  misc_feature (228)..(228): n is a, c, g, or t
  modified_base (252)..(252): a, c, t, g, unknown or other
  misc_feature (252)..(252): n is a, c, g, or t
  modified_base (366)..(366): a, c, t, g, unknown or other
  misc_feature (366)..(366): n is a, c, g, or t
  modified_base (379)..(379): a, c, t, g, unknown or other
  misc_feature (379)..(379): n is a, c, g, or t
  modified_base (427)..(427): a, c, t, g, unknown or other
  misc_feature (427)..(427): n is a, c, g, or t
  modified_base (431)..(431): a, c, t, g, unknown or other
  misc_feature (431)..(431): n is a, c, g, or t
  modified_base (435)..(435): a, c, t, g, unknown or other
  misc_feature (435)..(435): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataactntgtctctggtaccaacagcacccaggacaaacgcccccaaactcatgatttatgatgtcactaatccggcctcgtagggtttctaatcgtcttctctggctcaagtctgcaacncgcctcctgaccntctcgtggcctcgagctgaggacgagctgtactttattctgcagctanatanacanccacagcactctctatcgttcgttacggacgtcggaacctacggtcctacccggttccgtaggtccaccgaccccgaacggacccccaacccgtcc

SEQ ID NO: 199007 - DNA, 513 bp, Homo sapiens
  misc_feature: GYAE6OF02G4Z8V.18.59.F04.1.454.CMB.1.raw
  modified_base (421)..(421): a, c, t, g, unknown or other
  misc_feature (421)..(421): n is a, c, g, or t
  modified_base (510)..(510): a, c, t, g, unknown or other
  misc_feature (510)..(510): n is a, c, g, or t
tcagtacgagtatgcacgaccggtgctcgatttagtacacacacttagggattgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcaccaggcaaagcccccaaatcatgatttatgatgtcagtaactcggccctgagggtttctaatcgcttctctggctcaagtctggcaacacggcctcctgaccatctcgtcgggctccgaggctgaggacgaggctgattattactgcngctcatatacagcacagcactctctatgtacttcggaactcgggaacctaaggtccaaccgtctaggtccacgcccaaggcccaacccntcg

SEQ ID NO: 199008 - DNA, 502 bp, Homo sapiens
  misc_feature: GYAE6OF02FRGKL.18.59.F04.1.454.CMB.1.raw
  modified_base (452)..(452): a, c, t, g, unknown or other
  misc_feature (452)..(452): n is a, c, g, or t
  modified_base (500)..(502): a, c, t, g, unknown or other
  misc_feature (500)..(502): n is a, c, g, or t
tcagtacgagtatgcacgaccggtgctcgatttagtacacacacttagggattgggggagagagacccctcccctgggatcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaatcatgatttatgatgtcactaatcggcctcaggggtttctaatcgcttctctggctccaagtctggcaacacggcctcctgaccatctctgggctccagctgaggacgaggctgattattactgcagctcatatacaagcaccagcactctctatgtctcggaactgggaccaaggtcacgtctagcacgcccaggccaacccactcgtcactctcgttcccnccctcctccatactcgtactgacgcgggctggcgaaggcgacatacgnnn

SEQ ID NO: 199009 - DNA, 506 bp, Homo sapiens
  misc_feature: GYAE6OF02GTB5I.18.59.F04.1.454.CMB.1.raw
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggcctcgagggtttcaatcgcttctctgctcagtctggcaacacgcctcctgaccatctctcgggctccgaggctgaggacgaggctgattattactgcagctcatatacagcacagcactctctatcgtcttcggacgtggaacctaggtccaccgtctacggtcacgcccaacggcccaacccgtc

SEQ ID NO: 199010 - DNA, 510 bp, Homo sapiens
  misc_feature: GYAE6OF02G5PTN.18.59.F04.1.454.CMB.1.raw
  modified_base (386)..(386): a, c, t, g, unknown or other
  misc_feature (386)..(386): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgggtctgggtctcctggacagtcgatcaccatctcctgcactggaaccagcagtgacgttggtggttataactatgtctcctggtaccaacagcaccaggcaaagcccccaaatcatgatttatgatgtcactaatccggccctcgtagggtttctaagtcgcttctctggctcaagtctgcaacacgcctccctgaccatctcncgggtctccgaggctgaggcgaggtctgtattatactgcagtctcattactacaagcaccagcactctctatgttctcggaacgtggaccaggtcacgtctaggcacgccgacgtcccaccctc

SEQ ID NO: 199011 - DNA, 518 bp, Homo sapiens
  misc_feature: GYAE6OF02HEZG6.18.59.F04.1.454.CMB.1.raw
  modified_base (242)..(242): a, c, t, g, unknown or other
  misc_feature (242)..(242): n is a, c, g, or t
  modified_base (305)..(305): a, c, t, g, unknown or other
  misc_feature (305)..(305): n is a, c, g, or t
  modified_base (429)..(429): a, c, t, g, unknown or other
  misc_feature (429)..(429): n is a, c, g, or t
  modified_base (436)..(436): a, c, t, g, unknown or other
  misc_feature (436)..(436): n is a, c, g, or t
  modified_base (450)..(450): a, c, t, g, unknown or other
  misc_feature (450)..(450): n is a, c, g, or t
  modified_base (458)..(458): a, c, t, g, unknown or other
  misc_feature (458)..(458): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggngttataactatgtctcctggtaccaacagcacccaggcaaagcccccaaaactcatgatttangatgtcactaatccggccctcgaggggtttctaatcgcttctctggctccaagtctggacaacacggcctccctgaccatcctcgtgggcctccgaggtctggaggacgaggctgattattacngcagctnatatacaagcaccngcactctntatgtctaggacgtggaacctaggtccaccgtcaggtcacgcccgaagcccaaccctacg

SEQ ID NO: 199012 - DNA, 535 bp, Homo sapiens
  misc_feature: GYAE6OF02ILN5G.18.59.F04.1.454.CMB.1.raw
  modified_base (248)..(248): a, c, t, g, unknown or other
  misc_feature (248)..(248): n is a, c, g, or t
  modified_base (253)..(253): a, c, t, g, unknown or other
  misc_feature (253)..(253): n is a, c, g, or t
  modified_base (303)..(303): a, c, t, g, unknown or other
  misc_feature (303)..(303): n is a, c, g, or t
  modified_base (381)..(381): a, c, t, g, unknown or other
  misc_feature (381)..(381): n is a, c, g, or t
  modified_base (388)..(388): a, c, t, g, unknown or other
  misc_feature (388)..(388): n is a, c, g, or t
tcagtacgagtatgcacgaccggtgctcgatttagtacacacacttagggagttgggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttanaactntgtctctggtacaacagcaccaggcaaacgcccccaaactcatgatttangatgtcactaactcgccctgagggtttcaatcgcttctctcggctacctaagtctggacaaccgacggtcccttcccngaacccnttcctcgtcgggccctccgaggctaggaggacgtaggctaggtatttaattactgactagctcaatatacagccacagcactctctatcgtctacggactgggaccaggtcacccgtctaggccacgacccaaggccccaaccctcg

SEQ ID NO: 199013 - DNA, 530 bp, Homo sapiens
  misc_feature: GYAE6OF02HOOQ3.18.59.F04.1.454.CMB.1.raw
  modified_base (367)..(367): a, c, t, g, unknown or other
  misc_feature (367)..(367): n is a, c, g, or t
  modified_base (428)..(428): a, c, t, g, unknown or other
  misc_feature (428)..(428): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcctggtaccaacagcacccaggcaaacgcccccaaactcatgatttatgatgtcactaatccggccctcgtagggtttctaatcgcttctctgctccagtctggacaacncgcctccctgacctatcctcgtcgggcctccgaggctggaggacgaggctgtattattacngcagctacatactacagccacagcactctctatcgtcgttacggacgtacggaccaggtccaccgtaccgtacgtcacgacccaacggaccccaaccctacg

SEQ ID NO: 199014 - DNA, 501 bp, Homo sapiens
  misc_feature: GYAE6OF02HLZP2.18.59.F04.1.454.CMB.1.raw
  modified_base (305)..(305): a, c, t, g, unknown or other
  misc_feature (305)..(305): n is a, c, g, or t
  modified_base (364)..(364): a, c, t, g, unknown or other
  misc_feature (364)..(364): n is a, c, g, or t
  modified_base (416)..(416): a, c, t, g, unknown or other
  misc_feature (416)..(416): n is a, c, g, or t
  modified_base (444)..(444): a, c, t, g, unknown or other
  misc_feature (444)..(444): n is a, c, g, or t
  modified_base (500)..(500): a, c, t, g, unknown or other
  misc_feature (500)..(500): n is a, c, g, or t
tcagtacgagtatgcacgaccggtgctcgatttagtacacacacttagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgtttggtggttataactatgtctcctggtaccaacagcacccaggcaaagcccccaaactcatgatttangatgtcactaatcggccctgagggtttctaatcgcttctctggctcaagtctggcaacncgcctcctgaccatctcgtgggctccaggctgaggacgaggctgattatacngcagctcatatacaagcacagcactctntatgtctcggactgggaccaaggtcaccgtctacggcacgcccaaggcccaacccng

SEQ ID NO: 199015 - DNA, 580 bp, Homo sapiens
  misc_feature: GYAE6OF02G1OFZ.18.59.F04.1.454.CMB.1.raw
  modified_base (309)..(309): a, c, t, g, unknown or other
  misc_feature (309)..(309): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgcccccaaactcatgatttangatgtcactaatcggccctcgtagggtttctaatcgtcttctctggcctcaagtctaggacaacgaccggtccctcccgtcgacctactcctcgtcgggcctccgaggtctggacggacgaggtcttagtatttactacgtgcagtctacaatactaacaacgccaccacgacctacgttctacttagtcgttacgttacggtaacgtacgggaacctaacggttcccaacccgttccgtaggtccaacggtacccgaaccgtaacccccg

SEQ ID NO: 199016 - DNA, 557 bp, Homo sapiens
  misc_feature: GYAE6OF02H1XXT.18.59.F04.1.454.CMB.1.raw
  modified_base (363)..(363): a, c, t, g, unknown or other
  misc_feature (363)..(363): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaccagcagtgacgttggtgttaataactatgtctcctggtaccaacagcaccaggcaaacgcccccaaatcatcgatttatgatgtcactaatcgccctcgtagggtttctaatcgcttctctggctcagtctggcaacncgcctcctgaccatctctggctccgaggctggaggacgaggctgtattattactgacagtccagtataataacaagtcgaagcaagcaactaccgaagttccttacgggaacctcggggtaacctaagggtcccaacccggttaccgtacggtaccaccggaccccgaacgggacccctaaccccgcgttaccg

SEQ ID NO: 199017 - DNA, 603 bp, Homo sapiens
  misc_feature: GYAE6OF02G59BG.18.59.F04.1.454.CMB.1.raw
  modified_base (596)..(596): a, c, t, g, unknown or other
  misc_feature (596)..(596): n is a, c, g, or t
  modified_base (600)..(600): a, c, t, g, unknown or other
  misc_feature (600)..(600): n is a, c, g, or t
tcagtacgagtatgcacgaccggtgctcgatttagtacacacacttagggattggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatccggccctcaggggtttctaatcgcttctctggctccaagtctggcaacacggccctccctgaccatcctcgtgggcctccgaggctggacggacgaggctgattattactgcagtatcatatacaagtcaaccagcctactcctcttagttcgttaccgttacgggaacgttacgggaaccgtaacggtaccctaccgttaccgtacggtaccaccgaccccgtaacggcccctaaacccctacgttacgtaccctaccttccgttacccgttcccctaccctcccttacctactccgttacgtaccgtcggacggtccggtcggtacggacgacggacgactacgtcgctangtcntcg

SEQ ID NO: 199018 - DNA, 589 bp, Homo sapiens
  misc_feature: GYAE6OF02JWC90.18.59.F04.1.454.CMB.1.raw
  modified_base (228)..(228): a, c, t, g, unknown or other
  misc_feature (228)..(228): n is a, c, g, or t
  modified_base (305)..(305): a, c, t, g, unknown or other
  misc_feature (305)..(305): n is a, c, g, or t
  modified_base (461)..(461): a, c, t, g, unknown or other
  misc_feature (461)..(461): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccnggcagtgacgttggtgttataactatgtctctggtaccaacagcacccaggcaaacgccccaaactcatgactttangtatgtacactaagtccggccctcgtacgggtttactaatcgtacttcgtctcggtctccaagtcgtggacaacgacggtcctccgtcgacctatcctcgtacggtcctccgaggcgtaggacggacggacggtcgtagtacttattacgcgtacncgtctcaatactacgacgacacgacgctactctatcgtacgtcgtacgtaacggtcggtaacctaacggtacctaccgttaccgtacggtaccgaaccggtacccgaacggtacccctaccccgtacg

SEQ ID NO: 199019 - DNA, 564 bp, Homo sapiens
  misc_feature: GYAE6OF02H5JT5.18.59.F04.1.454.CMB.1.raw
  modified_base (228)..(228): a, c, t, g, unknown or other
  misc_feature (228)..(228): n is a, c, g, or t
  modified_base (305)..(305): a, c, t, g, unknown or other
  misc_feature (305)..(305): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtggttataactatgtctcctggtaccaacagcacccaggcaaagcccccaaaatcatgatttangatgtcactaatcggccctgtagggtttcaatcgcttctctggctccaagtctggcaacgcgcctccctgaccattctcgtcgggcctccgaggctgaggacgaggcttagatttagttactgacagtctacaattaataacaagccaaccgagcctactctactagttcgttccgttacggtaacgtcgggaaccctaagggtccctacccggttcgtagggttccaccggaccccaaacggtccccaaaccccgtcg

SEQ ID NO: 199020 - DNA, 526 bp, Homo sapiens
  misc_feature: GYAE6OF02FYTOB.18.59.F04.1.454.CMB.1.raw
  modified_base (248)..(248): a, c, t, g, unknown or other
  misc_feature (248)..(248): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttanaactatgtctcctggtaccaacagcacccaggcaaagcccccaaactcatgattatgatgtcactaatcggccctcgaggggtttctaatcgcttctctggctccaagtctggcaacgacgcctccctgaccatctcgtgggctccgaggtctggacggacgaggctgattatactgcagctcatatacagcacagcactctctatcgtacttacggaacgtcgggaacctaaggtccaccgtcgtaggtcacgacccaacggaccccaaccctaccg

SEQ ID NO: 199021 - DNA, 707 bp, Homo sapiens
  misc_feature: GYAE6OF02G9J96.18.59.F04.1.454.CMB.1.raw
  modified_base (231)..(231): a, c, t, g, unknown or other
  misc_feature (231)..(231): n is a, c, g, or t
  modified_base (256)..(256): a, c, t, g, unknown or other
  misc_feature (256)..(256): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacgagggtcctgggcccagtctgccctgactcagcctgcctccgtgtcgtgggtctccgtggacagtcgatcaccatctcctgcactggaaccngcagtgacgttggtgttaataactntgtctctggtaccaacagccaccgaggacaaaccgaccccaaactcactagtatttatgatcgtactaactaacgtccgccctcgtacggggtttactaacgtccgtctttactcgtcggtcctaccgtaagtcgtacggaccaaccgaccggtccctcccgtacgaccctagtcctcgtcggtcctaccgacggtcgtaggaacgggtacggacggcgttaggtaactttacgttacgttcgacgtacgtcctacgtaattaacgtaaaccgaacgtacccaacccgtacgtaccctacgttccttacgtacgttacggttaccgttaacgggtaaccggttaccgggtaacccgtaaacgggttaccccgtaacccggtttacccggttaacgggtacccgaacccggtaacccccggtaaaccggtacccccctaaccccgttaaccg

SEQ ID NO: 199022 - DNA, 564 bp, Homo sapiens
  misc_feature: GYAE6OF02HDZJL.18.59.F04.1.454.CMB.1.raw
  modified_base (377)..(377): a, c, t, g, unknown or other
  misc_feature (377)..(377): n is a, c, g, or t
  modified_base (556)..(556): a, c, t, g, unknown or other
  misc_feature (556)..(556): n is a, c, g, or t
tcagtacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgcaggctccagggaggggctggagtgggtggccgtattaaaaccaaaactgaatggtaggacaacagactacgntgcaccgtgaaggcagattcaccatctcaagagatagattacaaaaacgcacgactgtactctagacaaatgaacacgacctgaacgaaccgaggacacgagccgtagtaacttacgtagtaccacactacccctagaaacgccgtacaactactactactacggtatcggaccttagngggaaccg

SEQ ID NO: 199023 - DNA, 543 bp, Homo sapiens
  misc_feature: GYAE6OF02GRHDG.18.59.F04.1.454.CMB.1.raw
  modified_base (304)..(304): a, c, t, g, unknown or other
  misc_feature (304)..(304): n is a, c, g, or t
  modified_base (422)..(422): a, c, t, g, unknown or other
  misc_feature (422)..(422): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctctggtaccaacagcaccaggacaaacgcccccaaactcatgatttangatgtcactaactcgccctgagggtttctaatcgcttctcgtgcctcaagtctggcaacacgcctcctcgaccatctctgggcctccgaggcgtgagggacgaggctgtattaattcngcagctctatataacagccacagcctactcttatatcgttacgttacggtaacgtcgggaccctaaggtcctaaccgttcgtaacggtccacggacccgaaccggaccctaaccccgtacg

SEQ ID NO: 199024 - DNA, 824 bp, Homo sapiens
  misc_feature: GYAE6OF02JGECS.18.59.F04.1.454.CMB.1.raw
  modified_base (275)..(275): a, c, t, g, unknown or other
  misc_feature (275)..(275): n is a, c, g, or t
  modified_base (353)..(353): a, c, t, g, unknown or other
  misc_feature (353)..(353): n is a, c, g, or t
tcagtacgagtatgcacgaccggtgctcgatttagtacacacacttagggattgggggggtcgtcgaggaggcagcgctctcgggacgtctccaccatggcctgggctctgctattcctcaccctcctcactcagggcacagggtcctgggcccagtctgccctgactcagcctgcctccgtgtctgggtctccttgacagtcgatccaccatcctccgtgccactacgggaacccagcctaggtcgtacggtttgggtaggttaataaaccttntcgttacttccgtaggtaccaaacgacgcaaccccgaggacaaaccgaccccccaaaacctcactagtaattttaagngtaatcgtactaactaacgtccggacccttcgacggggtttttacaaacgttccgtccttttacgttccgtcgggttacctacccgtaacgtttccgtacgggtaccaaacgtaaccccgggtccccttacccccgttacggtaaaccctacgtttcccgttaccggttccggggttaccttccccgaacggggttcccgtacggttaaacgggggaaccgtagggggtaccttacggttaatttaaccgttttcgtaggccaacgttcctagttaactaaacgttaaccgaacgtaccgagtaccctacgggtaccaaaccgttaacgtaactttcccggttaccgggtaaaccgggttacggggaaaccctaaaccgggtttccctaaacccgggtttccgttaaacgggtcccgaaacccgggtacccccggtaaaggaccccccctaaacccccggttcgtacccgg

SEQ ID NO: 199025 - DNA, 532 bp, Homo sapiens
  misc_feature: GYAE6OF02H2KS2.18.59.F04.1.454.CMB.1.raw
  modified_base (359)..(359): a, c, t, g, unknown or other
  misc_feature (359)..(359): n is a, c, g, or t
  modified_base (527)..(532): a, c, t, g, unknown or other
  misc_feature (527)..(532): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaaacgccccccaaaactcatgatttatgatgtcactaatcggccctcaggggtttctaatcgcttctctggctccaagtctggcaacacggcctccctgaccatctctgggctccaggctgaggacgaggctgatttattactgcagctanatatacaagcaccagcactctctatgtcttcggaactgggaccaaggtcaccgtctaggtcacgcccaaggcccaaccccactcgtccaccttcctccgttccccacccttccctacctactacctcgttactcgacggcgggactcggaccgaaggccgacgatagnnnnnn

SEQ ID NO: 199026 - DNA, 548 bp, Homo sapiens
  misc_feature: GYAE6OF02GEN1N.18.59.F04.1.454.CMB.1.raw
  modified_base (365)..(365): a, c, t, g, unknown or other
  misc_feature (365)..(365): n is a, c, g, or t
  modified_base (515)..(515): a, c, t, g, unknown or other
  misc_feature (515)..(515): n is a, c, g, or t
  modified_base (540)..(540): a, c, t, g, unknown or other
  misc_feature (540)..(540): n is a, c, g, or t
  modified_base (543)..(543): a, c, t, g, unknown or other
  misc_feature (543)..(543): n is a, c, g, or t
  modified_base (546)..(546): a, c, t, g, unknown or other
  misc_feature (546)..(546): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgccccccaaaactcatgatttatgatgtcactaatcggccctcaggggtttctaatcgcttctctggctccaagtctggcaacacggcctccctgaccatctcgtcgggcctccgaggctgaggacgaggctgatttattactgcagctcatanacagcaccagcactctctatgtctcggaactgggaccaaggtccaccgtccgtaggtccacgcccaaggccccaaccctactcgtaccaccttcgttcccgttccccaccccttcctaccacttaccctcgtaacctcgacggccgggtntcggacgtaacgggcacgatacggncgntcnac

SEQ ID NO: 199027 - DNA, 559 bp, Homo sapiens
  misc_feature: GYAE6OF02JDHMO.18.59.F04.1.454.CMB.1.raw
  modified_base (217)..(217): a, c, t, g, unknown or other
  misc_feature (217)..(217): n is a, c, g, or t
  modified_base (221)..(221): a, c, t, g, unknown or other
  misc_feature (221)..(221): n is a, c, g, or t
  modified_base (228)..(228): a, c, t, g, unknown or other
  misc_feature (228)..(228): n is a, c, g, or t
  modified_base (231)..(231): a, c, t, g, unknown or other
  misc_feature (231)..(231): n is a, c, g, or t
  modified_base (250)..(250): a, c, t, g, unknown or other
  misc_feature (250)..(250): n is a, c, g, or t
  modified_base (252)..(252): a, c, t, g, unknown or other
  misc_feature (252)..(252): n is a, c, g, or t
  modified_base (268)..(268): a, c, t, g, unknown or other
  misc_feature (268)..(268): n is a, c, g, or t
  modified_base (277)..(277): a, c, t, g, unknown or other
  misc_feature (277)..(277): n is a, c, g, or t
  modified_base (287)..(287): a, c, t, g, unknown or other
  misc_feature (287)..(287): n is a, c, g, or t
  modified_base (290)..(290): a, c, t, g, unknown or other
  misc_feature (290)..(290): n is a, c, g, or t
  modified_base (295)..(295): a, c, t, g, unknown or other
  misc_feature (295)..(295): n is a, c, g, or t
  modified_base (303)..(303): a, c, t, g, unknown or other
  misc_feature (303)..(303): n is a, c, g, or t
  modified_base (319)..(319): a, c, t, g, unknown or other
  misc_feature (319)..(319): n is a, c, g, or t
  modified_base (329)..(329): a, c, t, g, unknown or other
  misc_feature (329)..(329): n is a, c, g, or t
  modified_base (341)..(341): a, c, t, g, unknown or other
  misc_feature (341)..(341): n is a, c, g, or t
  modified_base (347)..(347): a, c, t, g, unknown or other
  misc_feature (347)..(347): n is a, c, g, or t
  modified_base (361)..(361): a, c, t, g, unknown or other
  misc_feature (361)..(361): n is a, c, g, or t
  modified_base (397)..(397): a, c, t, g, unknown or other
  misc_feature (397)..(397): n is a, c, g, or t
  modified_base (404)..(404): a, c, t, g, unknown or other
  misc_feature (404)..(404): n is a, c, g, or t
  modified_base (422)..(422): a, c, t, g, unknown or other
  misc_feature (422)..(422): n is a, c, g, or t
  modified_base (471)..(471): a, c, t, g, unknown or other
  misc_feature (471)..(471): n is a, c, g, or t
  modified_base (489)..(489): a, c, t, g, unknown or other
  misc_feature (489)..(489): n is a, c, g, or t
tcagtacgagtatgcacgaccggtgctcgatttagtacacacacttagggagttgggggggtcgtcgaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcngacnctggacnagngtacgtgtgtatactactntntctcgtacgaacagcncacgtgaanacccctaacncanacgtntacttagntctcactaattcgccnctaggggttntactagctttcnctggtntcctactactcggnaacctacggcctccgtaccataacctctcgtcgggntacccgngtaacgtccgagaacggnggtacctagagttaacctttagacgttcgaacgtctacgtatacctaanaacggcaacaacggttcnctactctatcgtcttagaccgcggtaacacgtaccgtcgacgttcgcggacacccgaccgaccacccaag

SEQ ID NO: 199028 - DNA, 604 bp, Homo sapiens
  misc_feature: GYAE6OF02H0ENT.18.59.F04.1.454.CMB.1.raw
  modified_base (497)..(497): a, c, t, g, unknown or other
  misc_feature (497)..(497): n is a, c, g, or t
tcagtacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaaggccggggggtcccttagactcccctgtacagcctctggattcactttcagtaaggcctggatgaactgggtccgcaggctccgaggggaaggggctgggagtggggttggaccgtaattaaaaccaaaactgagtgggtagggacaacgagactacgctgccaccgtgaaaggcagattcacatctacaagagatagaattacaaaaagcaacgtctgtatcgtgacaatgaacagacctagacggaaccgaggacacacgaccgtnttattactgtaaccactacttcccctagaaacgccgtaacctaaccttaaccgttaaccttaaccgttaacggtactcgggtaacccgttccggtacggggacccgg

SEQ ID NO: 199029 - DNA, 767 bp, Homo sapiens
  misc_feature: GYAE6OF02HV7P1.18.59.F04.1.454.CMB.1.raw
  modified_base (270)..(270): a, c, t, g, unknown or other
  misc_feature (270)..(270): n is a, c, g, or t
  modified_base (306)..(306): a, c, t, g, unknown or other
  misc_feature (306)..(306): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcactggaaccagcagtgacgttggtgttataactatgtctctggtaccaacngcaccaggacaaacgcccccaaactcatgtatttangatgtacaactaacgtccgcctacgtacggggtttacttaagtccgtacttctcgttcggccttacctaagtcgtcggcctaccgtaccacgtccccttcccgtcggaccctacgttccgaaccggttcggggccccttaacccggacggtaccgttagggaaacggggtaaccggtacggggtaccttagggttaaactttttaacgttaccttacggacgtaacgtccttaacgaaactttaaaccttaaacccggaaacgtacccaaccccgtaaacgtcccttaacccgttaccttaaccgttaagtttaccggttaacccgttttaacgggaaaacccggttacggggtaaacccgtaaacggggtttaccccgtaaccccgggtttaccgttaaaccgggggtaacccaaccccgggtaaccccgtaaaccggtaaccccccctaaaacccccgg

SEQ ID NO: 199030 - DNA, 624 bp, Homo sapiens
  misc_feature: GYAE6OF02JCZ6X.18.59.F04.1.454.CMB.1.raw
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcctggtaccaacagcaccaggcaaacgcccccaaactcatgatttatgatgtcactaatcggcctcgtagggtttctaatcgtcttctctcggtctccgtaagtcgtggaccaaccgaccggtcccctcccctagaccctacttccgtcgtcgggtcctccgacgggtcctaggacgggacgacggcttagtattttaactacgttgaccagtcctactaattactaaccgaagcccaaccgacgacctaaccttccttacttattcgtccgtttacgggaaccgtacgggaacccgtaaagggttcccgaacccgttccgttacgggtccaaccggaccccaaacgggtccccaaacccccgtacg

SEQ ID NO: 199031 - DNA, 652 bp, Homo sapiens
  misc_feature: GYAE6OF02IVMMS.18.59.F04.1.454.CMB.1.raw
  modified_base (154)..(154): a, c, t, g, unknown or other
  misc_feature (154)..(154): n is a, c, g, or t
  modified_base (298)..(298): a, c, t, g, unknown or other
  misc_feature (298)..(298): n is a, c, g, or t
  modified_base (328)..(328): a, c, t, g, unknown or other
  misc_feature (328)..(328): n is a, c, g, or t
  modified_base (645)..(645): a, c, t, g, unknown or other
  misc_feature (645)..(645): n is a, c, g, or t
tcagtacgagtatgcacgaccggtgctcgattttagtacacacacttagggattggggagagagacccctccccctcgggagttccctgggcccagtctgccctgactcagcctgcctccgtgtctgggtctcctggacagtcgattcgaccanctcctgtcacttggaaccagtcgagtgacgttggtggttataactatgtctctggtaccaacagcaccaggccaaacgcccccaaagtcatgatttatgatgtacactaactccggcctctaggggtttcctaatcgtctttcnctgctccaagtctggcaacacggcctccgngaccatctcgtcggctccaggcgtgaggacgaggctgaatttactactgactacgctacaattactacgaagaccgaaccagacctacttcttactacttcgttaccgttacggaaacgttcgggaaaccctaaacggtcccgaaccgtttaccgtacgttaccgaaccgaccccgaacggaccccaacccgtactacgtaccaccgttccgttaccggttccccgtaccccttcctaccctaacgttaccttaccgttaccgtggaacgggtccgggaccgtacgggaccgaacgggtccgtaaccgtaggtacgngagtacg

SEQ ID NO: 199032 - DNA, 569 bp, Homo sapiens
  misc_feature: GYAE6OF02FX7LF.18.59.F04.1.454.CMB.1.raw
  modified_base (367)..(367): a, c, t, g, unknown or other
  misc_feature (367)..(367): n is a, c, g, or t
tcagtacgagtatgcacgaccggtgctcgatttagtacacacacttagggattggggtctgggaaaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtcccttagactcccctgtacagcctctggattcactttcagtaaggcctggatgaactgggtccgccaggctccagggagggctggagtgggtggccgtattaaaaccaaactgatggtagggacaanagactacgctgcaccgtgaaagcagatcacatctacaagagatgattacaaaagcaacgctgtatctagacaaagtgaacagacctagaacgaaccgaggacacgacgccgtagtacttactacgtaccactactacccgtagaacgtctacaactactactacgttacggtatacggacctcggtacgggacctaaccggg

SEQ ID NO: 199033 - DNA, 522 bp, Homo sapiens
  misc_feature: GYAE6OF02H5O63.18.59.F04.1.454.CMB.1.raw
  modified_base (512)..(512): a, c, t, g, unknown or other
  misc_feature (512)..(512): n is a, c, g, or t
  modified_base (517)..(519): a, c, t, g, unknown or other
  misc_feature (517)..(519): n is a, c, g, or t
  modified_base (521)..(522): a, c, t, g, unknown or other
  misc_feature (521)..(522): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggcctcaggggtttctaatcgcttctctggctccaagtctggcaacaccggcctcccctgaccatctctggcctccgaggctgaggacgaggctgtattattactgcagctcatatacaagcaccagcactctactatcgtcttacggaactgggaaccaaggtcccacgtcctaggtccacgacccaaggcccaacccactgccacctctccgttccccaccctcctccatacctcgtactggacggcgggctcgggacaacggtcncatgnnncnn

SEQ ID NO: 199034 - DNA, 549 bp, Homo sapiens
  misc_feature: GYAE6OF02GZKWU.18.59.F04.1.454.CMB.1.raw
  modified_base (228)..(228): a, c, t, g, unknown or other
  misc_feature (228)..(228): n is a, c, g, or t
  modified_base (457)..(457): a, c, t, g, unknown or other
  misc_feature (457)..(457): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccngcagtgacgttggtgttataactatgtctcctggtaccaacagcacccaggacaaacgcccccaaactcatgatttatgatgtcactaatccggccctcgtaggggtttctaagtcgtcttctctgctccaagtctggacaacacgcctccctgaccatcctcgtcgggcctccgaggtcgtggacgggacggaggctgtaatttattacgtgcagctcaatataacanccaacagcacctctctatcgttctacggtaacgtcggaacctaacggtccaccgttcgtacgtcgaccgacccgaacgaccccaaccctacg

SEQ ID NO: 199035 - DNA, 638 bp, Homo sapiens
  misc_feature: GYAE6OF02IHV7J.18.59.F04.1.454.CMB.1.raw
  modified_base (272)..(272): a, c, t, g, unknown or other
  misc_feature (272)..(272): n is a, c, g, or t
  modified_base (387)..(387): a, c, t, g, unknown or other
  misc_feature (387)..(387): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactaggaaccagcagtgacgttggtgttataactatgtctctggtaccaangcaccaggcaaacgccccaaactcatgattatgatgtcactaatccgcctacgtagggtttctaatcgtcttctcgtgtcctacagtctgaccaacgtacgccctcctcgacctntcgtcgtcgggtcctccgaggtctaggacggacggtaggcgttagtatttacgttacgtcgcgacgtctacgtaattaccgtaacaacgtaccaaacccacggtacctaacttacccgtacttacgttcggtttacccgttaacgggtaaccgttaccgggggtaaacccgtaaccggttaccccgtaaccccggttcccggttaaccggtacccgtaacccgtacccccgggaaacggtaccccccccgg

SEQ ID NO: 199036 - DNA, 627 bp, Homo sapiens
  misc_feature: GYAE6OF02JFASC.18.59.F04.1.454.CMB.1.raw
  modified_base (315)..(315): a, c, t, g, unknown or other
  misc_feature (315)..(315): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgtgctgacgcagccgccctcagtgtctggggccccagggcagagggtcaccatctcctgcactgggagcacctccaacagtcgggggcggttatgatgtacactggtaccagcagccttcgagggacacgcccccaaatcctcatcttggtacncaacatccggccctgacggggtccctggaccgtattcctctcggctaccgaagttctcggccaccgtcacgtccctcccgtcggcctatccgacgtcgggcctccgaggtctggacggtatggagctagacttattcgcgaccagtcctatcgactagttgacggtcttaggtacggtttcgggtttacgtacgttcggttaccgttacgggtacgtttccggtaacgggggtaaccgtaaacgggttacccgtaacccggtttaccgttaaacggtcccgtaacccggtaccccggtaaccggtacccccc

SEQ ID NO: 199037 - DNA, 592 bp, Homo sapiens
  misc_feature: GYAE6OF02HHJRB.18.59.F04.1.454.CMB.1.raw
  modified_base (449)..(449): a, c, t, g, unknown or other
  misc_feature (449)..(449): n is a, c, g, or t
tcagtacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggattttccttgctgctatttaaaggtgtccagtgtgaggtgcagctggtggagtcgtgggggaggcgttgggtaaaggccgggggggtcccttaggacctccccgtgtaccagcctcgtggattcactttcagtaaggcctggatgaactgggtccgccaggctccgagggaaggggctgggagtgggttggccgtaattaaaaccaaatgatgggtaggacaacgagacagctgcaccgtgaaagcagatcacatcacagagatgattacaaaagcaacgctagtatcgtnacaaatacgaacacgtacctaggaacgaaccggagaacaacgacgaccgtagtacttaacgtctaacccactaccgtaccctaggaacgccgtaccaaccgttacctaacctaaccttaacggtagtaccggtaccctacggg

SEQ ID NO: 199038 - DNA, 565 bp, Homo sapiens
  misc_feature: GYAE6OF02F9P16.18.59.F04.1.454.CMB.1.raw
  modified_base (470)..(470): a, c, t, g, unknown or other
  misc_feature (470)..(470): n is a, c, g, or t
  modified_base (515)..(515): a, c, t, g, unknown or other
  misc_feature (515)..(515): n is a, c, g, or t
tcagtacgagtatgcacgaccggtgctcgatttagtacacacacttagggattggggtctgggagaggagccccagccttgggattcccaagtgttttcattcagtgatcagcactgagcacagaggactcaccatggaattggggctgagctgggttttcctcgttgctattttagaaggtgtccagtgtgacgtgcagctggtggagtctgggggagcttggtccagcctggggggtccctgagactctcctgtgtaggccctgcattcatctttaatagttattggatgcacgtgggtccgccaggcgtccgggggaaggggccggaggtggggtggccaacataatgcaagatggaactgaagaagaactagtgtggactcgtggtagaagggccattccaaccgatcgtaccagacgaaccaaacaactaaacgaaccttactagtatctagacaaatcgaaacngccctagagacgaccggaaggaaccacggtctgtagtacttacgnggtcgacgaagcgcgtaggtggccgtaggggaccaggtcgggacgtcggg

SEQ ID NO: 199039 - DNA, 509 bp, Homo sapiens
  misc_feature: GYAE6OF02FHLUR.18.59.F04.1.454.CMB.1.raw
tcagtacgagtatgcacgaccggtgctcgatttagtacacacacttagggattggggggggtctcaggaggcagcgctctcgggacgtctccaccatggcctgggctctgctattcctcaccctcctcactcaggcacagggtcctgggcccagtctgccctgactcagcctgcctccgtgtctgggtctcctggacagtcgatcaccatctcctgcactggaaccagcagtgacgttggtggttataactatgtctcctggtaccaacagcaccccaggcaaacgcccccaaactcatgatttatgatgtcactaatcggccctcaggggtttctaatcgcttctctggctccaagtctggcaacacggcctccctgaccatctctgggctccgaggctgaggacgagctgattatactgcagctcatatacaagcacagcactctctatgtctcggactgggaccaaggtccaccgtcctaggtcacgcccacggtcccaaccctac

SEQ ID NO: 199040 - DNA, 561 bp, Homo sapiens
  misc_feature: GYAE6OF02GKJR2.18.59.F04.1.454.CMB.1.raw
  modified_base (228)..(228): a, c, t, g, unknown or other
  misc_feature (228)..(228): n is a, c, g, or t
  modified_base (252)..(252): a, c, t, g, unknown or other
  misc_feature (252)..(252): n is a, c, g, or t
  modified_base (305)..(305): a, c, t, g, unknown or other
  misc_feature (305)..(305): n is a, c, g, or t
  modified_base (457)..(457): a, c, t, g, unknown or other
  misc_feature (457)..(457): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataactntgtctcctggtaccaacagccacccaggcaaacgcccccaaatcatgatttangatgtcactaagtccgccctcgtagggtttctaagtcgtcttctctgctccaagtctggacaacaccgtccctccctcgacctactcctcgtcgggcctccgaggtccgtaggacgggacgaggctagtagtttacttactgacagtcctanatactacagcaccagccactctactagtcgtaccgtacggacgtcgggaactacggtcctaccgtccgtacggccaccgacccgaacggtaccccaaccctacg

SEQ ID NO: 199041 - DNA, 573 bp, Homo sapiens
  misc_feature: GYAE6OF02H7BG7.18.59.F04.1.454.CMB.1.raw
  modified_base (229)..(229): a, c, t, g, unknown or other
  misc_feature (229)..(229): n is a, c, g, or t
  modified_base (450)..(450): a, c, t, g, unknown or other
  misc_feature (450)..(450): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataactatgtctcctggtaccaacagcacccaggacaaacgcccccaaaactcatgtatttatgatgtacaactaatccggccctgtagggtttctaatcgcttctctgctaccagtcgtggaccacgaccgccctccctacgacctacttccgtcgtcgggccttccgaggtctaggacggacgaggctagtactttattacngacagctacataactaacgacgaccaaccgagacctactcttactattcgtaccttacggaacgtcgggaacctaggtcccaacccgtcgtacggtcaccggcccgaacggccccaaccctcg

SEQ ID NO: 199042 - DNA, 759 bp, Homo sapiens
  misc_feature: GYAE6OF02J3NNO.18.59.F04.1.454.CMB.1.raw
  modified_base (187)..(187): a, c, t, g, unknown or other
  misc_feature (187)..(187): n is a, c, g, or t
  modified_base (189)..(189): a, c, t, g, unknown or other
  misc_feature (189)..(189): n is a, c, g, or t
  modified_base (195)..(195): a, c, t, g, unknown or other
  misc_feature (195)..(195): n is a, c, g, or t
  modified_base (257)..(257): a, c, t, g, unknown or other
  misc_feature (257)..(257): n is a, c, g, or t
  modified_base (410)..(410): a, c, t, g, unknown or other
  misc_feature (410)..(410): n is a, c, g, or t
  modified_base (431)..(431): a, c, t, g, unknown or other
  misc_feature (431)..(431): n is a, c, g, or t
  modified_base (728)..(728): a, c, t, g, unknown or other
  misc_feature (728)..(728): n is a, c, g, or t
tcagtacgagtatgcacgaccggtgctcgatttagtacacacacttagggattggggagctctgggagaggagccccagccttgggattcccaagtgttttcattcagtgatcaggactgaacacagaggactcaccagtggagttgggctgagcgtggtattctgctgtactattaagtgcagtgngngtgctntcgtggtgagtcggtaggggagtcgtagggtaacggtccggggttctaggcctccgtgtacncggtcctcgtggtacttctacgtttacgacggtacgcctaggaattcggaaccgttcggccgactacgggctacgggaggtaacggtgtggtaggtggtacggtaacctaacttaaaacgaacgttgtacggtcggaggaaccagacgtaccncgctacggaccaaccggttanaaagtcgtaacgtactaccactacgtacgtagaaaggtctaataacggtaaacctaaacgggaaacttcccggtaactataaccggtgttaccaaagggttacgaaaccttgggaaacccttcgggaaccgtaagtaaaccgggaaccggttaacaaccgttaccggggttacgttaaacccccgtttaaggttaaccttacccgtaacccggaacccgttcccgaaccggtttaacccgggaataaaccccccggtacgttaaacccttaccgtaaccgttaccgtaaaccgggtntaacccgggtccgggtaacgtaaccccgggg

SEQ ID NO: 199043 - DNA, 622 bp, Homo sapiens
  misc_feature: GYAE6OF02H7T4O.18.59.F04.1.454.CMB.1.raw
  modified_base (188)..(188): a, c, t, g, unknown or other
  misc_feature (188)..(188): n is a, c, g, or t
  modified_base (581)..(581): a, c, t, g, unknown or other
  misc_feature (581)..(581): n is a, c, g, or t
  modified_base (583)..(583): a, c, t, g, unknown or other
  misc_feature (583)..(583): n is a, c, g, or t
  modified_base (588)..(588): a, c, t, g, unknown or other
  misc_feature (588)..(588): n is a, c, g, or t
  modified_base (591)..(591): a, c, t, g, unknown or other
  misc_feature (591)..(591): n is a, c, g, or t
  modified_base (595)..(595): a, c, t, g, unknown or other
  misc_feature (595)..(595): n is a, c, g, or t
  modified_base (597)..(597): a, c, t, g, unknown or other
  misc_feature (597)..(597): n is a, c, g, or t
  modified_base (599)..(599): a, c, t, g, unknown or other
  misc_feature (599)..(599): n is a, c, g, or t
  modified_base (607)..(607): a, c, t, g, unknown or other
  misc_feature (607)..(607): n is a, c, g, or t
  modified_base (609)..(609): a, c, t, g, unknown or other
  misc_feature (609)..(609): n is a, c, g, or t
  modified_base (611)..(611): a, c, t, g, unknown or other
  misc_feature (611)..(611): n is a, c, g, or t
  modified_base (613)..(613): a, c, t, g, unknown or other
  misc_feature (613)..(613): n is a, c, g, or t
  modified_base (615)..(616): a, c, t, g, unknown or other
  misc_feature (615)..(616): n is a, c, g, or t
  modified_base (618)..(618): a, c, t, g, unknown or other
  misc_feature (618)..(618): n is a, c, g, or t
  modified_base (620)..(621): a, c, t, g, unknown or other
  misc_feature (620)..(621): n is a, c, g, or t
tcagtacgagtatgcacgaccggtgctcgatttagtacacacacttagggagttgggggctttgtctgggtctcctggacagtcgatcaccatcctcctgcactggaaccagcagtgacgttggtggttataactatgtctcctggtaccaacagcacccaggcaaagcccccaaactcatgatttangatgtcactaatccggccctctaggggtttcctaatcgcttctcgtggctccaagtctggcaacatcggccctcctcgacctactcctcgtcgggcctaccgaggcctggacggacgaggtctgtaatttacttacgtggcaggtcctcatactacgaacgcagcacgccactaccgaacgttcgttacggaacgtagggaacccaacggttaccaacccgttcgtacgggtaccacccgacccgaaaccggaccccaaacccgtagtaccggtacctaccgttccgttccggttcccccgccccttaccctaccgtactttacccgtccggtttaaactcgggacggtccgggtcgtacgggccgaaacgggtcccaccgaagttcgacgtncncgcgngcnctcncncncacacacncncncncnncncnnc

SEQ ID NO: 199044 - DNA, 527 bp, Homo sapiens
  misc_feature: GYAE6OF02HUNPA.18.59.F04.1.454.CMB.1.raw
  modified_base (425)..(425): a, c, t, g, unknown or other
  misc_feature (425)..(425): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctctggtaccacagcaccagcaaagcccccaaatcatgatttatgatgtcactaatcgcctcgagggtttcaatcgcttctctggctcaagtctggcaacacggcctccctgacctatcctctcgggacctccgaggctaggacggacgaggctagtattattcgngcagctcaatactaacagaccaccagcactctctagttcgtcgtacggaacctgggaacctaacggtcaccgttcgtacggtcaacggcccaaggtaccccc

SEQ ID NO: 199045 - DNA, 584 bp, Homo sapiens
  misc_feature: GYAE6OF02IH9ZE.18.59.F04.1.454.CMB.1.raw
  modified_base (408)..(408): a, c, t, g, unknown or other
  misc_feature (408)..(408): n is a, c, g, or t
  modified_base (413)..(413): a, c, t, g, unknown or other
  misc_feature (413)..(413): n is a, c, g, or t
  modified_base (466)..(466): a, c, t, g, unknown or other
  misc_feature (466)..(466): n is a, c, g, or t
tcagtacgagtatgcacgaccggtgctcgatttagtacacacacttagggattgggggggagaggagccccagccttgggattcccaagtgttttcattcagtgatcaggactgaacacagaggactcaccatggagtttgggctgagctggattttccttgctgctattttaaaaaggtgtccagtgtgaggtgcagctggtggagtctgggggaggcttggtaaagccggggggtcccttagactcccctgtacagcctctggattcactttcagtaaggcctggatgaactgggtccgccaggctccaggggaaggggctgggaggtgggttgggccgtaattaaaaccaaatgatggtgggacaacagactacgctgcacccgtgaaagcagattcaccagtcncaagngatgattacaaaaagcaacggctagtatctgacaaatgaaacagtcctagganaaaccggaggaccaacagtccgtagtaattacctgtaacccacactacccctagaaacggtctacaacctactaacgtactaacggtatcggacctcggtaggggccaagggtacccg

SEQ ID NO: 199046 - DNA, 821 bp, Homo sapiens
  misc_feature: GYAE6OF02IDTBQ.18.59.F04.1.454.CMB.1.raw
tcagtacgagtatgcacgaccggtgctcgatttagtacacacacttagggattgggggagctctgggagaggagccccagccttgggattcccaagtgttttcattcagtgatcaggactgaacacagaggactcaccatggagtttgggctgagctggattttccttgctgcttattttaaaaggtgtccagtgtgaggtgcagctggtggagtcgtgggggaggcgttagggtaaacgggcccgggggggttcccttaaggacccttcccccgtagtaaccacgccctcgtggtatttcctacttttccaaggtaacggccgtggatggaacgtcggggtcccgaccgaggcccgtaccggaagggggaacgggggtcgtaggggagggtttgggggttacgggtacccggttaaacgttaaaaaaccccgaaaaacgttggaacggttcggggtacgggaaaccaaacgaacggtacctaaccggcgtacgacccgtaacccggtaaggaaacgggctaagtactttaccaacccgtaattacctaaccgaaaggtaacgtaacttaggtaaactttaaacgaaaaaacggtcccaacgtacgttagtaacttccgagtaacaaatacggaaacacgtacccgtaaggaaacccggaaccggaaggaaccaaccgacggtcccgttagtaacctttacgtacgtaaccctacctaacccgttccccgaagtaaaccggtcccgttaacctaaaccctttaaccgtaaccgtttaaacccggttaccgggttaacttaccgggtaccccgttaccgggg

SEQ ID NO: 199047 - DNA, 594 bp, Homo sapiens
  misc_feature: GYAE6OF02GVC03.18.59.F04.1.454.CMB.1.raw
tcagtacgagtatgcacgaccggtgctcgatttagtacacacacttagggattgggaggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatcctcctgcactggaaccagcagtgacgttggtgttataactatgtctctggtacaacagcaccaggacaacgccccaaactcatgtattatgatgtcagtaagtccggtcctcgtagggtttctaatcgtcttctctgctcgaagtcgtcgacacctcacgccctcctcgccactcacgtcggtctccgaggtcgtaggaggtatggacggtctacgtacttacttacgtccgaccgtacggtacctagtacgacgtagtcggtaggtcgttaggtagggtttcggttacggttacgttacggttcgttacgggtacgttacggtccgggtaaccgtacggtcccgtaccgttaccgtaacggtcgaccgacccgtaaacccgg

SEQ ID NO: 199048 - DNA, 588 bp, Homo sapiens
  misc_feature: GYAE6OF02HISWK.18.59.F04.1.454.CMB.1.raw
  modified_base (234)..(234): a, c, t, g, unknown or other
  misc_feature (234)..(234): n is a, c, g, or t
  modified_base (273)..(273): a, c, t, g, unknown or other
  misc_feature (273)..(273): n is a, c, g, or t
tcagtacgagtatgcacgaccggtgctcgatttagtacacacacttagggattgggggcgtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatccaccatctcctgcacgtggaaccngcagtgacgttggtgttatactatgtctctgtaccaacngcaccagcaacgcccaactcatgtattatgatcgtcactaatcgcctcgtagggtttcaagtcgtcttctctggctaccaagtcgtacgacaacgacggtccctcccgtgtaccacgtctcgtcgggtcctaccgaggtccgtaggaggtacgtacgggtcttaggtattacttacgtcgtacacgtctacataacgtactaacgcaacgacgtctactcgtacgtagttccgttacgttacggaacgtacgggacccgtaacggtaccgtacccgttacgtacggtaccaccggtacccggtaacgtaaccccg

SEQ ID NO: 199049 - DNA, 529 bp, Homo sapiens
  misc_feature: GYAE6OF02FIQG7.18.59.F04.1.454.CMB.1.raw
  modified_base (381)..(381): a, c, t, g, unknown or other
  misc_feature (381)..(381): n is a, c, g, or t
  modified_base (429)..(429): a, c, t, g, unknown or other
  misc_feature (429)..(429): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgcccccaaactcatgatttatgatgtcactaatcggccctcgaggggtttctaatcgcttctctggctccaagtctggcaacacggcctcccngaccatctctgggcctccgaggctggacggacgaggctgattattacngcagctcatatacaagccaccagcacttcctactatgtcgttacggaacgttacgggacctaaggtccaccgtcgtacggtcacgacccaaggtaccccc

SEQ ID NO: 199050 - DNA, 548 bp, Homo sapiens
  misc_feature: GYAE6OF02GWBQ0.18.59.F04.1.454.CMB.1.raw
  modified_base (352)..(352): a, c, t, g, unknown or other
  misc_feature (352)..(352): n is a, c, g, or t
  modified_base (538)..(538): a, c, t, g, unknown or other
  misc_feature (538)..(538): n is a, c, g, or t
  modified_base (542)..(542): a, c, t, g, unknown or other
  misc_feature (542)..(542): n is a, c, g, or t
  modified_base (548)..(548): a, c, t, g, unknown or other
  misc_feature (548)..(548): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctcaggctgaggacgaggctgattattactgcagctnatatacagcacagcactctctatgtcttacggaacgtgggaccaaggtccaccgtcctaggtcacgacccaacgcccaaccccactcgtccacttcctcgttccccacccttccctcctacttacctccgtaacgtcggacggccgggtccgtacggaccggtaacgggcccgtacgtacgtacgntacnctcgcn

SEQ ID NO: 199051 - DNA, 324 bp, Homo sapiens
  misc_feature: GYAE6OF02IXU2O.18.59.F04.1.454.CMB.1.raw
  modified_base (260)..(260): a, c, t, g, unknown or other
  misc_feature (260)..(260): n is a, c, g, or t
  modified_base (300)..(300): a, c, t, g, unknown or other
  misc_feature (300)..(300): n is a, c, g, or t
  modified_base (308)..(308): a, c, t, g, unknown or other
  misc_feature (308)..(308): n is a, c, g, or t
  modified_base (313)..(322): a, c, t, g, unknown or other
  misc_feature (313)..(322): n is a, c, g, or t
  modified_base (324)..(324): a, c, t, g, unknown or other
  misc_feature (324)..(324): n is a, c, g, or t
tcagtacgagtatgcacgaccggtgctcgatttagtacacacacttagggattggggagagaagacaggattcaggacaatctccagcatggccggcttccctctcctcctcaccctcctcactcactgtgcaggtcctggcccagtctgtgctgactcagccacctcagcgtctcgggacccccggcagacggtcaccatctcttgttctggaagcagctaccaacactcggaagtcacgcccaagctcgcccctgacnctctcgttcccacctctcactactcgtactgacgcggtcngacaggcncatgnnnnnnnnnnan

SEQ ID NO: 199052 - DNA, 547 bp, Homo sapiens
  misc_feature: GYAE6OF02JJ89K.18.59.F04.1.454.CMB.1.raw
  modified_base (230)..(230): a, c, t, g, unknown or other
  misc_feature (230)..(230): n is a, c, g, or t
  modified_base (249)..(249): a, c, t, g, unknown or other
  misc_feature (249)..(249): n is a, c, g, or t
  modified_base (539)..(539): a, c, t, g, unknown or other
  misc_feature (539)..(539): n is a, c, g, or t
  modified_base (545)..(547): a, c, t, g, unknown or other
  misc_feature (545)..(547): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaatcatgatttangatgtcagtaatcggcctnagggtttctaatcgcttctctggctccaagtctggcaacacggcctccctgaccatcctcgtgggcctccgaggctggaggacgaggctagattattactgcagctcatataacaagcagcagcactcagtctacggaactcgggaccaaggtcaccgttaccgtaggtaccacggaccccaacggtacccaaccccgactcgtacaccttaccgtcgttccccgcccttacctcctacttcctacgtaccgtgacggcggtacgtcggacaacgggtcgacgtatacgngcagcnnn

SEQ ID NO: 199053 - DNA, 467 bp, Homo sapiens
  misc_feature: GYAE6OF02G6P7T.18.59.F04.1.454.CMB.1.raw
  modified_base (385)..(385): a, c, t, g, unknown or other
  misc_feature (385)..(385): n is a, c, g, or t
  modified_base (405)..(405): a, c, t, g, unknown or other
  misc_feature (405)..(405): n is a, c, g, or t
  modified_base (448)..(448): a, c, t, g, unknown or other
  misc_feature (448)..(448): n is a, c, g, or t
  modified_base (454)..(467): a, c, t, g, unknown or other
  misc_feature (454)..(467): n is a, c, g, or t
tcagtacgagtatgcacgaccggtgctcgatttagtacacacacttagggattgggggctttgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggcctccaggctgaggacgaggctgattatactgcagctcatatacaagcaccagcactctctatgtcttcggactggaccaggtcaccgtctaggtcacgcccaaggcccaacccnctcgtcactctcgttccccnccctcctccatacctcgtactgacgccgggctgggacaaggcncatagnnnnnnnnnnnnnn

SEQ ID NO: 199054 - DNA, 634 bp, Homo sapiens
  misc_feature: GYAE6OF02I3UNL.18.59.F04.1.454.CMB.1.raw
  modified_base (229)..(229): a, c, t, g, unknown or other
  misc_feature (229)..(229): n is a, c, g, or t
  modified_base (253)..(253): a, c, t, g, unknown or other
  misc_feature (253)..(253): n is a, c, g, or t
  modified_base (477)..(477): a, c, t, g, unknown or other
  misc_feature (477)..(477): n is a, c, g, or t
tcagtacgagtatgcacgaccggtgctcgatttagtacacacacttagggagttggggggggtctcaggaggcagcgctctcgggacgtctccaccatggcctgggctctgctattccctcaccctcctcactcagggcacagggtcctgggcccagtctgccctgactcagcctgcctccgtgtctgggtctcctggacagtcgatcacatctcctgcactggaaccngcagtgacgttggtgttataactntgtctcctggtaaccaacacgcaccaggcaaacgccccaaactcatagattatgatgtcactaactcggccctcgtagggtttctaagtcgtcttcgtctcggtcctaccgtaacgtcgtacggacaaaccgaccgggtccctcccgtacgaccctacgtccgtaccgtcggggacctaccgagggtcctaggacgggacgacggtcctagtactttaatacgngacagtctacgattactaacaacgccaaccacgtcctaaccttctacgtacgttacgtaccgttacgggtaacgtaccggggaacctaacgggtcccgtaacccgttccggtaacggtcccgaacggtaccccaacggtccccctaaaccccgtacg

SEQ ID NO: 199055 - DNA, 528 bp, Homo sapiens
  misc_feature: GYAE6OF02GZLJ6.18.59.F04.1.454.CMB.1.raw
  modified_base (273)..(273): a, c, t, g, unknown or other
  misc_feature (273)..(273): n is a, c, g, or t
  modified_base (420)..(420): a, c, t, g, unknown or other
  misc_feature (420)..(420): n is a, c, g, or t
  modified_base (456)..(456): a, c, t, g, unknown or other
  misc_feature (456)..(456): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcctggtaccaacngcacccaggcaaacgcccccaaactcatgatttatgatgtcaactaatcggccctgacggggtttctaagtcgtcttctctggctccaagtctggcaacacggtccctcctgaccatcctcgtcgggctccgaggctggacggacgnggctgattatactgcagctcatacacaagcaccganccatctcttatcgttcgttcggaactgggaaccctaaggtcacccgtcgtaggtccacggcccaaggacccc

SEQ ID NO: 199056 - DNA, 648 bp, Homo sapiens
  misc_feature: GYAE6OF02HMRMC.18.59.F04.1.454.CMB.1.raw
  modified_base (307)..(307): a, c, t, g, unknown or other
  misc_feature (307)..(307): n is a, c, g, or t
  modified_base (460)..(460): a, c, t, g, unknown or other
  misc_feature (460)..(460): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttaataactatgtctctggtaccaacagcacccaggacaaacgcccccaaactcaatgatttangatgtcactaagtcgccctcgtagggtttctaagtcgtcttctcgtcggctacaagtctggaccaacgaccggtccctccctcgacctactcgtcgtcgggcctccgaggtcgtaggacggacggtacggtcgtagtaactttagtttaccgngtaccagtctacgattaactaacaacgaccaaccgacgtacctaacttccttacttaagttcgttaccgtttaccgggtaaacggttacggggtaaacccgtaacgggttacccgtaaccccggttcggttaaccggtaccgaacccggtacccccggtaaacggacccccgtaaaccccgttaccgg

SEQ ID NO: 199057 - DNA, 519 bp, Homo sapiens
  misc_feature: GYAE6OF02GBC5V.18.59.F04.1.454.CMB.1.raw
  modified_base (245)..(245): a, c, t, g, unknown or other
  misc_feature (245)..(245): n is a, c, g, or t
  modified_base (376)..(376): a, c, t, g, unknown or other
  misc_feature (376)..(376): n is a, c, g, or t
  modified_base (390)..(390): a, c, t, g, unknown or other
  misc_feature (390)..(390): n is a, c, g, or t
  modified_base (517)..(519): a, c, t, g, unknown or other
  misc_feature (517)..(519): n is a, c, g, or t
tcagtacgagtatgcacgaccggtgctcgatttagtacacacacttagggattggggagagagacccctcccctgggtatcctgggcccagtctgccctgaactcagcctgcctccgtgtctgggtctcctggacagtcgatcaccatctcctgcactggaaccagcagtgacgttggtggttataacgtatgtctccgtggtaccaacagcacccagggcaaagcccccaaactcatgatttangatgtcactaatcggcctcaggggtttctaatcgcttctctggctccaagtcctggccaacacggcctccctggaccatctcgtgggctccaggctggaggacgaggctgattagtactggcagctcatanacagcacagcactntctatgtcttcggactgggaccaggtcaccgtctaggtcaggcccaaggcccaacccgctgtccactctccgttcccaccctcctccatcctccgtactcgacgcggtctggcaaggccacatacgnnn

SEQ ID NO: 199058 - DNA, 324 bp, Homo sapiens
  misc_feature: GYAE6OF02FULNV.18.59.F04.1.454.CMB.1.raw
  modified_base (191)..(191): a, c, t, g, unknown or other
  misc_feature (191)..(191): n is a, c, g, or t
  modified_base (318)..(324): a, c, t, g, unknown or other
  misc_feature (318)..(324): n is a, c, g, or t
tcagtacgagtatgcacgaccggtgctcgatttagtacacacacttagggattggggagagaagacaggattcaggacaatctccagcatggccggcttccctctcctcctcaccctcctcactcactgtgcagggtcctgggcccagtctgtgctgactcagccaccctcagcgtctgggacccccgggnagagggtcaccatctcttgttctggaagcagctccaacatcggaatcagcccaaggcctgccccctcggtcactctgttccccgcctcctccatactcgtactgagcgggctggcaaggcgcatagnnnnnnn

SEQ ID NO: 199059 - DNA, 573 bp, Homo sapiens
  misc_feature: GYAE6OF02IEW6U.18.59.F04.1.454.CMB.1.raw
  modified_base (309)..(309): a, c, t, g, unknown or other
  misc_feature (309)..(309): n is a, c, g, or t
  modified_base (331)..(331): a, c, t, g, unknown or other
  misc_feature (331)..(331): n is a, c, g, or t
  modified_base (351)..(351): a, c, t, g, unknown or other
  misc_feature (351)..(351): n is a, c, g, or t
  modified_base (362)..(362): a, c, t, g, unknown or other
  misc_feature (362)..(362): n is a, c, g, or t
  modified_base (366)..(366): a, c, t, g, unknown or other
  misc_feature (366)..(366): n is a, c, g, or t
  modified_base (372)..(372): a, c, t, g, unknown or other
  misc_feature (372)..(372): n is a, c, g, or t
  modified_base (391)..(391): a, c, t, g, unknown or other
  misc_feature (391)..(391): n is a, c, g, or t
  modified_base (394)..(394): a, c, t, g, unknown or other
  misc_feature (394)..(394): n is a, c, g, or t
  modified_base (400)..(400): a, c, t, g, unknown or other
  misc_feature (400)..(400): n is a, c, g, or t
  modified_base (426)..(426): a, c, t, g, unknown or other
  misc_feature (426)..(426): n is a, c, g, or t
  modified_base (433)..(433): a, c, t, g, unknown or other
  misc_feature (433)..(433): n is a, c, g, or t
  modified_base (443)..(443): a, c, t, g, unknown or other
  misc_feature (443)..(443): n is a, c, g, or t
tcagtacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggagcgttggtaaaggccgggggggtcccttagacctcccctgtacagcctctggattcactttcagtaaggcctggatgaactgggtcncaggctccgagggagggctggngtggtggctataaaacaatnatggtggacanaganacgctncacgtagaagcagatcacntcncaaganatgattagaaaacgcacgctagtacnctacganaaatacgaanagcctagacgaaccgagaaccgacacgaccgtgtacttacgtacgtaccactacctaccccgtaagaacgcccttaaccgaacttacctaacttaaccgttaaccggtacgtaccggaccgttacccggg

SEQ ID NO: 199060 - DNA, 470 bp, Homo sapiens
  misc_feature: GYAE6OF02FVR40.18.59.F04.1.454.CMB.1.raw
  modified_base (450)..(450): a, c, t, g, unknown or other
  misc_feature (450)..(450): n is a, c, g, or t
  modified_base (456)..(470): a, c, t, g, unknown or other
  misc_feature (456)..(470): n is a, c, g, or t
tcagtacgagtatgcacgaccggtgctcgatttagtacacacacttagggattgggggctttgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtctaggtcagcccaaggcccaaccccactcgtccactctcgttccccaccctcctccacttacctcgtactgacgcggctggcaaggcncatagnnnnnnnnnnnnnnn

SEQ ID NO: 199061 - DNA, 514 bp, Homo sapiens
  misc_feature: GYAE6OF02IH067.18.59.F04.1.454.CMB.1.raw
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctctggtaccaacagcacccaggcaaagcccccaaaatcatgatttatgatgtcactaatcggccctgaggggtttctaatcgcttctctggctccaagtctggcaacacgcctccctgaccatctctgggcctcaggctgaggacgaggctgattattatgcagctacatataacagcaccagcactctctatgtcttacggaactgggaacctaagggtcaaccgtctaggtcacggcccaaggcccaaccctacg

SEQ ID NO: 199062 - DNA, 592 bp, Homo sapiens
  misc_feature: GYAE6OF02HZR6U.18.59.F04.1.454.CMB.1.raw
  modified_base (252)..(252): a, c, t, g, unknown or other
  misc_feature (252)..(252): n is a, c, g, or t
  modified_base (304)..(304): a, c, t, g, unknown or other
  misc_feature (304)..(304): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactntgtctctggtaccaacagcaccaggcaaagcccccaaaactcatgattttangatgtcactaatcggccctcgtaggggtttctaagtcgctttctctgctcaagtctggcaacacggcctccctgaccatctcgtgggcctccgaggcctaggacggacgaggcctagtaattattactgctagctcaattataacgaagtcaccgagtacctactctcttagttcgttacgttccgggtaaacgtcggggtaaacccaagggttaccgaaccccggtttacccgtacggttacccaacggtaacccccgaacgggtaccccctaacccccgtaaccgg

SEQ ID NO: 199063 - DNA, 527 bp, Homo sapiens
  misc_feature: GYAE6OF02JJ4LS.18.59.F04.1.454.CMB.1.raw
  modified_base (229)..(229): a, c, t, g, unknown or other
  misc_feature (229)..(229): n is a, c, g, or t
  modified_base (254)..(254): a, c, t, g, unknown or other
  misc_feature (254)..(254): n is a, c, g, or t
tcagtacgagtatgcacgaccggtgctcgatttagtacacacacttagggattgggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaaccngcagtgacgttggtggttataactntgtctcctggtaccaacagcacccaggcaaacgcccccaaactcatgatttatgatgtcataatcggccctcagggtttctaatcgcttctctgctcaagtctggctaacacggccctccctgacctatctctgggctccgaggctgacggacgaggctgattattactgctagctcatactacacgcaccgagccactctctatgtcttacgacttgggacctaaaggtccaccgtccgtacggtcacgacccgacggacccaacccctacg

SEQ ID NO: 199064 - DNA, 768 bp, Homo sapiens
  misc_feature: GYAE6OF02HPTB2.18.59.F04.1.454.CMB.1.raw
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcctggtaccaacagcaccaggacaaacgaccccaaactcatgatttatgatgtacactaatcgtccctcgtagggttctaatcgtcttctcgtcggtctaccgtaagtcgtacggaccaaccgtaccggtcccttaccccgtacgaccctaacgttcccgttccgtggggtaccctcccggaacgggtccgttacgggacgggtaaacccgggtacgggtaccgttaaggttaaacgttttaacgttttaaccgtcgtaccgtaacggttacccttacgtaaactttaaccgtaaaccgtaaaacggtacccctaaacccgtaacggaccctaaaccgtttcccgttaaccgtttacgtttaccggtttacccggtttaacccggggtaaaccggttaaccggggtaaaccccgttaaaccgggttaaccccgtaaccccgggtttacccgtaaccggggtttaacccgaaacccggtaccccccggtaaaccggtaaaccccccccg

SEQ ID NO: 199065 - DNA, 523 bp, Homo sapiens
  misc_feature: GYAE6OF02IZGOY.18.59.F04.1.454.CMB.1.raw
  modified_base (231)..(231): a, c, t, g, unknown or other
  misc_feature (231)..(231): n is a, c, g, or t
  modified_base (371)..(371): a, c, t, g, unknown or other
  misc_feature (371)..(371): n is a, c, g, or t
  modified_base (497)..(497): a, c, t, g, unknown or other
  misc_feature (497)..(497): n is a, c, g, or t
  modified_base (516)..(516): a, c, t, g, unknown or other
  misc_feature (516)..(516): n is a, c, g, or t
  modified_base (518)..(518): a, c, t, g, unknown or other
  misc_feature (518)..(518): n is a, c, g, or t
  modified_base (522)..(523): a, c, t, g, unknown or other
  misc_feature (522)..(523): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttangatgtcactaatcggcctcgaggggtttctaatcgcttctctggctccaagtctggcaacacggcctccctgaccatctctgggctccaggctgaggacgaggctgattattactgcagctacattataacaagcaaccngccactctctatgtcttacggactgggaccaaggtccaccgtccgtaggcacgaccaacggacccacccactcgtcactcctcgtccccgccctcctcctactacctcgtacctgacgccgggtcncggacacgggcacgagtgngncgcnn

SEQ ID NO: 199066 - DNA, 578 bp, Homo sapiens
  misc_feature: GYAE6OF02H4AL7.18.59.F04.1.454.CMB.1.raw
  modified_base (357)..(357): a, c, t, g, unknown or other
  misc_feature (357)..(357): n is a, c, g, or t
  modified_base (381)..(381): a, c, t, g, unknown or other
  misc_feature (381)..(381): n is a, c, g, or t
  modified_base (462)..(462): a, c, t, g, unknown or other
  misc_feature (462)..(462): n is a, c, g, or t
  modified_base (568)..(568): a, c, t, g, unknown or other
  misc_feature (568)..(568): n is a, c, g, or t
  modified_base (574)..(574): a, c, t, g, unknown or other
  misc_feature (574)..(574): n is a, c, g, or t
  modified_base (576)..(576): a, c, t, g, unknown or other
  misc_feature (576)..(576): n is a, c, g, or t
tcagtacgagtatgcacgaccggtgctcgatttagtacacacacttagggattgggggctttgcctgggtcctgggcccagtctgcctgactcagcctgcctccgtgtctgggtctcctggacagtcgatcaccatctcctgcactggaaccagcagtgacgttggtggttataactatgtctcctggtaccaacagccacccaggcaaacgcccccaaaactcatgatttatgatgtcactaatccggcctcgtaggggtttctaatccgctttctctggctccaagtctggacaacacggcctcccctgaccatctcgtcggctcgaggctaggagacgaggctgtattattacngacagtctcatacacaagccacancactctctatcgttctacggaacgttacggacctaaggtcctaccggtactacggtccacgtacccgaacgcccaaacccncttcgactacctccgtccgttaccccacccttcccgtaccacttacccgttacgtactggaccggtcgggacttacggacgaacgggtaccgacgtacgtacggcnctacgnancg

SEQ ID NO: 199067 - DNA, 550 bp, Homo sapiens
  misc_feature: GYAE6OF02IJF6E.18.59.F04.1.454.CMB.1.raw
  modified_base (371)..(371): a, c, t, g, unknown or other
  misc_feature (371)..(371): n is a, c, g, or t
  modified_base (384)..(384): a, c, t, g, unknown or other
  misc_feature (384)..(384): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagccagtgacgttggtggttataactatgtctcctggtaccaacagcacccaggcaaacgcccccaaactcatgatttatgatgtcagtaactcggccctcgtagggtttactaatcgcttctctggtctccagtctggcaacncgcctcctgaccntctcgtcggctccgagctgacggacgaggtctgatttatactgcagctcatatacagtcaccgacgcactcgttctagttcgtccttacggaacgtcgggtaaccgaaggttccgaacccgttccgtacggtcgtaaccggacccaacggtaccccaacccgtacg

SEQ ID NO: 199068 - DNA, 506 bp, Homo sapiens
  misc_feature: GYAE6OF02HZEJ4.18.59.F04.1.454.CMB.1.raw
  modified_base (349)..(349): a, c, t, g, unknown or other
  misc_feature (349)..(349): n is a, c, g, or t
  modified_base (432)..(432): a, c, t, g, unknown or other
  misc_feature (432)..(432): n is a, c, g, or t
  modified_base (500)..(500): a, c, t, g, unknown or other
  misc_feature (500)..(500): n is a, c, g, or t
  modified_base (504)..(506): a, c, t, g, unknown or other
  misc_feature (504)..(506): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcngctcatatacaagcacagcactctctatgtcttcggaactgggaccaaggtcaccgtctaggtcacgccaacggcccaacccntcgtcactctcgttcccacctcctccatacctcgtactgacgtccggctcggacgacggcacgatagnagcnnn

SEQ ID NO: 199069 - DNA, 522 bp, Homo sapiens
  misc_feature: GYAE6OF02F5BUK.18.59.F04.1.454.CMB.1.raw
  modified_base (374)..(374): a, c, t, g, unknown or other
  misc_feature (374)..(374): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgcccccaaactcatgatttatgatgtacactaatcggccctcgtagggtttctaatcgcttctctgctcagtctggcacacggcctccngaccatctctgggcctccgaggctggaggacgaggctgtattattactgcagctcaatactaacagaccacacgctactctctattcgtcgttacggaacgtcgggaacacggtccaccgttctaggtcacgccacggcccaccctcg

SEQ ID NO: 199070 - DNA, 545 bp, Homo sapiens
  misc_feature: GYAE6OF02FQJ54.18.59.F04.1.454.CMB.1.raw
  modified_base (437)..(437): a, c, t, g, unknown or other
  misc_feature (437)..(437): n is a, c, g, or t
  modified_base (538)..(539): a, c, t, g, unknown or other
  misc_feature (538)..(539): n is a, c, g, or t
  modified_base (541)..(541): a, c, t, g, unknown or other
  misc_feature (541)..(541): n is a, c, g, or t
  modified_base (543)..(544): a, c, t, g, unknown or other
  misc_feature (543)..(544): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatcgtcttcggaactgggaccaaggtccaccgtctaggtcacgcccaaggcccaaaccccnctcgtccaccttccgttcgttccccgccccttccctacccattacccgttcgtaacctcggacggtccgggtccgtggccaacgggtccgacgtagtacgnngncnnc

SEQ ID NO: 199071 - DNA, 547 bp, Homo sapiens
  misc_feature: GYAE6OF02JDI4M.18.59.F04.1.454.CMB.1.raw
  modified_base (231)..(231): a, c, t, g, unknown or other
  misc_feature (231)..(231): n is a, c, g, or t
  modified_base (439)..(439): a, c, t, g, unknown or other
  misc_feature (439)..(439): n is a, c, g, or t
  modified_base (539)..(539): a, c, t, g, unknown or other
  misc_feature (539)..(539): n is a, c, g, or t
  modified_base (547)..(547): a, c, t, g, unknown or other
  misc_feature (547)..(547): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttangatgtcactaatcggcctcaggggtttctaatcgcttctctggctccaagtctggcacacggcctccctgaccatctcgtgggctccaggctgacggacgaggctgtattattactgcagctcatatacagcaccagcactctctatgtcttcggaactggaccaagtccaccgtcctaggtccacgacccgaacggaccccaacccncgtcgtactaccttccgtccgttccccgccccttcctacccacttacctcgtaccgtcggacgccgggtcttcggaccgtaacggccgactacgtacggnacgatcan

SEQ ID NO: 199072 - DNA, 493 bp, Homo sapiens
  misc_feature: GYAE6OF02GG1RA.18.59.F04.1.454.CMB.1.raw
  modified_base (186)..(186): a, c, t, g, unknown or other
  misc_feature (186)..(186): n is a, c, g, or t
  modified_base (455)..(455): a, c, t, g, unknown or other
  misc_feature (455)..(455): n is a, c, g, or t
  modified_base (463)..(463): a, c, t, g, unknown or other
  misc_feature (463)..(463): n is a, c, g, or t
  modified_base (467)..(471): a, c, t, g, unknown or other
  misc_feature (467)..(471): n is a, c, g, or t
  modified_base (476)..(476): a, c, t, g, unknown or other
  misc_feature (476)..(476): n is a, c, g, or t
  modified_base (479)..(482): a, c, t, g, unknown or other
  misc_feature (479)..(482): n is a, c, g, or t
  modified_base (484)..(487): a, c, t, g, unknown or other
  misc_feature (484)..(487): n is a, c, g, or t
  modified_base (489)..(493): a, c, t, g, unknown or other
  misc_feature (489)..(493): n is a, c, g, or t
tcagtacgagtatgcacgaccggtgctcgatttagtacacacacttaagggattgggggctttgtctgggtctcctggacagtcgatcaccatctcctgcactggaccagcagtgacgttggtggttataactatgtctcctggtaccaacagcacccaggcaaagcccccaaactcatgatttangatgtcactaatccggccctcgaggggtttcctaatccgcttctctggctccaagtctggcaacacggcctcctgaccatctactggctccgaggctgacggacgaggcctgacttattactgctagcttcatactacaagcacgagcactctctagtcgtctacggaactgggaccaagtccaccgtctagtcacgcccaaggtcccaacccatcgccatctcgttcccgccctctccatcctcgtactgcgcggctggccaaggccnctagtcgngctnnnnntacgnagnnnntnnnngnnnnn

SEQ ID NO: 199073 - DNA, 474 bp, Homo sapiens
  misc_feature: GYAE6OF02GEWF0.18.59.F04.1.454.CMB.1.raw
  modified_base (431)..(431): a, c, t, g, unknown or other
  misc_feature (431)..(431): n is a, c, g, or t
  modified_base (446)..(446): a, c, t, g, unknown or other
  misc_feature (446)..(446): n is a, c, g, or t
  modified_base (452)..(474): a, c, t, g, unknown or other
  misc_feature (452)..(474): n is a, c, g, or t
tcagtacgagtatgcacgaccggtgctcgatttagtacacacacttagggattgggggctttgtctgggtctcctggacagtcgatcaccatctcctgcactggaaccagcagtgacgttggtggttataactatgtctcctggtaccaacagcacccaggcaaatcccccaaactcatgatttatgatgtcactaatcggccctcaggggtttctaatcgcttctctggctccaagtctggcaacacggcctccctgaccatctctgggctccaggctgaggacgaggctgattatactgcagctcatatacaagcaccagcactctctatgtcttcggaactgggaccaaggtccaccgtctaggcacgcccaaggcccaacccatcgtccactctcgttccccaccctcctccataccttcgtactgngcggctggcaaggcncatagnnnnnnnnnnnnnnnnnnnnnnn

SEQ ID NO: 199074 - DNA, 539 bp, Homo sapiens
  misc_feature: GYAE6OF02FL9BK.18.59.F04.1.454.CMB.1.raw
  modified_base (216)..(216): a, c, t, g, unknown or other
  misc_feature (216)..(216): n is a, c, g, or t
  modified_base (360)..(360): a, c, t, g, unknown or other
  misc_feature (360)..(360): n is a, c, g, or t
  modified_base (431)..(431): a, c, t, g, unknown or other
  misc_feature (431)..(431): n is a, c, g, or t
  modified_base (439)..(439): a, c, t, g, unknown or other
  misc_feature (439)..(439): n is a, c, g, or t
  modified_base (457)..(457): a, c, t, g, unknown or other
  misc_feature (457)..(457): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctccngcactggaaccagcagtgacgttggtggttataactatgtctcctggtaccaacagcacccaggcaaacgcccccaaactcatgatttatgatgtcaactaatcggccctcgagggtttctaatcgtcttctctgctcaagtcngcaacacgcctcctgaccatcctcgtcgggcctccgaggtctggaaggacgaggctgtaattatactgacngctcatanaacagacaccagcactcncttagtgtaccttcggaacgtcgggaacctaacggtcctaccggtcctacggtcaccgacccgaacggacccaacccctacg

SEQ ID NO: 199075 - DNA, 577 bp, Homo sapiens
  misc_feature: GYAE6OF02IIWJ1.18.59.F04.1.454.CMB.1.raw
  modified_base (422)..(422): a, c, t, g, unknown or other
  misc_feature (422)..(422): n is a, c, g, or t
  modified_base (441)..(441): a, c, t, g, unknown or other
  misc_feature (441)..(441): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcctggtaccaacagcacccaggcaaagcccccaaactcatgatttatgatgtcaactaagtccgccctgtacgggtttctaatccgctttctctggcctccgaagtctggacctaacgacggccctcctgacccatcttcgcgggcctccgaggctggaggacgnggctagtactttagttacngcagtctacattacaacagcaaggcaagccactactaagttccgttacggaactggggaaccctaacggtcctaacccggttaccgtaagggtcccaacggtacccccgaaacgcccctaaacccccagttacccg

SEQ ID NO: 199076 - DNA, 502 bp, Homo sapiens
  misc_feature: GYAE6OF02GMYCQ.18.59.F04.1.454.CMB.1.raw
  modified_base (312)..(312): a, c, t, g, unknown or other
  misc_feature (312)..(312): n is a, c, g, or t
  modified_base (433)..(433): a, c, t, g, unknown or other
  misc_feature (433)..(433): n is a, c, g, or t
  modified_base (452)..(452): a, c, t, g, unknown or other
  misc_feature (452)..(452): n is a, c, g, or t
  modified_base (460)..(460): a, c, t, g, unknown or other
  misc_feature (460)..(460): n is a, c, g, or t
  modified_base (497)..(502): a, c, t, g, unknown or other
  misc_feature (497)..(502): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctcngggctccaggctgagacgaggctgattattactgcagctcatatacaagcaccagcactctctatgtcttacggaactgggaccaaggtccaccgtccaggtcagcccaaggcccaacccntcgtcactcctcgttcccncccttccnccactactcgtactgagcgggctggcaggcgcatagnnnnnn

SEQ ID NO: 199077 - DNA, 649 bp, Homo sapiens
  misc_feature: GYAE6OF02JX1R2.18.59.F04.1.454.CMB.1.raw
  modified_base (229)..(229): a, c, t, g, unknown or other
  misc_feature (229)..(229): n is a, c, g, or t
  modified_base (643)..(644): a, c, t, g, unknown or other
  misc_feature (643)..(644): n is a, c, g, or t
  modified_base (646)..(646): a, c, t, g, unknown or other
  misc_feature (646)..(646): n is a, c, g, or t
  modified_base (648)..(649): a, c, t, g, unknown or other
  misc_feature (648)..(649): n is a, c, g, or t
tcagtacgagtatgcacgaccggtgctcgatttagtacacacacttaggattggggcgtttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaatcatgatttangatgtacagtaatcggccctcgaggggtttctaatccgctttcctctggcctccaaggtctgggcaaacgcggccctacccgtgaccatcctcgtgggcctccgaggcctaggaacggacgagggtcctaggtaactttagttaactggaccagtcctttacaattataaccgaagcaaggcaacgctaactacgaaagttccgttagggaaccgtaggggaccaaacgggtcctaccggttaccgtacggtaccgaacggtaccccaaaccgggtccccaaacccgtacctcggtacccaaccgttccttacccggtttaccccaccccgttcccgtaccctacgttccttacccgtaactcggaccgaccggggtcgtccggactacgggtaccgacgtaacgtacggctcnncncnn

SEQ ID NO: 199078 - DNA, 498 bp, Homo sapiens
  misc_feature: GYAE6OF02FWCBN.18.59.F04.1.454.CMB.1.raw
  modified_base (497)..(497): a, c, t, g, unknown or other
  misc_feature (497)..(497): n is a, c, g, or t
tcagtacgagtatgcacgaccggtgctcgatttagtacacacacttagggattggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctctagggtttctaatcgcttctctggctccaagtctggcaacacggcctccctgacccatctctgggctccaggctgaggcgaggctgattatactgcagctcatatacagcaccagcactctctatgtcttacggacgtggacaaggtcaccgtctagtcagcccaggccacccnc

SEQ ID NO: 199079 - DNA, 545 bp, Homo sapiens
  misc_feature: GYAE6OF02F93W5.18.59.F04.1.454.CMB.1.raw
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcctggtaccaacagcacccaggcaaagccccccaaactccatgatttatgatgtcactaatccggccctcgaggggtttctaagtcgtacttctctggctccaagtctggcaacacggtccctccctgaccctatcctctgggcctccgagggctgacggacgaggctgatttatactgcagctacatatacaagcaccagccactctctatcgttactcggtacgtcgggacctaacgggtcctaccggtctacggtccacgaccccgaggtaccccaacccctacg

SEQ ID NO: 199080 - DNA, 573 bp, Homo sapiens
  misc_feature: GYAE6OF02FWKV0.18.59.F04.1.454.CMB.1.raw
  modified_base (322)..(322): a, c, t, g, unknown or other
  misc_feature (322)..(322): n is a, c, g, or t
  modified_base (342)..(342): a, c, t, g, unknown or other
  misc_feature (342)..(342): n is a, c, g, or t
  modified_base (345)..(345): a, c, t, g, unknown or other
  misc_feature (345)..(345): n is a, c, g, or t
  modified_base (349)..(349): a, c, t, g, unknown or other
  misc_feature (349)..(349): n is a, c, g, or t
tcagtacgagtatgcacgaccggtgctcgatttagtacacacacttagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctccctggtaccaacagcaaccccaggaaaacgcccccaaactcatgatttatgatgtcactaanccggcctcaggggtttctancgnttcnctggctcaagtctaggcaacgacgccctccctgacccatccgtctcgggctcccagggtctcggaggaccgagggcctggactttattacctggcacgctcaagttctaactaagccaaccgacgcaccttccaaagttccttacgggaaccttggggaccaagggtcccaccgttaccgtagtacctacgcccgaacgccccgaacccctctacggttcaccg

SEQ ID NO: 199081 - DNA, 515 bp, Homo sapiens
  misc_feature: GYAE6OF02FE9VV.18.59.F04.1.454.CMB.1.raw
  modified_base (228)..(228): a, c, t, g, unknown or other
  misc_feature (228)..(228): n is a, c, g, or t
  modified_base (410)..(410): a, c, t, g, unknown or other
  misc_feature (410)..(410): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtggttataactatgtctcctggtaccaacagcacccaggcaaagcccccaaatccatgatttatgatgtcactaatcggccctcgaggggtttctaatcgtcttctctggctccaagtctggcaacacggcctccctgaccatctcgtgggctccgaggctgaggacgngctgtattatactgcagctcatatacagcaacagccactctctatgtctacggacgtggaccaaggtccaccgtctacggtcacgcccaacggcccaaccctacg

SEQ ID NO: 199082 - DNA, 509 bp, Homo sapiens
  misc_feature: GYAE6OF02HWU7G.18.59.F04.1.454.CMB.1.raw
  modified_base (304)..(304): a, c, t, g, unknown or other
  misc_feature (304)..(304): n is a, c, g, or t
  modified_base (324)..(324): a, c, t, g, unknown or other
  misc_feature (324)..(324): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcctggtaccaacagcacccaggcaaagcccccaaactcatgatttangatgtcactaatcggccctnaggggtttctaatcgcttctctggctcaagtctgcacacgcctcctgaccatctctggctccgagctgacggacgaggctgattattctgcagctcatacgtacaagcaccagcactctctatcgtcttacggacgtggacctaggtccaccgtcgtacggtcacgacccgaacgcccaccctcg

SEQ ID NO: 199083 - DNA, 563 bp, Homo sapiens
  misc_feature: GYAE6OF02GEVGG.18.59.F04.1.454.CMB.1.raw
  modified_base (306)..(306): a, c, t, g, unknown or other
  misc_feature (306)..(306): n is a, c, g, or t
  modified_base (557)..(557): a, c, t, g, unknown or other
  misc_feature (557)..(557): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttaataactatgtctcctggtaccaacagcaccaggcaaacgcccccaaactcatgatttangatgtacagtaatcggccctcgtaggggtttctaatcgcttctctgctcaagtctggcacacgcctcctcgacctatcctcgtcgggcctccgacggtctaggacggaccggaggtcctgtaatttattactgcagctacataactacaagcagcgagactactactaagttcttaccggaacgtacgggaacctaacggtaccacccggttaccgtaggtccacggacccgaacggaccccaaccccgtntacccg

SEQ ID NO: 199084 - DNA, 525 bp, Homo sapiens
  misc_feature: GYAE6OF02I4EBU.18.59.F04.1.454.CMB.1.raw
  modified_base (367)..(367): a, c, t, g, unknown or other
  misc_feature (367)..(367): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgccactggaaccagcagtgacgttggtggttataactatgtctcctggtaccaacagcacccaggcaaacgcccccaaactcatgatttatgatgtacactaatcggccctcgtagggtttctaatcgcttctctggctcagtctgcaacncgcctccctgaccatctcgtcggctccgaggctggacggacgaggctagtattattactgcagctacatactacagcacagcactctctatcgtcttacggaacgtgggacctaggtccaccgtcgtacggtccacgacccaacggacccaccctacg

SEQ ID NO: 199085 - DNA, 502 bp, Homo sapiens
  misc_feature: GYAE6OF02I9EED.18.59.F04.1.454.CMB.1.raw
  modified_base (304)..(304): a, c, t, g, unknown or other
  misc_feature (304)..(304): n is a, c, g, or t
  modified_base (402)..(402): a, c, t, g, unknown or other
  misc_feature (402)..(402): n is a, c, g, or t
  modified_base (414)..(414): a, c, t, g, unknown or other
  misc_feature (414)..(414): n is a, c, g, or t
tcagtacgagtatgcacgaccggtgctcgatttagtacacacacttagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgcccccaaatcatgatttangatgtcactatcgcctgagggtttcaatcgcttctctgctccagtctggcaacacggcctccctgaccatcctcgtcgggctccgaggctgaggacgnggctgattatcngcagctcatatacagcacagcactctactatcgtcttcgacgtggaccaggtccaccgtctaggtccacgcccaacggtcccaacctc

SEQ ID NO: 199086 - DNA, 725 bp, Homo sapiens
  misc_feature: GYAE6OF02JIXMR.18.59.F04.1.454.CMB.1.raw
  modified_base (239)..(239): a, c, t, g, unknown or other
  misc_feature (239)..(239): n is a, c, g, or t
  modified_base (317)..(317): a, c, t, g, unknown or other
  misc_feature (317)..(317): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcaactgcctcgtgtctgggtctccgtggacagtcgatcaccatctcctgcacgtggaacccagcaggtnacggttggtggttaataactatgtctcctggtaaccaacacgcacccaggacaaacgccccaaactcactgtatttangtatgtactaactaacgtccgtcctacgtacggggtttactaatcgtctttacgtctacggcctaccgtaagtctcggaccgtaacgtacccgcccttccgtacgacctactcctacggtcggctacccgaggtcgtcggaacggacggacggtcgttaacgtaacttttagttacccgtagactacgtaccgttaacaacgtttaacgtaacgtaaacggtacccaaccggtaactacctaacttaaccgttcttaacgttccggtttaaccggttaaccgggttaaccggttaaccgggtaaccggttaaaacccgggtttccccgtaaccgggttaacccgttaacgggtaccccgttaacccggtaaccccggtaaaccccggtaacccccgttaaacccccgg

SEQ ID NO: 199087 - DNA, 556 bp, Homo sapiens
  misc_feature: GYAE6OF02JPSKC.18.59.F04.1.454.CMB.1.raw
  modified_base (182)..(182): a, c, t, g, unknown or other
  misc_feature (182)..(182): n is a, c, g, or t
  modified_base (309)..(309): a, c, t, g, unknown or other
  misc_feature (309)..(309): n is a, c, g, or t
  modified_base (350)..(350): a, c, t, g, unknown or other
  misc_feature (350)..(350): n is a, c, g, or t
  modified_base (378)..(378): a, c, t, g, unknown or other
  misc_feature (378)..(378): n is a, c, g, or t
  modified_base (403)..(403): a, c, t, g, unknown or other
  misc_feature (403)..(403): n is a, c, g, or t
  modified_base (419)..(419): a, c, t, g, unknown or other
  misc_feature (419)..(419): n is a, c, g, or t
  modified_base (423)..(423): a, c, t, g, unknown or other
  misc_feature (423)..(423): n is a, c, g, or t
  modified_base (426)..(427): a, c, t, g, unknown or other
  misc_feature (426)..(427): n is a, c, g, or t
  modified_base (438)..(438): a, c, t, g, unknown or other
  misc_feature (438)..(438): n is a, c, g, or t
  modified_base (449)..(449): a, c, t, g, unknown or other
  misc_feature (449)..(449): n is a, c, g, or t
tcagtacgagtatgcacgaccggtgctcgatttagtacacacacttagggattggggggggtcgtcaggaggcagcgctctcgggacgtctccaccatggcctgggctctgctattcctcaccctcctcactcagggcacagggtcctgggcccagtctgccctgactcagcctgcctccgngtctgggtctcctggcagtcgatcaccatctcctgcactggaaccagcagtgacgttgggtgttataactatgtctcctggtaccaacagccaccaggacaaacgcccccaaactccaatgatttangatgtcactaagtcgccctgtagggtttcaatcgcttctcngctccagtctgcacacggcctcctgacnctctgtcggctcgagctggagacgngtctgtattaattcgnacgnctnntactacagacngcacgcacgtnaagttcctacgggaacgtcgggaaaccctaaggttccgaacccgtttacccggaggttacccaacgggaccccctaaacgggaccccctaaccccgtacgttaccgg

SEQ ID NO: 199088 - DNA, 673 bp, Homo sapiens
  misc_feature: GYAE6OF02J1887.18.59.F04.1.454.CMB.1.raw
  modified_base (274)..(274): a, c, t, g, unknown or other
  misc_feature (274)..(274): n is a, c, g, or t
  modified_base (299)..(299): a, c, t, g, unknown or other
  misc_feature (299)..(299): n is a, c, g, or t
  modified_base (309)..(309): a, c, t, g, unknown or other
  misc_feature (309)..(309): n is a, c, g, or t
  modified_base (470)..(470): a, c, t, g, unknown or other
  misc_feature (470)..(470): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctccgtgtaccaacngcacccaggccaaacgccccaaacncatgatttangtatgtacactaactccggcctagtacgggtttctaagtcgtcttctcgtcggctaccgtaagtcgtcgacacgtaccggccctcctagaccatcctcgtcgggcctaccgaggtcgtaggacgggacgtacgggcttaggtaacgttttacgttaaccgngtactaccgtacgtacgttaattaacccggtaaacaaaccggaccctaaaccgaccggtaacctaccctttaccgtttaccttagttccggttttaccggttaaacccgggttacggtaaccgggtaaccttacccggttaccgtaaccccggtttaccgaacggttacccggaccgttacccccggaaccggtaaccccccg

SEQ ID NO: 199089 - DNA, 565 bp, Homo sapiens
  misc_feature: GYAE6OF02I1B5B.18.59.F04.1.454.CMB.1.raw
tcagtacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggatttccttgctgctatttaaaagtgtccagtgtgaggtgcagctggtggagtctgggggaggcttggtaaagccggggggtccttagactcccctgtacagcctctggattcactttcagtaaggcctggatgaactgggtccgcaggctcgaggggaggggctggagtgggtggcgtataaaccaaatgatggtaggacacagactacgctgcaccgtgaaagcagacttcacctatctacgaagagatagattacaaaaagcaacgctagtatctacgactaaagtcgaaacagcctagaacgaaccgacgaacgacagtccgtagttaacttactcgtacctacgacctcccgtaagaacgtcgtactaacctactactacgtacggtactacggacccgtcgg

SEQ ID NO: 199090 - DNA, 529 bp, Homo sapiens
  misc_feature: GYAE6OF02HL0TN.18.59.F04.1.454.CMB.1.raw
  modified_base (227)..(227): a, c, t, g, unknown or other
  misc_feature (227)..(227): n is a, c, g, or t
  modified_base (303)..(303): a, c, t, g, unknown or other
  misc_feature (303)..(303): n is a, c, g, or t
  modified_base (359)..(359): a, c, t, g, unknown or other
  misc_feature (359)..(359): n is a, c, g, or t
  modified_base (371)..(371): a, c, t, g, unknown or other
  misc_feature (371)..(371): n is a, c, g, or t
tcagtacgagtatgcacgaccggtgctcgatttagtacacacacttagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataactatgtctctggtaccaacagcaccaggcaaacgcccccaaatccatcgatttangatgtcactaatcggcctcgagggtttctaatcgcttctctgctcaagtctgcacncgcctcctgacntctctggctccgagctgacggacgaggctgactttattactgcagtcctacagtactacaagccaaccagcctaactctctatcgtacgttacggacgtcgggaccaggtccaccgttcctacggtccacgaccccgaacggcccctaaccccgtacg

SEQ ID NO: 199091 - DNA, 560 bp, Homo sapiens
  misc_feature: GYAE6OF02IOVOS.18.59.F04.1.454.CMB.1.raw
  modified_base (439)..(439): a, c, t, g, unknown or other
  misc_feature (439)..(439): n is a, c, g, or t
  modified_base (444)..(444): a, c, t, g, unknown or other
  misc_feature (444)..(444): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctgtaccaacagcaccaggcaaacgccccaaactcatgatttatgatgtcactaactcggccctcaggggtttactaatcgtcttctctggctccgaagtctggacaacaccggcctccctagaccatctcgtcggctccgaggctggtaggacgacggctgtattacttacgtgcngctanatacgtacaagcaaccagcaactactagttaccgttacggaacgtcgggaaccgtaagggtacctacccggttaccgtacggtaccacgacccgaacgggaccccaacccgtaccg

SEQ ID NO: 199092 - DNA, 550 bp, Homo sapiens
  misc_feature: GYAE6OF02FP4JA.18.59.F04.1.454.CMB.1.raw
  modified_base (368)..(368): a, c, t, g, unknown or other
  misc_feature (368)..(368): n is a, c, g, or t
  modified_base (376)..(376): a, c, t, g, unknown or other
  misc_feature (376)..(376): n is a, c, g, or t
  modified_base (454)..(454): a, c, t, g, unknown or other
  misc_feature (454)..(454): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccagacaaacgccccccaaactcatgtatttatgatgtcactaatccggccctcgtagggtttctaatcgtcttctctgctcagtctgcaacncgcctccngaccatctcgtcggctccgagcgtggacggacgaggctgtaatttacttactgcagctacatataacagaccacgacnctactctactatcgttacgttacggaacgtcggaaccgtaacggtcctacccgtccgtacggtccgaacgacccgaacggaccccgtaaccctacg

SEQ ID NO: 199093 - DNA, 617 bp, Homo sapiens
  misc_feature: GYAE6OF02I2SU3.18.59.F04.1.454.CMB.1.raw
  modified_base (253)..(253): a, c, t, g, unknown or other
  misc_feature (253)..(253): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactntgtctcctggtaccaacagcaccaggcaaacgccccaaatcatgatttatgatgtacactaactcggccctacgtagggtttactaagtcgtcttctcgtggtcctacgaagtcgtcggactaaccgaccggtaccctcccgtagaccctacttccgtcgtcgggtcctccgaggtctacggacggacgaggtctagtaactttattacgtgacctgtctacgattaactaaccgaagtcacgtacacgtccgaacttcgtacttagttcgttacgttaacggtaacggtcggaacccgtaacggttccgtaacccgttccgtacggtaccgaaccggacccgaacggtccccctaaaccccgg

SEQ ID NO: 199094 - DNA, 614 bp, Homo sapiens
  misc_feature: GYAE6OF02GHOE4.18.59.F04.1.454.CMB.1.raw
  modified_base (307)..(307): a, c, t, g, unknown or other
  misc_feature (307)..(307): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgcccccaaactcatgtatttangatgtacactaactcggccctcgtagggtttactaatcgtcttctcgtcggcctcctaagtctcggaccaacgaccgtccctcccgtagacccagtcctcgtcgggcctccgaggtctaggacggacgacggtctagtaatttactacgtgcacgcctacattaacgtacaacgaccaacgacgtacctactcctcttacgttcgttaccgttacggtaaccggttcgggtaaccgtaacggtacccgtacccgtaccggttacggaccgaacccgtacccgaaccggtaccccaacccccgtacgg

SEQ ID NO: 199095 - DNA, 512 bp, Homo sapiens
  misc_feature: GYAE6OF02IPNGJ.18.59.F04.1.454.CMB.1.raw
  modified_base (306)..(306): a, c, t, g, unknown or other
  misc_feature (306)..(306): n is a, c, g, or t
  modified_base (446)..(446): a, c, t, g, unknown or other
  misc_feature (446)..(446): n is a, c, g, or t
tcagtacgagtatgcacgaccggtgctcgatttagtacacacacttagtgattggggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcctggtaccaacagcacccaggcaaacgcccccaaatcatgatttangatgtcactaatcggcctcgagggtttctaatcgtcttctctggctcaagtctggcaacacggcctccctgacctatcctcgtgggcctcgaggctggaggacgaggctgatttatactgcagctcatatacaagccacnacactctctatgtctggaactggacctaaggtccaccgtcgtacgtcacgacccaggcccaacccg

SEQ ID NO: 199096 - DNA, 686 bp, Homo sapiens
  misc_feature: GYAE6OF02HYTCI.18.59.F04.1.454.CMB.1.raw
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttaataactatgtctcctggtaccaacagccaccaggacaaacgcccccaaactcatgatttatgatgtcactaacgtccggtaccctcgtacggggtttctaagtccgtcttctcgtcggtcctacctagtcgtggaccaaccgaccggtccccttccccgtaggaccctacttccgtacgtcgggtccctcccgacgggtctggaacgggaaccgtacgggtcttaggtaactttacgttactcggtaccgagtcctacgaattaacgtaaccgtaacgcaacgcctaagacctaccgtacgtaacgttccgtttaaccggtaccgtaaccggggtaaccgtaacgggttacccgtaaccccggttacccgttaaccgggtaccgaacccggtaaccccgaacccgggaacccccttaacccccggtaccgttaacccgg

SEQ ID NO: 199097 - DNA, 707 bp, Homo sapiens
  misc_feature: GYAE6OF02FUUUX.18.59.F04.1.454.CMB.1.raw
  modified_base (274)..(274): a, c, t, g, unknown or other
  misc_feature (274)..(274): n is a, c, g, or t
  modified_base (309)..(309): a, c, t, g, unknown or other
  misc_feature (309)..(309): n is a, c, g, or t
tcagtacgagtatgcacgaccggtgctcgatttagtacacacacttagggattggggggggtctcaggaggcagcgctctcgggacgtctccaccatggcctgggctctgctattccctccaccctcctcactcagggcacagggtcctgggcccaaggtctgccctgactcagcctgcctccgtgtctgggtctccgtggacagtcgatcaccatctcctgcactggaacagcagtgacgttggtagttataactatgtctcctggtaccaanagcaccaggcaaacgcccccaaactcatgatttanagatgtacactaatccgcctcgtagggttctaatcgtcttctctaggcctaccgaagtcgtacggctaaccaccggtcccttcccgagaccctatccgttaccgtgggcccttccgaggtcgtagggaccggacggtacggtaccgtaggttacctttaaacgtttacgtacggtaccgtaggtacccttacaaagtttaaccgtaaaccgtaaaccggtacctaaggtaccaaaccgtccctaaaccgttcctttaccttaagttcggtttacccgtttaaccgggaacccggttacgggaaccccttaaaccgggttccgtaaccccggtttacggttaaccgggttacccgaacccggtacccccggtaaccgggaaccccccttaaccccccgg

SEQ ID NO: 199098 - DNA, 640 bp, Homo sapiens
  misc_feature: GYAE6OF02J2YYF.18.59.F04.1.454.CMB.1.raw
  modified_base (242)..(242): a, c, t, g, unknown or other
  misc_feature (242)..(242): n is a, c, g, or t
  modified_base (265)..(265): a, c, t, g, unknown or other
  misc_feature (265)..(265): n is a, c, g, or t
  modified_base (297)..(297): a, c, t, g, unknown or other
  misc_feature (297)..(297): n is a, c, g, or t
  modified_base (321)..(321): a, c, t, g, unknown or other
  misc_feature (321)..(321): n is a, c, g, or t
  modified_base (367)..(367): a, c, t, g, unknown or other
  misc_feature (367)..(367): n is a, c, g, or t
tcagtacgagtatgcacgaccggtgctcgatttagtacacacacttaggagttggggagagagaccctccctgggatctggcccagtctgccctgactcagcctgcctccgtgtctggtctcctggacagtcgatcaccatctcctgcaactggaaccagccagtcgacgttggtcggttataactatgtcgtcctggtaccaacagcctacccaggcaaagcccccaaatcatcgatttancgtatgtcagtaactcggccctntagggttcactcgcttctctggctcaagttcngacaactcgcctcctgaccagtcncgtcgggcctcgaggtctgaaggagcggctagtacttacgttacgngacctagcttacaactataaccaagccagccacgcactatcctagtgttccttacggaagtaccggtaaaccgtaggttccgtaaccgtccgttaacgaccgtaacgtaccccgaaacgtacccgtaaccccttactaccgggttacctaaccgttccgttaccgttccccggacccttaccgttacccgtaacttaccgttaccgtaaccggtacgtacggggtcccgttacggtaccgaccggttaacggccgtacgtacgttaccggctc

SEQ ID NO: 199099 - DNA, 678 bp, Homo sapiens
  misc_feature: GYAE6OF02JI0PE.18.59.F04.1.454.CMB.1.raw
  modified_base (567)..(567): a, c, t, g, unknown or other
  misc_feature (567)..(567): n is a, c, g, or t
tcagtacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgctattttaaaaggtgtccagtgtgaggtgcgagctggtggaggtccgggggaggtcgtggtccagccgtgggggtccctggaacctctcctgtcgcacgtcctcgtcggttctaccttcagtgctctgctatgactcgtcggtacccgccgtaggccgttaccggggaaagggcgtaggacggttcgggttacgggccgttaagttagaacgtacgaaacgtcgtaaacgtacggttacgacgaacgacgtactaaagtatcggtcgtcgtccggttacggagaaacggtcgtaacgttcgaacccgttaccgtacgaagtaacgtagacttaacgaaacgaacgtacggtactacttacgacgaacaacgtaggaaactcgaccgtaaagaaacccgnggtaaccgacgtacgtacgttaaacgttctacgagtagaacgtggtagtacgttacgtaggtttacgggagtttacggacggtaacgggtaacggggtacctacggtacgg

SEQ ID NO: 199100 - DNA, 647 bp, Homo sapiens
  misc_feature: GYAE6OF02GT559.18.59.F04.1.454.CMB.1.raw
  modified_base (228)..(228): a, c, t, g, unknown or other
  misc_feature (228)..(228): n is a, c, g, or t
  modified_base (306)..(306): a, c, t, g, unknown or other
  misc_feature (306)..(306): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataactatgtctcctggtaccaacagcacccaggcaaacgcccccaaactcatgtatttangatgtacaactaagtccggccctcgtaggggtttactaacgtcgtcttctcgtcggtcctccaagtctgacaacgaccgccctccctcgaccacttccgtcgtcgggtcctaccgacggtcgtaggtacgggacgacggtcgtagtaatttaacgttaccgtggacctacggtcctactaacttaacgtaaccgaaacgaccaaccgacgtacctacttacctacttacgttcgttaccgttaccggtaacgtaccggggaacccttaacgggtacccgtacccggttaccggtaacggtcctaacccggaccccgaacgggaccccctaacccgtacccg

SEQ ID NO: 199101 - DNA, 508 bp, Homo sapiens
  misc_feature: GYAE6OF02F2VIC.18.59.F04.1.454.CMB.1.raw
  modified_base (429)..(429): a, c, t, g, unknown or other
  misc_feature (429)..(429): n is a, c, g, or t
  modified_base (440)..(440): a, c, t, g, unknown or other
  misc_feature (440)..(440): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcagggtttctaatcgcttctctggctccaagtctggcaacacggcctccctgaccatctctgggctccaggctgaggacgaggctgattatactgcagctcatanacaagcaccancactctctatgtctcggacgtgggaccaaggtcaccgtcctaggtccagcccaagacccaaccctacg

SEQ ID NO: 199102 - DNA, 687 bp, Homo sapiens
  misc_feature: GYAE6OF02HC5HK.18.59.F04.1.454.CMB.1.raw
  modified_base (234)..(234): a, c, t, g, unknown or other
  misc_feature (234)..(234): n is a, c, g, or t
  modified_base (538)..(538): a, c, t, g, unknown or other
  misc_feature (538)..(538): n is a, c, g, or t
tcagtacgagtatgcacgaccggtgctcgatttagtacacacacttagggattgggggcgtggggtctcaggaggcagcgctctcgggacgtctccaccatggcctgggctctgctattcctcaccctcctcactcagggcacagggtcctgggcccagtctgccctgactcagcctgcctccggtgtctgggtctccgtggacagtcgatcaccatctcctgcactggaaccngcagtgacggttggtgttaataactatgtctcctggtaccaacagcacccaggacaaacgaccccctaaactacagtacgtatttagtcgaattcgtactacttaaacgtccggtaccccttcggtaacgggggttttacctaaatcccgtactttccgttcgtcgggtccttacccgaacgtttccggttaggaaccctaaaaccgcccgggttcccctacccgttacgaaccctatcccgttctcggggtccctccgaggtcgtaggacgggaccggacggtcttaggtactttagttacgngtacagtcctacgttaataacgttaaccaacggtacccaaccgacgtacccaaccgttcttaacctggttaccgttccgttaacggaccgttacggtaaccgaacggttccgtacccgtaccgtagtaccgacgacccgaacgtacccc

SEQ ID NO: 199103 - DNA, 623 bp, Homo sapiens
  misc_feature: GYAE6OF02IS7P3.18.59.F04.1.454.CMB.1.raw
  modified_base (228)..(228): a, c, t, g, unknown or other
  misc_feature (228)..(228): n is a, c, g, or t
  modified_base (242)..(242): a, c, t, g, unknown or other
  misc_feature (242)..(242): n is a, c, g, or t
  modified_base (253)..(253): a, c, t, g, unknown or other
  misc_feature (253)..(253): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggngttataacgtntgtctcctggtaccaacagcacccaggacaaacgcccccaaactcatgatttatagatgtacaactaatccggcccctagtacggggtttactaagtccgtcttctctcggctaccgaagttcgtcggactaacgccggtcctcccgtagacctatctcgtcggtctcgaggcctagacggacgacggtctagtacttattacgtagcaagtctacgattaactaacgaagacctaccaaggtccaaccgtctactaagttcgttaccgttacggtaaccgttaccgggaacctaacgggtaccctacccggttaccgttaaccggtacctaccggaaccccgtaaccggtacccctaacccccgtaacg

SEQ ID NO: 199104 - DNA, 559 bp, Homo sapiens
  misc_feature: GYAE6OF02F7K3S.18.59.F04.1.454.CMB.1.raw
  modified_base (446)..(446): a, c, t, g, unknown or other
  misc_feature (446)..(446): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggacaaacgccccccaaactcatgatttatgatgtcaactaatccggccctcgtaggggtttactaagtctcttctctggctccaagtctgacaacaccgcctccctgaccatctcgtggtcctcgaggctggacggacgaggctagtatttattactgctagctanatataacaagccacagctactctactagtcttcgttacggtaacgtcgggaacctaacggtcctaccggttaccgtacggaccacggaccccgaacggaccccaacccgtacg

SEQ ID NO: 199105 - DNA, 592 bp, Homo sapiens
  misc_feature: GYAE6OF02HP5H3.18.59.F04.1.454.CMB.1.raw
  modified_base (267)..(267): a, c, t, g, unknown or other
  misc_feature (267)..(267): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccattctgccctgactcagcctgcctccgtgtctgggtctcctggacagtcgatcaccatctctgcactggaccagcagtgtacgttggtgttataactatgtctctggtaccaanagcaccaggacaaacgccccaaactcatgatttatgatgtcataatccggggcctgtagggtttacaatcgtcttctctggctcagtctgacaacgacgcctcctgaccatctcgtcgggctccgaggctggacggacgacggctagtatttaacgttacgtgccaagtcctactaatactaacaacggtaccaaccacgctaattcctacgttacgttcgttaccgttaaccgggtaacgtaccggggaacctaacggtcccgtaacccgtccgttaacggtaccaaccggtaccccgaaacggtaccccctaaacccgtaccg

SEQ ID NO: 199106 - DNA, 575 bp, Homo sapiens
  misc_feature: GYAE6OF02F0W3A.18.59.F04.1.454.CMB.1.raw
  modified_base (423)..(423): a, c, t, g, unknown or other
  misc_feature (423)..(423): n is a, c, g, or t
  modified_base (452)..(452): a, c, t, g, unknown or other
  misc_feature (452)..(452): n is a, c, g, or t
tcagtacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttggtaaagccgggggggtccttagactcccctgtacagcctctggattcactttcagtaaggcctggatgaactggggtccgccaggctccgagggaaggggctgggacggtggggttcggccgtaattaaaaaccaaactgatgggtggacaacgagactacgctgcacccgtgaagcagattcaccatctcaaganatgatacaaaaagcacgactgtatcgtanactaaatgaaacagacctaggacgaaccgagacacacgccgtagtaattacctgtacccactaccgtcccctagaacgtccgtacaacttaccaacttactacggtagtacggaccttacggg

SEQ ID NO: 199107 - DNA, 507 bp, Homo sapiens
  misc_feature: GYAE6OF02JISVJ.18.59.F04.1.454.CMB.1.raw
  modified_base (251)..(251): a, c, t, g, unknown or other
  misc_feature (251)..(251): n is a, c, g, or t
  modified_base (344)..(344): a, c, t, g, unknown or other
  misc_feature (344)..(344): n is a, c, g, or t
  modified_base (351)..(351): a, c, t, g, unknown or other
  misc_feature (351)..(351): n is a, c, g, or t
  modified_base (470)..(470): a, c, t, g, unknown or other
  misc_feature (470)..(470): n is a, c, g, or t
  modified_base (498)..(498): a, c, t, g, unknown or other
  misc_feature (498)..(498): n is a, c, g, or t
  modified_base (503)..(503): a, c, t, g, unknown or other
  misc_feature (503)..(503): n is a, c, g, or t
  modified_base (506)..(506): a, c, t, g, unknown or other
  misc_feature (506)..(506): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctnaggggtttcaatcgcttctctggctccaagtctggcaacacggcctccctgaccatctctgggctccaggctggagcgaggctgattattacngcagctnatatacaagcaccagccactctctatgtcttcggaactgggacaaggtcaccgtcctaggtcagcccaaggcccaacccatcgtccactcgtcgttccccacctcctcactctcgtacngagcggctcggacaacggcgacatacgnacgcnctnc

SEQ ID NO: 199108 - DNA, 353 bp, Homo sapiens
  misc_feature: GYAE6OF02IDTOJ.18.59.F04.1.454.CMB.1.raw
  modified_base (223)..(223): a, c, t, g, unknown or other
  misc_feature (223)..(223): n is a, c, g, or t
  modified_base (256)..(256): a, c, t, g, unknown or other
  misc_feature (256)..(256): n is a, c, g, or t
  modified_base (292)..(292): a, c, t, g, unknown or other
  misc_feature (292)..(292): n is a, c, g, or t
  modified_base (323)..(324): a, c, t, g, unknown or other
  misc_feature (323)..(324): n is a, c, g, or t
  modified_base (327)..(353): a, c, t, g, unknown or other
  misc_feature (327)..(353): n is a, c, g, or t
tcagtacgagtatgcacgaccggtgctcgatttagtacacacacttagggattgggggagaggaagacaggattcaggacaatctccagcatggccggcttccctctcctcctcaccctcctcactcactgtgtagggtcctgggcccagtctgtgctgactcagcccaccctcagcgtctgggacccccgggcagagggtcaccaatctcttgttctggaancagctccaacatcggaagtcagcccaaggctcncccctggtcactctacgttccccgcctctcataccncgtactgagccggctggcctaaggcgcatgnngcnnnnnnnnnnnnnnnnnnnnnnnnnnn

SEQ ID NO: 199109 - DNA, 825 bp, Homo sapiens
  misc_feature: GYAE6OF02JY3XT.18.59.F04.1.454.CMB.1.raw
  modified_base (261)..(261): a, c, t, g, unknown or other
  misc_feature (261)..(261): n is a, c, g, or t
  modified_base (313)..(313): a, c, t, g, unknown or other
  misc_feature (313)..(313): n is a, c, g, or t
  modified_base (322)..(322): a, c, t, g, unknown or other
  misc_feature (322)..(322): n is a, c, g, or t
tcagtacgagtatgcacgaccggtgctcgatttagtacacacacttagggattgggggggtcgtcaggaggcagcgctctcgagacgtctccaccatggcctgggctctgctattcctcaccctcctcactcaggcacagggtcctgggcccagtctgccctgactcagcctgccctccgtgtctgggtcctctggacagtcgatcaccatctcctggaccactacgggaaccagcagtgacgttggtaggttaataactntgtctctcggtaccacagcacccagaccaaacgccccaaaactcacgtagtntttaaacgngttactacggtacaaccgttaacgtccgggtacccttacggttaacgggggttttacccttaaagttccggttacccttttacgtcccgttttagggtcccgttaacccgtaaaggttttcccgttacgggtaaacctaaccccgacgggttacccccttaccccgttaaccgggaacccgttactacccggtttcggttaccgggggtaacctaccccggacggggtaccttacgggaaacggggaccgtaaccgggggtccttaaagggttttaaccttttaaaacgttcccgttgggtaacccgacggttcctaaacgttaaactttaaccgaaacgtaaccgccctaagtacccggaaacttccgttacttcgttaacgttccggttacgtttaaccggggtaacttccggggaaacctttaaccgggtccccctaaggttaaccccgttggggtaacccccacggttaaccccccggtaacggacccccctaaaccgg

SEQ ID NO: 199110 - DNA, 576 bp, Homo sapiens
  misc_feature: GYAE6OF02F0KHL.18.59.F04.1.454.CMB.1.raw
  modified_base (309)..(309): a, c, t, g, unknown or other
  misc_feature (309)..(309): n is a, c, g, or t
  modified_base (361)..(361): a, c, t, g, unknown or other
  misc_feature (361)..(361): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgcccccaaactcatgatttangatgtacactaatccggcctgagggtttctaatcgtcttctctgctcagtcngcacacgcctcctgaccatctcgtcgggctccgagctggaggacgaggctagtatttattacgtgcgacgtctactattataacaacgccaaccgacgacctaccttactacttagttcgttacgtttaaccggaaccgttacggggaaccctaacgggttacccacccggttcccgtaacggtacccaaccggtaccccgaaccggtacccccc

SEQ ID NO: 199111 - DNA, 580 bp, Homo sapiens
  misc_feature: GYAE6OF02GET48.18.59.F04.1.454.CMB.1.raw
  modified_base (232)..(232): a, c, t, g, unknown or other
  misc_feature (232)..(232): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcaggacacagggtcctgggcccagtctgccctgactcagcctgcctccgtgtctgggtctcctggacagtcgatcaccatcctcctgcactggaaccngcagtgacgttggtgttataactatgtctctgtaccaacagccaccaggcaaaacgcccccaaactcatgtatttatgatgtcaagtaactcggccctcgtacgggtttctaatcgtcttctcgtcggctccgaagtctgacaaccacggtccctccctgaccctatcctcgtcgggcctccgagtcctggacggacggaggtctagtatttattactgcagtcctgaattactaacaagcaagcgaacgccaacgtctaacgttccttacggaaccgttagggaacccaacggttcccaacccggttcgtaacggtccaccggaccccgaacggacccctaaccccg

SEQ ID NO: 199112 - DNA, 603 bp, Homo sapiens
  misc_feature: GYAE6OF02F99P4.18.59.F04.1.454.CMB.1.raw
  modified_base (322)..(322): a, c, t, g, unknown or other
  misc_feature (322)..(322): n is a, c, g, or t
  modified_base (371)..(371): a, c, t, g, unknown or other
  misc_feature (371)..(371): n is a, c, g, or t
  modified_base (478)..(478): a, c, t, g, unknown or other
  misc_feature (478)..(478): n is a, c, g, or t
  modified_base (485)..(485): a, c, t, g, unknown or other
  misc_feature (485)..(485): n is a, c, g, or t
tcagtacgagtatgcacgaccggtgctcgatttagtacacacacttagggattggggagctctgggagaggagccccagcccttgggattcccaagtgttttcattcagtgatcaggactgaacacagaggactcaccatggagtttgggctgagctggattttccttgctgctatttaaaggtgtccagtgtgaggtgcagctggtggagtcgtgggggaggcgttgggtaaacgggcccgggggggttcccttaggaccttccccgtgtacacgcctctggtattcactttcagtaacggcctggatgaacgtgggtccnccaggctccgagggagggctggagtgggtgcgtaataaacaatgatggnggacaacagactacgctagcacccgtagaaacggcaagtacttcaccgtatcctacaaagacgatagtaacttacaaaaacgcaacgtctagtatcgtacgataaanacgaacngactagaacgaaccgagacacgagccgtagtactacgtcgtaccactacctcccgtaagaaccgtccgtaacctaactaaccttactaaccgttaacgtacgtacggacccgtaccgg

SEQ ID NO: 199113 - DNA, 574 bp, Homo sapiens
  misc_feature: GYAE6OF02HUA3R.18.59.F04.1.454.CMB.1.raw
  modified_base (271)..(271): a, c, t, g, unknown or other
  misc_feature (271)..(271): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttaataactatgtctcctggtaccaanagcacccaggcaaacgcccccaaatcaatgattttatgatgtacagtaatccggccctcgtaggggttttactaagtccgtactttctcttcggcctaccaagttcgtaggacaacaccggccctccctgaccatctcgtcgggctccgaggctggagacgaggctgattatactgcagctcaatataacaagcagcagcactcaacgtcgttacggaacgtacgggaaccgtaacggtaccacccggttaccgttaaggtaccgaacgtaccccaaacgggaccccaaccccgagttacccg

SEQ ID NO: 199114 - DNA, 740 bp, Homo sapiens
  misc_feature: GYAE6OF02GF0IQ.18.59.F04.1.454.CMB.1.raw
  modified_base (571)..(571): a, c, t, g, unknown or other
  misc_feature (571)..(571): n is a, c, g, or t
tcagtacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcgttgggtaaacgggccggggggttaccttaggacctccccgtgtaccacgtcctcgtggtacttctacctttcgaagtaaggccttaggatagaaccgtcgggtcccgccgaggtcctaccggaggggacgggtcgtgggaggttggggttacggtaccgttaaacgttaaaaacccgaaaacgttggtaagtggtacgggaacctaaacgacggtaactacgcgtacgacccgtaacccggtagaaacggacaagtacttaccgaccctataccgtacgaaacgtagtaagtcggaaacgttaaaccgaaaaagcctaaccggtcgttacggttaacttccgtanaaccgttaaaagtcgaaaccgtacggtacctaaggaaccgggaaaccgtagggaaaccaccggtacgtaccgtagtaaccgttactacggtacccacgtacctaccccgtaagaaccgtctaacctaactaccctaacgtaccggtaacgtagtaccggtacctacggg

SEQ ID NO: 199115 - DNA, 587 bp, Homo sapiens
  misc_feature: GYAE6OF02JDIQZ.18.59.F04.1.454.CMB.1.raw
  modified_base (302)..(302): a, c, t, g, unknown or other
  misc_feature (302)..(302): n is a, c, g, or t
  modified_base (375)..(375): a, c, t, g, unknown or other
  misc_feature (375)..(375): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcctggtaccacagcaccaggcaacgcccccaaatcatcgatttangatgtcactaatccggccctcgtagggtttctaatcgtcttctctggctccaagtctggcaacacgcctcccngaccatcctcgtcggctccgaggctaggaggacgaggctagtactttattacgtgaccagtcctactaattaactacgaagccaacgcgtaccaacttccttactacgttcgttaccttacggaaccggttcgggaacccgtaacgggtacccgtacccgttaccgtacggtaccgtaccgaccccggtaaccggacccctaaccccgtacg

SEQ ID NO: 199116 - DNA, 525 bp, Homo sapiens
  misc_feature: GYAE6OF02I6VJC.18.59.F04.1.454.CMB.1.raw
  modified_base (199)..(199): a, c, t, g, unknown or other
  misc_feature (199)..(199): n is a, c, g, or t
  modified_base (342)..(342): a, c, t, g, unknown or other
  misc_feature (342)..(342): n is a, c, g, or t
  modified_base (373)..(373): a, c, t, g, unknown or other
  misc_feature (373)..(373): n is a, c, g, or t
  modified_base (401)..(401): a, c, t, g, unknown or other
  misc_feature (401)..(401): n is a, c, g, or t
  modified_base (420)..(420): a, c, t, g, unknown or other
  misc_feature (420)..(420): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacngtcgatcaccatctcctgcactggaaccagcagtgacgttggtggttataactatgtctcctggtaccaacagccacccaggccaaacgccccccaaactcatgatttatgatgtcactaatcggccctcagggtttcaatcncttctctgctcagtctggcaacgcgcctccngaccatctctggctcaggctgaggacgnggctgattatctgcagctnatatacaagcaccagccactctctatcgtacttacggacgtcgggaactaaggtcctaccggtccgtaggtccgacgccccgaacggcccctaacccacgttccg

SEQ ID NO: 199117 - DNA, 510 bp, Homo sapiens
  misc_feature: GYAE6OF02G5XVB.18.59.F04.1.454.CMB.1.raw
  modified_base (306)..(306): a, c, t, g, unknown or other
  misc_feature (306)..(306): n is a, c, g, or t
  modified_base (326)..(326): a, c, t, g, unknown or other
  misc_feature (326)..(326): n is a, c, g, or t
  modified_base (446)..(446): a, c, t, g, unknown or other
  misc_feature (446)..(446): n is a, c, g, or t
  modified_base (508)..(508): a, c, t, g, unknown or other
  misc_feature (508)..(508): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcaccccaggcaaagcccccaaactcatgatttangatgtcactaatcggccctnaggggtttcaatcgcttctctggctccaagtctggcaacacggcctccctgacccatcctctgggcctccgaggctgaggacgaggtctgatttatactgcagctcatatacaagcaccngcactctctatgtctcggaactgggacctaggccaccgtctagtcagcccaggcccaacccncg

SEQ ID NO: 199118 - DNA, 675 bp, Homo sapiens
  misc_feature: GYAE6OF02JDYD6.18.59.F04.1.454.CMB.1.raw
  modified_base (509)..(509): a, c, t, g, unknown or other
  misc_feature (509)..(509): n is a, c, g, or t
tcagtacgagtatgcacgaccggtgctcgatttagtacacacacttagggattgggggagctctgggagaggagccccagccttgggattcccaagtgttttcattcagtgatcaggactgaacacagaggactcaccatggagtttgggctgagctggattttccttgctgcttattttaaaggtgtcagtgtgaggtgcagctggtaggagtcgtgggggaggcgttagggtaaacgggccgggggggtcccttaggacctcccccgtagtacagcctcgtggattcactttcagtacggcctaggatagaacgtcgggtccgcgaggctaccgaggggacggggctgggaggtgggttgggacgtaataaaaaccgaaacgtggagtggtaggaacaagagactaacgcgtacgaccgaccgtagaaacggcagtactccaactatctacaagactatgaataacaaaagcacgtactagtatactagaacaaagtacgaaaccgngtacccgtagaaaccgaaccgaacggtaaccacgacgtaacccggtattaacgttacgtaaccggtacctaacgaaccccgtttccccgaaaggaaaccgtccgaaccttaaaccgtaacctttaacccgtacgttaaccgggtagttacccggtaaccgtacggg

SEQ ID NO: 199119 - DNA, 580 bp, Homo sapiens
  misc_feature: GYAE6OF02HNMUC.18.59.F04.1.454.CMB.1.raw
  modified_base (228)..(228): a, c, t, g, unknown or other
  misc_feature (228)..(228): n is a, c, g, or t
  modified_base (251)..(251): a, c, t, g, unknown or other
  misc_feature (251)..(251): n is a, c, g, or t
  modified_base (353)..(353): a, c, t, g, unknown or other
  misc_feature (353)..(353): n is a, c, g, or t
  modified_base (361)..(361): a, c, t, g, unknown or other
  misc_feature (361)..(361): n is a, c, g, or t
  modified_base (433)..(433): a, c, t, g, unknown or other
  misc_feature (433)..(433): n is a, c, g, or t
tcagtacgagtatgcacgaccggtgctcgatttagtacacacacttagggagttgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctctgcactggaaccngcagtgacgttggtgtataactntgtctctggtacaacagcacccaggcaaacgccccaaatccatgatttatgatgtcactaatcgccctgagggtttctaatcgcttctctaggctacagtcncgtcaacnccggcctcctgacctatctctcgggctccgagtcctggaaggacgaggctaggtacttaagtttactcgacncgtcttacgacttaataacgacggtccaccgagcctacttctacttacgtgttaccgttcggaacgttcggggaacctacgggtaaccacccggttcgttaacgggtcccaacgggtacccccaacgggaccccctaacccctacgg

SEQ ID NO: 199120 - DNA, 679 bp, Homo sapiens
  misc_feature: GYAE6OF02HW92Y.18.59.F04.1.454.CMB.1.raw
  modified_base (198)..(198): a, c, t, g, unknown or other
  misc_feature (198)..(198): n is a, c, g, or t
  modified_base (208)..(208): a, c, t, g, unknown or other
  misc_feature (208)..(208): n is a, c, g, or t
  modified_base (213)..(213): a, c, t, g, unknown or other
  misc_feature (213)..(213): n is a, c, g, or t
  modified_base (223)..(223): a, c, t, g, unknown or other
  misc_feature (223)..(223): n is a, c, g, or t
  modified_base (245)..(245): a, c, t, g, unknown or other
  misc_feature (245)..(245): n is a, c, g, or t
  modified_base (264)..(264): a, c, t, g, unknown or other
  misc_feature (264)..(264): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacngtcgatcacntctcngcacgtgacngcagtgacgttggtgtatactntcgtctcgtagtaccaacncgccaccgagactaaaccgcccctaaagtcagtcgtactttagcgtattcgtacacgttaacgtccggtacctacggttacgggttactagtccgtacttctcgtcggtctacgtattcgtacgactacgacgtcctcgtacgactcgttcgtcgtcggcctacgacggtcgttaggaccggtaacgtcggtacgttacgtaacgtttaaccgttaccggacgtccgttacggtacctaaccgttaggttaaccttaaccggaaacgtcccgtaaacggtacgttaccgttaacccttgttaacccggttagtttaccgttaccgttacgggttaaccgggtaccgtaaccggtaacgtccgtaaccggttccttaggaccttaccggacccgttacggacccctacgttaccgg

SEQ ID NO: 199121 - DNA, 590 bp, Homo sapiens
  misc_feature: GYAE6OF02I4UUL.18.59.F04.1.454.CMB.1.raw
  modified_base (251)..(251): a, c, t, g, unknown or other
  misc_feature (251)..(251): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcaacctgcctcgtgtctgggtctctggacagtcgatcaccatctcctgcactggaaccagcagtgacgttggtgttataactntgtctcctgtaccaacagcaccaggacaacaccccaaactcatgtatttatgatgtacactaactccggcccttcgtacgggtttactacgtcgtcttctcgtgctacagtctcgacacgacgtcctccctgacctactctcgtcggcctccacggtctgggacggtacggaggtctagtatttacttacgtgcgtacgtcttcaatactacgaacgaccaccgacgactaccttctaccttacgtcgttcgttacggtacgtacgggaaccgttaaggtccctacccgttccgtacggtaccgaccgtaccgaacccgacccgtaccctacgttaccg

SEQ ID NO: 199122 - DNA, 710 bp, Homo sapiens
  misc_feature: GYAE6OF02I1AN5.18.59.F04.1.454.CMB.1.raw
  modified_base (310)..(310): a, c, t, g, unknown or other
  misc_feature (310)..(310): n is a, c, g, or t
tcagtacgagtatgcacgaccggtgctcgatttagtacacacacttagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtcgacgttggtggttaataactatgtctcctggtaccaacagccaccaggcaaacgcccccaaactcatgatttacngatgtacaactaactcggccctcgtaggggtttacctaagtcgtactttcctcgtcggtacctaccgtaagttcgttcggacctaaaccgacccggtccccgttaccctacggtaacccaacgttccttccggtacggggtccttaccgacgggtctagggaacgggtaccggaacgggtcttacgtaatttacgtttaacgtgacgtacgcttaccgaaagttactaaaccgaacgtccaaccgacgtaccctaccttaccgtatttacgttacggttacccgtttacgggaaacccggttcgggtaaacccctaaggggtaccccttaaccccggttaaccgttacggttacccgaaccgacccccggaaacgggtacccccctaacccccgttacgg

SEQ ID NO: 199123 - DNA, 539 bp, Homo sapiens
  misc_feature: GYAE6OF02GHXLY.18.59.F04.1.454.CMB.1.raw
  modified_base (377)..(377): a, c, t, g, unknown or other
  misc_feature (377)..(377): n is a, c, g, or t
  modified_base (532)..(532): a, c, t, g, unknown or other
  misc_feature (532)..(532): n is a, c, g, or t
  modified_base (534)..(534): a, c, t, g, unknown or other
  misc_feature (534)..(534): n is a, c, g, or t
  modified_base (536)..(537): a, c, t, g, unknown or other
  misc_feature (536)..(537): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctcgtgggcctccaggctggacggacgaggctgatttattactgcacgctacatactacaagccaaccngacactctctatgtcttacggactcggaccaacggtcaccgtacctaagtcacgccgaacgcccaccctcgtcgtcacgtcctcgttcccgcccttccctcctactacgtcctacgtgacggtccggcgtacggcgaacggtcgaccgaagtcgntncnngc

SEQ ID NO: 199124 - DNA, 542 bp, Homo sapiens
  misc_feature: GYAE6OF02IY5FA.18.59.F04.1.454.CMB.1.raw
  modified_base (308)..(308): a, c, t, g, unknown or other
  misc_feature (308)..(308): n is a, c, g, or t
  modified_base (432)..(432): a, c, t, g, unknown or other
  misc_feature (432)..(432): n is a, c, g, or t
  modified_base (467)..(467): a, c, t, g, unknown or other
  misc_feature (467)..(467): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggacaaacgcccccaaactcatgatttangatgtcagtaactcggccctgtaggggtttctaatcgcttctctgctccagtctggcaacgacgcctcccgtgacctatctcgtgggcctcaggctggagacgagctagtattattacgtgcgngtctacgatactaacagccacgagcaactctactntcgtcttaaccggacgtcggaaccaggtacctaccgtacgtacggtacaccgacccgaacggaccaacccctacg

SEQ ID NO: 199125 - DNA, 507 bp, Homo sapiens
  misc_feature: GYAE6OF02FYOY8.18.59.F04.1.454.CMB.1.raw
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggcctcgagggtttctaatcgcttctctgctccaagtctggcaacacggcctccctgaccatctctcggctccaggctgaggacgaggctgattatctgcagctcatatacagcaccagcactctctatgtctcggactgggacctaaggtcaccgttcgtacgtcacgcccaacggcccaaccctacg

SEQ ID NO: 199126 - DNA, 615 bp, Homo sapiens
  misc_feature: GYAE6OF02GKFZ0.18.59.F04.1.454.CMB.1.raw
  modified_base (229)..(229): a, c, t, g, unknown or other
  misc_feature (229)..(229): n is a, c, g, or t
  modified_base (385)..(385): a, c, t, g, unknown or other
  misc_feature (385)..(385): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataactatgtctcctggtaccaacagccacccaggcaaacgcccccaaaactcatgtatttatcgatgtcaactactccggccctagtacgggtttctaagtcgtccttctcgtaggtcctacaagtcgtggacaactntacggccctccctgaccattcctcgtcggcctccgaggctaggacggacgaggtctgtaactttattacgtgctagtctacgtaatacttaaccgaacgacctaaccgacgtacctacttccttacgtacttcggttaccgttacggtaaccggtcggaaacccgtaacggtaccctaccggtacccgtacggtacccaacggaccccgtaaccggaccctaaacccccg

SEQ ID NO: 199127 - DNA, 921 bp, Homo sapiens
  misc_feature: GYAE6OF02GAZV3.18.59.F04.1.454.CMB.1.raw
  modified_base (273)..(273): a, c, t, g, unknown or other
  misc_feature (273)..(273): n is a, c, g, or t
tcagtacgagtatgcacgaccggtgctcgatttagtacacacactttagggtaggttgggggacgaggagacccctccctagggatccgtgggcccagtcctgcccgtcgacgtcacgcctcgtcccttcccgtcgtcctcgggttctcctggaccagtcgatcggaccgactcctcctgacactaggaaccagcacgtgacgttgtggttataactatgtctcgtaggtaccaagagcacccaggcaaacgccccgaaatcatgtatttacncgaatcgtactaagttaagttccggtcccgttacgtacggggttttactaaagtccggtacctttacgtccgtacgggtccccttaccgtaaggttcgtacgggacctaaacgaacccggggtaccccttacccgtacggaacccgtacgttcccgttaccgtcgggggtacccttcccggaacgggtcgttacgggaacgggtaccggacggtcgttacggtaactttacgttaccgtacggaccgtaacgttaccgtaactaacgtttaactaaccgaaacgtccgtaaggtaccgaacggtacccaaacgttaccgtaaacggtttacccgggttaaaccgggtaaccggttaacggggtaaacccctaaaaccgggttaccccgtaaacccggtttaaccgttaaccgggtaaccgtaaccggtaaacccgtaaaccgggaacccccgtaaaccccgtaccgttaccggtttaccgttaacccgtttacgtttaccccggtttacccccttaaccccgtacccgttaacccgtaaccgttaaccccgttaccggttaccgtaccggtaccgggtaccggttacccggtaacggacccggtaaacgggtcccaaaccggtaccgttaacgccgtacgtccgtccg

SEQ ID NO: 199128 - DNA, 609 bp, Homo sapiens
  misc_feature: GYAE6OF02HAZSK.18.59.F04.1.454.CMB.1.raw
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggacaaacgaccccccaaatcatgtatttatgatgtcactaagtccggcctgtacgggtttctaactcgtcttctcgtcgctccagtctgcaacgacgtccctcctcacctactctcgtcgggccttccgacggtctacggacgggacgtagggactgtaactttacgttacgtcgacgtacgtcttacaattaacgtaaccaacgaccgaaccaagtcctactccttactacgttcgttaccgttacggaacgttcggggaaaccctagggttacccaccgttaccgttacggtaccaccggaccccgaacgtaccccaacccgttaccg

SEQ ID NO: 199129 - DNA, 728 bp, Homo sapiens
  misc_feature: GYAE6OF02H8E3J.18.59.F04.1.454.CMB.1.raw
  modified_base (230)..(230): a, c, t, g, unknown or other
  misc_feature (230)..(230): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcactggaaccngcagtgtacgtttgggtgttataactagtgtcctcctggtaccaacagccaccaggacaaacgacccccaaactcatgatttatgatgtacactaacgtccgcctcgtacgggtttactaacgtcgtacttcgtcgtcgtcctacctaagttcgtcggaccgaccgtaccgtcccttacccgtcgaaccctacgttcccgtcggttcggggtcccttcccgacgggtcgtacgggtaacgggaaccgggtagggttccgtaggttaacgttttaacgttaccgttacggtaccgtacggtccttaaccgtaacgtttaactaaaccgacctacccgaaacccgtacgtaccgtacccctttacttaccttaacgtttccgttacccggttaccgggtaaccggtccgggtaacccttaaacggtccccgtaacccgttacccggtacggtacccgaaccggacccccgtaaccggtacccccgaaccccttaacccgg

SEQ ID NO: 199130 - DNA, 563 bp, Homo sapiens
  misc_feature: GYAE6OF02FK9WO.18.59.F04.1.454.CMB.1.raw
  modified_base (456)..(456): a, c, t, g, unknown or other
  misc_feature (456)..(456): n is a, c, g, or t
  modified_base (468)..(468): a, c, t, g, unknown or other
  misc_feature (468)..(468): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgcccccaaactcatgatttatgatgtcactaatccggcctcgtaggggtttctaagtcgcttctctcggctccaagtcgtggccaacgaccggccctcccgtcgacccattcctctcgggcctccgaggctggaggacggaggtctagatttattactgcagtctcaatanacaacgcaccancactctactatcgtcttacggaacgtgggaacctaacggtccctaccggtccgttaagggccaccgtaccccgaacggaccccaaccccgtaccg

SEQ ID NO: 199131 - DNA, 644 bp, Homo sapiens
  misc_feature: GYAE6OF02F37TZ.18.59.F04.1.454.CMB.1.raw
  modified_base (282)..(282): a, c, t, g, unknown or other
  misc_feature (282)..(282): n is a, c, g, or t
tcagtacgagtatgcacgaccggtgctcgatttagtacacacacttagggattggggtctgggagaggagccccagccttgggattcccaagtgttttcattcagttatcaggactgaacacagaggacgtcaccactggagttgggtcgtgaggctggagttttcctttgtctgtctattttaaaaggttagtccagtagtgaggtgcagctggtgggagtcgttgggggaggcgttggtaaaggaccgggggggtcccgttacgtactcccctgtacacncctctggattctactttctagtaaggcctggtatgaactagggtccgccaggctcccgagggaaggggctggagtgggttggccggtaattaaaaccgaaaactgatggtgggacgaacagactacgctgacacccgtgaaacggcagaactcaacccagtcttacaagagataagtatttacgaaaaacgacaccgacttgtaattcgtgacaaaatagaacgacgacctgaacggaacccgaggaacacagtcccgtgttacttaacgtgtaaccacacttccctaggaaacgtctaccgtaacttaccttaactaccgtacgttagtaccggaacccgtcttaccggggactaaccggg

SEQ ID NO: 199132 - DNA, 779 bp, Homo sapiens
  misc_feature: GYAE6OF02G182K.18.59.F04.1.454.CMB.1.raw
  modified_base (232)..(232): a, c, t, g, unknown or other
  misc_feature (232)..(232): n is a, c, g, or t
  modified_base (256)..(256): a, c, t, g, unknown or other
  misc_feature (256)..(256): n is a, c, g, or t
  modified_base (312)..(312): a, c, t, g, unknown or other
  misc_feature (312)..(312): n is a, c, g, or t
tcagtacgagtatgcacgaccggtgctcgatttagtacacacacttagggattggggggggtcgtcaggaggcagcgctctcgggacgtctccaccatggcctgggctctgctattcctcaccctcctcactcgaggcacgagggtcctgggcccagtctgccctgacctcagcctgcctccgtgtctgggtctcctggacagtcgatcaccatctcctgctactggaaccngcagtgacgttggtgttataactntgtctcctaggtaaccaacagccacccaggcaaacgccccctaaactcatgattangtactgtcactaacgtccggccctcgtagggttctaagtcgtcctttctcgtgtcctaccgtagttccgtaggtaccaaccgaccggtcccttccccgtacggacccctacgttcccgtacggtccggggacccttacccggtaacgggtaccgtacgggtaacggggaaccggttaacggggttacctttacggttaacttttaacgtttaccgtgggtaacccttacggtacccttttaccgtaaatttaaaccgtaaacccgtaaacggacccttaacccggtacgtaaccccgttaaaccttccgttacgttacgtttaccgttacccggttaaccggtaaacccggttacggggtaacccggtaaaccgggttcccctaaccccgggttacccgttaaccggttacccggtaaccgtaaccccccggtaacccggtaaccccccgtaaaccccgtaccccgg

SEQ ID NO: 199133 - DNA, 580 bp, Homo sapiens
  misc_feature: GYAE6OF02FWLCX.18.59.F04.1.454.CMB.1.raw
tcagtacgagtatgcacgaccggtgctcgatttagtacacacacttagggattgggggctttgtctgggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctctggtaccaacagcaccaggcaaacgcccccaaatcatgatttatgatgtacactaatcggccctgtaggggtttctaatcgtcttctcgtggctaccaagtctggaccaacaccggcctccctgaccatctcgtcgggcctccgaggtcctaggacggacggagctagtattatactgctagtctacatactacaacgccacgtagcctattcctactacgttcgttacccggttacggtaacgttacgggtaacccgtaacgggtttacccgtaccgttaacgggtccgtaaccggtaccccgtaaacccgg

SEQ ID NO: 199134 - DNA, 530 bp, Homo sapiens
  misc_feature: GYAE6OF02HTZQE.18.59.F04.1.454.CMB.1.raw
  modified_base (521)..(521): a, c, t, g, unknown or other
  misc_feature (521)..(521): n is a, c, g, or t
  modified_base (525)..(525): a, c, t, g, unknown or other
  misc_feature (525)..(525): n is a, c, g, or t
  modified_base (528)..(530): a, c, t, g, unknown or other
  misc_feature (528)..(530): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagccccaaactcatgatttatgatgtcactaatcggcctctaggggtttctaatcgcttctctggctccaagtctggcaacacggcctcctgaccatctctggctccaggctgaggacgaggctagatttatactgcagctacatatacaagcacagcactctctatcgttacttcggaactgggaaccaaggtcaccgtctaggtcacgcccaacgcccaacccactgtaccactccgtccgttcccgcccttcctccaactccttagtactagacgcgggctacgggacctaagggccgactaagtacgngtanacnnn

SEQ ID NO: 199135 - DNA, 623 bp, Homo sapiens
  misc_feature: GYAE6OF02IPSI2.18.59.F04.1.454.CMB.1.raw
  modified_base (487)..(487): a, c, t, g, unknown or other
  misc_feature (487)..(487): n is a, c, g, or t
  modified_base (493)..(493): a, c, t, g, unknown or other
  misc_feature (493)..(493): n is a, c, g, or t
tcagtacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggattttccttgctgctatttaaaggtgtccagtgtgaggtgcagctggtggagtcgtgggggaggcgttgggtaaaggccgggggggtccttaggacctccccgtgtacagcctctggattcactttcagtaaggcctggatgaacgtgggtccgcaggcctccgaggaagggctggaggtggtggccgtaataaaaccgaaacgtgagtggtagggacaacgagaaccgtacgcgtcgaccgaccggtagaaaggcaacggtactccaacacgtctacgaagagatagattacgaaaacgtcaccgtactagtacttctagactaaacngaaacncgaccgagaacggaaccgaagaaccgacgaccgacgtataacgtacgtacgtacccactaccgtacccgtagaacggtacctaccgtaaacaccgttaacaaccgtaacggttactacggaccctacggg

SEQ ID NO: 199136 - DNA, 691 bp, Homo sapiens
  misc_feature: GYAE6OF02FNGTV.18.59.F04.1.454.CMB.1.raw
  modified_base (353)..(353): a, c, t, g, unknown or other
  misc_feature (353)..(353): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaactcggccctgtaggggtttctaatcgcttctctggctccaagtctggcaacacggccctccctgaccatctcgtgggctccaggctggaggacgaggtctgtattattacngcagctacaatactacaagccaaccgagtaccactctacgttatcgtaccgttacggaacgtcgggaaccgtaacggtacctacccgttccgtaacggtaccaccggtaccccgaaacgggccccctaaaccccgtacgttaccgttaccctaccgttcccgttcccggtttacccccgtccccgtttaccctacccgttaaaccttacccgttacccggttaacccgttacgggtacccgggtacccgggggttacccggttaccggggaaacccgtaaaccggggttacccggtaaccgttaaccgggttaacgccggtacaccggttcgacgtcg

SEQ ID NO: 199137 - DNA, 636 bp, Homo sapiens
  misc_feature: GYAE6OF02GW9Z0.18.59.F04.1.454.CMB.1.raw
  modified_base (301)..(301): a, c, t, g, unknown or other
  misc_feature (301)..(301): n is a, c, g, or t
  modified_base (382)..(382): a, c, t, g, unknown or other
  misc_feature (382)..(382): n is a, c, g, or t
  modified_base (402)..(402): a, c, t, g, unknown or other
  misc_feature (402)..(402): n is a, c, g, or t
  modified_base (433)..(433): a, c, t, g, unknown or other
  misc_feature (433)..(433): n is a, c, g, or t
tcagtacgagtatgcacgaccggtgctcgatttagtacacacacttagggattggggagagagacccctcccctgggatcctgggcccagtctgccctgactcagcctgcctccgtgtctgggtctcctggacagtcgatcaccatctcctgcactggaaccagcagtgacgttggtggttataactatgtctcctggtaccaacagccacccaggcaaacgcccccaaatcatgtatttatgatgtcactaagtccgcctgtagggtttctaatccgtcttctcgtggcctaccagtcgnggaccaacgccggccctacccgtcgacctatcgtcgtggcctccgaggctaggaggacgtaggtctaggtattacttacgngtacacgtctacaacttaanaacacgcctaaccacgtcctaactctacttntacgttccgtacggtaacgtagggaacccgtacggtacccgtaccgtaccgtacggtaccacgacccgaaccggaccccaacccgtacgtctaccaccttccttcccgtaccccgtccctaccgtaccacttaccgttccgtacgtcggtacggaccgggtaccgtcggaccggtaacggcctacgtaacgtacggtctcgag

SEQ ID NO: 199138 - DNA, 468 bp, Homo sapiens
  misc_feature: GYAE6OF02HVPO3.18.59.F04.1.454.CMB.1.raw
  modified_base (320)..(320): a, c, t, g, unknown or other
  misc_feature (320)..(320): n is a, c, g, or t
  modified_base (389)..(389): a, c, t, g, unknown or other
  misc_feature (389)..(389): n is a, c, g, or t
  modified_base (408)..(408): a, c, t, g, unknown or other
  misc_feature (408)..(408): n is a, c, g, or t
  modified_base (449)..(449): a, c, t, g, unknown or other
  misc_feature (449)..(449): n is a, c, g, or t
  modified_base (455)..(468): a, c, t, g, unknown or other
  misc_feature (455)..(468): n is a, c, g, or t
tcagtacgagtatgcacgaccggtgctcgatttagtacacacacttagggattgggggctttgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacagcacngcactctctatcgtcttcggaactgggaccaggtccaccgtcctaggtccacgcccaaggcccaacccnctgtccactctcgttcccnccctcctccactacctcgtactgacgcgggctcggcaggcncatagnnnnnnnnnnnnnn

SEQ ID NO: 199139 - DNA, 641 bp, Homo sapiens
  misc_feature: GYAE6OF02FQSWW.18.59.F04.1.454.CMB.1.raw
  modified_base (228)..(228): a, c, t, g, unknown or other
  misc_feature (228)..(228): n is a, c, g, or t
  modified_base (253)..(253): a, c, t, g, unknown or other
  misc_feature (253)..(253): n is a, c, g, or t
  modified_base (271)..(271): a, c, t, g, unknown or other
  misc_feature (271)..(271): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtggttataactntgtctcctggtaccaacngcaccaggacaaacgcccccaaactcatagtatttatgatcgtcactaacgtccggcctcgaggggttttactaatcgtcttctctcggtctaccgtaagtcttgggacaaccgtaccgggtcccttcccgtacgaccactccgtcgtcgggcctcccgacggtctaggacgggaacgacgggtctagtaatttacgttactcgactagtcctacgaattaactaaccaagtccaaccgcgacctaccttccttcttagttcgttccgttaccggaacgttacgggaacccgtaacggttacccgtaacccggtttaccgtaacggttacccgaccggtaaccccgaacgggaccccctaacccgtaccg

SEQ ID NO: 199140 - DNA, 782 bp, Homo sapiens
  misc_feature: GYAE6OF02HWRXN.18.59.F04.1.454.CMB.1.raw
  modified_base (231)..(231): a, c, t, g, unknown or other
  misc_feature (231)..(231): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtacggaaccngcaggtggtacggttgggttagttaataacttattgttccttccgtacggtaaccaacacgaccacccgaggaccaaaccgaccccctaaactctatagtaactttatgtattcgtacaaccttaacgtcccggacccgttacggttacggggttttactaacgttccgtcctttccgttcgttcgggtaccttaccgtaacgtttcgtacgggaaccaaccggtacccgtcccttacccgtacgtaaccctacgttccgttccggtcgggtccttacccggagggtccgtagggaacgggtacggacgggtacgttagttaacttttaacttaccgtcggaccgtacgtcccttaacgtaacttaacgtaaccgtaaaccgaccctaaccgacgtacccttaccgttacttaccttacgtttcggttacccgttaacgggtaacccggttacggggtaaacccgttaaacgggtcccgttaaccccggtaccgttacgggtacccgaaccggtaaccccgaaaccggtacccccctaaccccgtacccgg

SEQ ID NO: 199141 - DNA, 558 bp, Homo sapiens
  misc_feature: GYAE6OF02FLTNI.18.59.F04.1.454.CMB.1.raw
tcagtacgagtatgcacgaccggtgctcgatttagtacacacacttagggattggggggggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttgggtaaagccgggggggtccttagactcccctgtacagcctctggattcactttcagtaaggcctggatgaactgggtccgcaggctccgagggaggggctggagtgggttggccgtataaaccaaactgatggtgggacaacgagactacgctgcaccgtgaaaggcagatcacatctacaagagatgatacaaaagcacgctgtatctgacaaatagaacacgcctagacgaaccggaggaaccacgagccgtagtacttactacgtaccacactccctagaacgcgtacaactactactacgtacgtatacggacctcgcgggaccaggacccg

SEQ ID NO: 199142 - DNA, 736 bp, Homo sapiens
  misc_feature: GYAE6OF02JWXMF.18.59.F04.1.454.CMB.1.raw
  modified_base (211)..(211): a, c, t, g, unknown or other
  misc_feature (211)..(211): n is a, c, g, or t
  modified_base (218)..(218): a, c, t, g, unknown or other
  misc_feature (218)..(218): n is a, c, g, or t
  modified_base (260)..(260): a, c, t, g, unknown or other
  misc_feature (260)..(260): n is a, c, g, or t
  modified_base (266)..(266): a, c, t, g, unknown or other
  misc_feature (266)..(266): n is a, c, g, or t
  modified_base (274)..(274): a, c, t, g, unknown or other
  misc_feature (274)..(274): n is a, c, g, or t
tcagtacgagtatgcacgaccggtgctcgatttagtacacacacttagggattggggggggtcgtcaggaggcagcgctctcgggacgtctccaccatggcctgggctctgctattcctcaccctcctcactcaggcacagggtcctgggcccagtctgccctgactcagcctgcctccgtgtctgggtctcctaggacagtcgatcaccnttctccngccacgtcggaaaccagccagtcggacgtttgggtagttaanaacttntgtctacngtacacagccaccaggcaacgtaccccaatcatcgtattactgatgtactacactcgcctacgtacgggttactacgttcggtccttcgtactggtacctactacgtcgtacggacaacgtccggtccctcccgtacaccgtcctcgtcgttcgggtcccttaccgacgggttaccgtaggaacgggtccgtaaacgggttcgtagttaacgggtttttacctacggtacgtaccgtaacggtccttaaccggtaattaacgttaaccgaacggttcccaacggtaacccgacttacccctttacttaacccgttttaacgttccgggttaccgtttccggggttaaaccgtcggggtaaaacccggtacgggttaaccccgttaccggtaacccggtttaacggtacccggttacccgtaacccgggaaaccccttacccccgggaacccctttaacccgg

SEQ ID NO: 199143 - DNA, 667 bp, Homo sapiens
  misc_feature: GYAE6OF02IGR2B.18.59.F04.1.454.CMB.1.raw
  modified_base (352)..(352): a, c, t, g, unknown or other
  misc_feature (352)..(352): n is a, c, g, or t
tcagtacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcgttgggtaaacgggccgggggggttcccttaggacctcccccgtgtaccagcctctggattccactttcagtaacggcctggatgaacgtgggtccgccaggcctaccgaggggaaggggctagggngtggggttggaccgttaaattaaaaaacccgaaatcgaagtgggtacggaacaacgagacctacgctgaccaccgtagaaacggcagtactccactactctacaagagatagaacttaacgaaaaacgcaacgtactagtaacttctagactaaatacgaaactagaccctaaggaaacgaacccggaaggaaccaacgacggtccgtagtacttacgactaacccaccgtacctaaccccgtagtaaaccgtaccgtaactaaaccgttacctaacgttaaccgtacgggtaacgtaccggtaccctaccgggg

SEQ ID NO: 199144 - DNA, 675 bp, Homo sapiens
  misc_feature: GYAE6OF02FPR2J.18.59.F04.1.454.CMB.1.raw
  modified_base (242)..(242): a, c, t, g, unknown or other
  misc_feature (242)..(242): n is a, c, g, or t
  modified_base (253)..(253): a, c, t, g, unknown or other
  misc_feature (253)..(253): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggnggttataactntgtctctggtaccacagcaccaggcaaacgcccccaaactcatcgtaattatgatgtcacgtaactccggccctgtaggggttttacctaagtcgtacctttctcgtcggtctccaagtctcggcaaacgaccggccctcccgtgacccatcgtcgtagggcctccgaggtctggacggacgacggtcctaggtatttacttacgtgactagtcctacgaattaactaaccaagtaccaaccgacgtacctaaaccgtttccttaccgttaacgtttcggtttaaccgttccggggtaaaccggttacgggggtaaaccccttaaacgggggttaaccctaaccccgggtttaccgtttaccggggtaacccgtaacggttaccccccggaaaagggtacccccctaacccccgtaacccgg

SEQ ID NO: 199145 - DNA, 622 bp, Homo sapiens
  misc_feature: GYAE6OF02F8KB2.18.59.F04.1.454.CMB.1.raw
  modified_base (241)..(241): a, c, t, g, unknown or other
  misc_feature (241)..(241): n is a, c, g, or t
tcagtacgagtatgcacgaccggtgctcgatttagtacacacactttaggggtagttgggggctggggtcctcaggaggcagcgctctcgggacgtctccaccgactggcctgggctctggctattcctcaccctcctcactcacgggcacagggtcctgggcccagtctgccctgactcagcctgcctccgtgtcctgggtctcctggacagtcgatcaccatctcctgcactggaaccnggcagtgacggttggtggttataactatgtctcctggtaccaacagcaccaggcaaagcccccaaatcatgatttatgatgtcactaactcggtacctgtacgggtttctaatcgtcttctcgtggctcgaagtctggcaacgacggtcctccctagaccatcctcgtcgggctccgaggcctggacggacgacggtctagtatttagttactgtacacgtcttacattactaacaacgccaaccgtacgtcctaacgttccttacgttacttacggttaccgttaaccgggtaacgttacggggaaccctaaacgggttaccctacccggttaccggttaacgggttaccgaaccggtaccccgtaaacggtaccccccg

SEQ ID NO: 199146 - DNA, 587 bp, Homo sapiens
  misc_feature: GYAE6OF02IJ1JZ.18.59.F04.1.454.CMB.1.raw
  modified_base (313)..(313): a, c, t, g, unknown or other
  misc_feature (313)..(313): n is a, c, g, or t
  modified_base (351)..(351): a, c, t, g, unknown or other
  misc_feature (351)..(351): n is a, c, g, or t
  modified_base (582)..(582): a, c, t, g, unknown or other
  misc_feature (582)..(582): n is a, c, g, or t
tcagtacgagtatgcacgaccggtgctcgatttagtacacacacttagggattgggggctttgcctgggtcctgggcccagtctgccctgactcagcctgcctccatgtctgggtctcctggacagtcgatcaccatctcctgcactggaaccagcagtgacgttggtggttataactatgtctcctggtaccaacagcacccaggcaaaagcccccaaaatcatgatttatgatgtcactaatcggccctgtaggggtttctaatcgcttctctggctccaagtctggcaacacggcctccctgaccactcnctggctcgaggctgaggacgagctgtattatactgacngctacattataacaagccaacgacgcaccttctactatcgttctacggaactagggacctaacggtcctaccgttacctagggtaccacggaccctaaacggcccaaaccccgtactcgtaccgtaccttccttaccgttccccaacccttaccctaccgtaacctaaccgttacgttaccgacggtacggccgggtacctagggaccgaacgggcgacgaacgttagcanctagc

SEQ ID NO: 199147 - DNA, 648 bp, Homo sapiens
  misc_feature: GYAE6OF02I6CQY.18.59.F04.1.454.CMB.1.raw
  modified_base (317)..(317): a, c, t, g, unknown or other
  misc_feature (317)..(317): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatccaccatctcctgccacgtggaaccagcagtcgacgttggtagttaataactatgtctccgtggtaccaacacgcacccaggccaaacgcccccaaactcatcgtatttagngtatcgtacaacgtaagtccggcccttcggtacggggtttactaagttccgtctttcctcgtcggtcctaccgtaagtcgtacggaccaaccgaccggtcccttcccgtacgaccctctaccgtcgtcgggtcctaccgagggtctacgggacggtacggaggtctagtaactttagttctagcgtacgtacctactaataacgtaaccaacgaccaccgacgacctactaccttactagtccgttacgtacggtacggtaccgggtaaccaggtacccgtaccgttccgtagcccgtaaccgacccgtaaccggaccccgtacccgtacg

SEQ ID NO: 199148 - DNA, 573 bp, Homo sapiens
  misc_feature: GYAE6OF02H1FNZ.18.59.F04.1.454.CMB.1.raw
  modified_base (568)..(568): a, c, t, g, unknown or other
  misc_feature (568)..(568): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcacttagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggaccaaacgcccccaaatcatgtatttatgatgtcactaactcggcctcgtagggtttctaatcgtcttctctcggctacaagtctgacaacgccgcctccctacgaccatcgtcgtcgggcctcgaggtctaggacggacgacggctagtaactttatacgtgacgacgtctactatactaacgagccaacgacgtcctacttctactattcgttacgtacggacgtcggaacctacggtactaccgtaccgtaggtaccacggaccccgaacggccccaacccgtntaccg

SEQ ID NO: 199149 - DNA, 641 bp, Homo sapiens
  misc_feature: GYAE6OF02I0CX7.18.59.F04.1.454.CMB.1.raw
tcagtacgagtatgcacgaccggtgctcgatttagtacacacacttagggattgggggggagaggagccccagccttgggattcccaagtgttttcattcagtgatcaggactgaacacagaggactcaccatggagtttgggctgagctggattttccttgctgctattttaaaaggtgtccagtgtgaggtgcagctgggtggagtcgtgggggaggcttggtaaaggccgggggggtcccttagactccccctgtaccagcctctggattcactttcagtagcctggatgaactgggtccgcaggctccgagggacggggctgggaggtggggttggaccgtaattaaaaccgaaaactgaagtggtagggacaacgagactacgctgcacccgtgaacggcagacttacacatctacaagagatgaattacaaaaagcaacgattagtatctagacaaatgtaacacgccagaacgaaccgaggaacacgacgaccgtagttacttacgtacgtaacccactacttacccgacgtaacgaccgtaacctaaccttaaccttaaccgttaaccgttaaccggttaacgtaccggtaacccttacgggtacccgggtaccggaacccgggtaaccccgg

SEQ ID NO: 199150 - DNA, 552 bp, Homo sapiens
  misc_feature: GYAE6OF02GPT34.18.59.F04.1.454.CMB.1.raw
  modified_base (439)..(439): a, c, t, g, unknown or other
  misc_feature (439)..(439): n is a, c, g, or t
tcagtacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtctgggggaggcttgggtaaagccgggggggtcccttagactcccctgtacagcctctggattcactttcagtaaggcctggatgaactgggtccgcaggctccgagggagggctggagtgggttggcgtataaaaccaaactgagtggtgggacaacgagactacgctgcacccgtgaaagcagatcaccatctcaagagatgattacaaaagcaacgctgtactntgacaaatcaacagaccgtagaacgaccgaggaccacagccgtagtatactgtaccactactcccctagaacgcgtaccaacttactactactacggtatacggtactaccgg

SEQ ID NO: 199151 - DNA, 668 bp, Homo sapiens
  misc_feature: GYAE6OF02IECSL.18.59.F04.1.454.CMB.1.raw
  modified_base (394)..(394): a, c, t, g, unknown or other
  misc_feature (394)..(394): n is a, c, g, or t
  modified_base (448)..(448): a, c, t, g, unknown or other
  misc_feature (448)..(448): n is a, c, g, or t
tcagtacgagtatgcacgaccggtgctcgatttagtacacacacttagggattggggggggtctcaggaggcagcgctctcgggacgtctccaccatggcctgggctctgctattcctcacccctcctcactcagggcacagggtcctgggcccagtctgccctgactcagcctgcctccgtgtctgggtctcctggacagtcgatcaccatctcctgccactggaaccagcagtgacgttggtggtataactatgtctcctggtacaacagccacccaggacaaacgcccccaaactcatacgtatttatagatgtcaactaatccggcctcgtagggtttcaacgtcgtcttctcgtgtctacctagtctggacctaacaccggtcctcccngaccacttcacgtggctccgagctagacggacgaggctagtaattactttaacncgacacgtctactaacgttaataacctaacgaccaaccgtaacgcctaaaccttccgttaactacgtttaggttaccgttttaacccgggaaaccgttcccgggggtaaacctaaacccggggttacccgtaacccccggtttaacccttaaccgggggttcccaaacccgggaacccccgtaaaaccgggtacccccccgtaaaaccccccttaaccgg

SEQ ID NO: 199152 - DNA, 344 bp, Homo sapiens
  misc_feature: GYAE6OF02GH9JJ.18.59.F04.1.454.CMB.1.raw
  modified_base (285)..(285): a, c, t, g, unknown or other
  misc_feature (285)..(285): n is a, c, g, or t
  modified_base (329)..(344): a, c, t, g, unknown or other
  misc_feature (329)..(344): n is a, c, g, or t
tcagtacgagtatgcacgaccggtgctcgatttagtacacacacttagggattggggagagaagacaggattcaggacaatctccagcatggccggcttccctctcctcctcaccctcctcactcactgtgcagggtcctgggcccagtctgtgctgactcagccaccctcagcgtctcgggacccccggcagagggtcaccatctcttgttctggaagcagctccaacatcggaatcagcccaaggctcgcccccctggtccactctgttccccaccccctccnccactccgtctctagcgggcgtggtcgaacgacggcactagtgnnnnnnnnnnnnnnnn

SEQ ID NO: 199153 - DNA, 527 bp, Homo sapiens
  misc_feature: GYAE6OF02GBGM2.18.59.F04.1.454.CMB.1.raw
  modified_base (228)..(228): a, c, t, g, unknown or other
  misc_feature (228)..(228): n is a, c, g, or t
  modified_base (247)..(247): a, c, t, g, unknown or other
  misc_feature (247)..(247): n is a, c, g, or t
  modified_base (436)..(436): a, c, t, g, unknown or other
  misc_feature (436)..(436): n is a, c, g, or t
  modified_base (446)..(446): a, c, t, g, unknown or other
  misc_feature (446)..(446): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttanaactatgtctcctggtaccaacagcacccaggcaaagccccccaaactcatgatttatgatgtcactaatcggccctgaggggtttctaatcgctttctctggctcaagtctggcaacaccggcctccctgacccatctcgtcggcctcgaggctggaggacgaggctgtattatactgcagctcatanacagccaacngcatctactatgtcgtacgaacgtcgggacctacggtccaccgttcgtacggtcacggacccaacggtcccaaccctaccg

SEQ ID NO: 199154 - DNA, 615 bp, Homo sapiens
  misc_feature: GYAE6OF02F3OT3.18.59.F04.1.454.CMB.1.raw
  modified_base (228)..(228): a, c, t, g, unknown or other
  misc_feature (228)..(228): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctcgtgtcgtgggtctcctggacagtcgatcacatctcctgcactggaaccngacagtgacgttggtagttaataactatgtctcctgtaaccaacagccaccaggacaaacgacccccaaactcatcgatttatgatgtcaactaagtccgtccgtcgtacgggtttactaactcgtcttctcgtcgctacctaagtcgtacggacaacgccgcccttacccgcgaacccagttcctcgtcgggtctaccgacggtcgtgggaacggacggacggtactagttactttaactacgtacgcgatctatactaactaacacgacacactacactctacgttattcgttacgtacggaacgttcggaacccgtaacggtccctaaccgttaccgtacggtacccgtaacggaccccgtaacggacccctaacccgtacccg

SEQ ID NO: 199155 - DNA, 588 bp, Homo sapiens
  misc_feature: GYAE6OF02IINXG.18.59.F04.1.454.CMB.1.raw
  modified_base (161)..(161): a, c, t, g, unknown or other
  misc_feature (161)..(161): n is a, c, g, or t
  modified_base (234)..(234): a, c, t, g, unknown or other
  misc_feature (234)..(234): n is a, c, g, or t
  modified_base (312)..(312): a, c, t, g, unknown or other
  misc_feature (312)..(312): n is a, c, g, or t
  modified_base (317)..(317): a, c, t, g, unknown or other
  misc_feature (317)..(317): n is a, c, g, or t
  modified_base (376)..(376): a, c, t, g, unknown or other
  misc_feature (376)..(376): n is a, c, g, or t
  modified_base (395)..(395): a, c, t, g, unknown or other
  misc_feature (395)..(395): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtcngccctgactcagcctgcctccgtgtctgggtctccgtggacagtcgatccaccatctcctgcacgtggaaccngcagtgacgttggtggttataactatgtctcctggtaccaacacgcaccgagacaaacgccccaaactcatgatttangtatntacgagtaactccggtcctgtacgggtttacaacgtcgtcttctcgtcgctaccagtcncggcaacgccgcctcccgngacctctcgtctcgggcctcgacgtctaggacggacgagtctgtacgttattactcgacacgtctacctataactacaagtacgacgtcgacgtcaaccgttacacggttcttaacgggaacggtacgggaacccgtaagtcccgtaccggttaccgttaggcctaccgcccggtaaccggacccctaacccg

SEQ ID NO: 199156 - DNA, 1091 bp, Homo sapiens
  misc_feature: GYAE6OF02I17V8.18.59.F04.1.454.CMB.1.raw
  modified_base (134)..(134): a, c, t, g, unknown or other
  misc_feature (134)..(134): n is a, c, g, or t
tcagtacgagtatgcacgaccggtgctcgatttagtacacacacttagggattggggagctctgggagaggagccccagccttgggattcccaagtgttttcattcagtgatcaggactgaacacagaggactnaccatggagtttgggctgagctggattttccttgctgctattttaaaaggtgtccagtgtgaggtgcagctggtggagtcgtgggggaggcttagggtaaacggccgggggggttccccttaggaccttccccgtgtaccacgcctctggtacttcacctttcgaggtaaacggtcctggatggaacgttcggggtccccgccgtaggccgtacccggaagggggaacgggggtcgtacggggtaggttcgggggtttacgggtacccggtttaaaaacgtttaaaaaaccccgtaaaaaacgttggtaaacggttacggggtacggggtaaaccgaaaaccgaagggtaaacccgtttaaccggaccgttacgggaacccctaaccccgggtaaggaaaaacgggtacccgtaagtaacgtttaacccgaaacccgttaacttacccgtaccgaaaaacgggaacgttacgtaagttaaacgtttaaaaccgaaaaaaaaccggccgtaaaccgggtaaccgtttaacgtttaaacgttacccgtttaaggtaaaaccgtaaaaaccgttacgggaaaaacccggttaaaccgtaccccggtttaaaacgggggaaaaccccgtaaaaaccccgggggaaaccggggtaaaaccccgtaaaccgggtaacccgggggtttaaacccggtttaaaccccggtttttaaaaccgtttaaaccccgttttaacccgggttaaaccccccttaaacccggttaaaccccccggttttaacccccccggtttaaaacgggtaaaaaaccccggttaaccccggtttaaaaccccgtaaaaaacccccgtttttttaaaacccgttaaaccccggtttttaaaaacccggttttaacccggggtttaaaacccggggtttacccccggggttaaacccccggttttaaacccccgggggggg

SEQ ID NO: 199157 - DNA, 849 bp, Homo sapiens
  misc_feature: GYAE6OF02IASOM.18.59.F04.1.454.CMB.1.raw
  modified_base (232)..(232): a, c, t, g, unknown or other
  misc_feature (232)..(232): n is a, c, g, or t
  modified_base (256)..(256): a, c, t, g, unknown or other
  misc_feature (256)..(256): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcgagggcacagggtcctgggcccagtctgccctgactcagcctgcctcgtgtctgggtctcctggacaggtcgatcaccatcctcctgcacgtggaaccngtcaagtggacgttggtagttaanaactagttgtaccttctcggtaaccaaactaggccaaccgaggaccaaaacggtcccccaaaactcaaacttgtaacttttaagacggtattacggtacctaaacgttaaaacgttccgggtaccccttacgggttaacgggggtttttacctaaaacgttccggtaaccgtttccctaaccgttttcggggaccccttaaccgtaaagggtttcccgttacggggtaaaccaccgggtaaacccggtcccgttaccccgtttacggaaactttaaccttccgttaccgtaccggggtaccttaccccgtaaaggacccgttagggaaacccgggaacgttaaacggggaccttaagggtttaaactttaaaccgtttttaacgtcggtaaccaacgggtaccttacgttaaaaaccgtttaggaaaaccgttaacgacccgtaaaccggactaaccgttaccttacgttaccttaagttcgggttaaccctacgggggtaaacgtaccgggtaaccgtaacggttaccccgtaaccgttccggtttaaacgggcaaaccgtaccccggtaaacggaccccctaaccgtaacg

SEQ ID NO: 199158 - DNA, 581 bp, Homo sapiens
  misc_feature: GYAE6OF02HNFXM.18.59.F04.1.454.CMB.1.raw
  modified_base (308)..(308): a, c, t, g, unknown or other
  misc_feature (308)..(308): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtcctcctggacagtcgatcaccatctcctgcactcggaaccagcagtgacgttggtgttataactatgtctcctggtaccaacagcacccaggacaaacgcccccaaatcatgatttangatgtcactaatccggcctgtagggtttctaatcgtcttctcgtcggctcctaagtcgtgaccaacgaccgtccctccctacgacctacttctcgtcggcctccgaggtcgtggacggtacggaggctagtatttacgttacgtgacatcctctaatactaacgaacgccaaccgacgaccacttctacgttatccgttacgttacggacgtcgggacctaagggtcctaccgtccgtaggtaccaccgacccgaacgcccctaacccttacc

SEQ ID NO: 199159 - DNA, 603 bp, Homo sapiens
  misc_feature: GYAE6OF02HB1SG.18.59.F04.1.454.CMB.1.raw
  modified_base (205)..(205): a, c, t, g, unknown or other
  misc_feature (205)..(205): n is a, c, g, or t
  modified_base (240)..(240): a, c, t, g, unknown or other
  misc_feature (240)..(240): n is a, c, g, or t
  modified_base (399)..(399): a, c, t, g, unknown or other
  misc_feature (399)..(399): n is a, c, g, or t
  modified_base (403)..(403): a, c, t, g, unknown or other
  misc_feature (403)..(403): n is a, c, g, or t
  modified_base (412)..(412): a, c, t, g, unknown or other
  misc_feature (412)..(412): n is a, c, g, or t
  modified_base (493)..(493): a, c, t, g, unknown or other
  misc_feature (493)..(493): n is a, c, g, or t
  modified_base (598)..(598): a, c, t, g, unknown or other
  misc_feature (598)..(598): n is a, c, g, or t
  modified_base (603)..(603): a, c, t, g, unknown or other
  misc_feature (603)..(603): n is a, c, g, or t
tcagtacgagtatgcacgaccggtgctcgatttagtacacacacttagggattggggagagagacccctcccctgggatcctgggcccagtctgccctgactcagcctgcctccgtgtctgggtctcctggacagtcgatcaccatctcctgcactggaaccagcagtgacgttggtggttataactatgtctcctggtaccaanagcacccaggcaaacgcccccaaatcatgatttangatgtcaactaatccggccctctagggggttttctaatcgtcttctctaggcttccaagtcctggccaacgaccggcccttcccgtgaccctattccgttcgtacggggcctccgagggtcctggacgggacgaggcttagtatttatactgcagtctnatanacagcacancactctctatcgtacgttcgaacgttcgggaacctacggtccacccgttcgtagtccacgcccgtaacggcccaacccgtntaccgtctaccttccgttccgttacccccgtccctaccctaccgtacttaccctacgtaccgtggaccggtaccgggcgtccgacgacggtccgacgtaggtacncgtan

SEQ ID NO: 199160 - DNA, 791 bp, Homo sapiens
  misc_feature: GYAE6OF02I2SDZ.18.59.F04.1.454.CMB.1.raw
tcagtacgagtatgcacgaccggtgctcgatttagtacacacacttaggagtggggggtctcaaggaggcagcgactctcgggacgtctccaccatggcctgggctctgctattcctcaccctcctcactcagggcacagggtcctgggcccagtctgccctgactcagcctgcctccgtgtctgggtctcctggacagtcgatcacatctcctgcactggaaccagcagtgacgttggtgttataactatgtctccgtaggtacctaacagcctacccgaggaccaaaacggtccccccaaaacgttccaagtacggtaattttacgtacgtattcggtactaactaacgttcccggcccgttacgtacgggggttttactaacgttccgtacgtttccgtccgttcgggtacctaccgtaacgtccgttcggacctaaacgtaccgggtccctaccccgtaggtaccctaacgttccgttccgttccgggtacccttacccggaagggttccgttacgggacgggtaacggtacgggtcccgtaggtaacgtttacgttagttcgacgtagtccgtactaacgtaacgttacgaacgtacgacgtacgacgtaaccgtaaccgttcggtaaaccgtttccgtacgggtaaccggttaaccggggtaaacccggttaaacccggtaacccggtttaaccccggtaacccgtttacggggtttaccccgaacggttaacccccggtaaacccggggtaaccccctaaaccccccggtcgtttaaacccggg

SEQ ID NO: 199161 - DNA, 710 bp, Homo sapiens
  misc_feature: GYAE6OF02G5VEV.18.59.F04.1.454.CMB.1.raw
  modified_base (215)..(215): a, c, t, g, unknown or other
  misc_feature (215)..(215): n is a, c, g, or t
  modified_base (257)..(257): a, c, t, g, unknown or other
  misc_feature (257)..(257): n is a, c, g, or t
  modified_base (262)..(262): a, c, t, g, unknown or other
  misc_feature (262)..(262): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtcgtgggtctccgaggacagtcgatcaccatcncctgacacgtcggaacctagcaggtcgtagttggtagttaanaactntgtctcgtagtaaccaacacgaccaccgaagaccaaaaccgacccccaaaatccaatagtaatttaagtagtatacgtactaactaactccggacccttacggtagggttttacctaagtcgtaccttcgtcgtacgtcctaaccgtaagttccgacggaccaaccgtaccggtacccttcccgtacgtaccgtaactccgttaccgtcgggtccctaccggacggttcgacgggtaacgggaaccggcggttactaacgttaacgtttaaactttaccgttacggaccgaacgttcctaactaacttaaacgaaccgtaacgaacgtacgaactacgtaactacgttaaacgtagtaccggttaccgaaaggtaccggtaacgtaaaccgttccgtacccgtaacgtacgtacgaccgtacccgaaccggaccctaacccgacgtac

SEQ ID NO: 199162 - DNA, 674 bp, Homo sapiens
  misc_feature: GYAE6OF02GMCR7.18.59.F04.1.454.CMB.1.raw
  modified_base (232)..(232): a, c, t, g, unknown or other
  misc_feature (232)..(232): n is a, c, g, or t
  modified_base (258)..(258): a, c, t, g, unknown or other
  misc_feature (258)..(258): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatccaccatcctcctgccactggaaccngcagtgacggttggtagttataactntgtcctcctggtaaccaacacgaccacccaggacaaaccgcccccaaactcatgatttagtgatgtacctaactaactccggacccttcgtacggggtttactaacgtcgtcctttctcgtcgcctacgaacgtcgtacggacaacgtaccggtcctccctacgacctactcgtcgtacgggcctaccgaggtctaggacgggacgacgggtcctaggtaactttagttactggctacgtcttacaattactaacgaaccgacaaccgtacgccgtaaccttccttacgttacttggttaccggttaccggtaacggtaccggggtaaaccgttaacgggtacccgttacccggttaccggtacggttaccgaaccggtaacccccggtaaccgtaccccgaacccccgttaccgg

SEQ ID NO: 199163 - DNA, 635 bp, Homo sapiens
  misc_feature: GYAE6OF02I8776.18.59.F04.1.454.CMB.1.raw
  modified_base (232)..(232): a, c, t, g, unknown or other
  misc_feature (232)..(232): n is a, c, g, or t
  modified_base (363)..(363): a, c, t, g, unknown or other
  misc_feature (363)..(363): n is a, c, g, or t
  modified_base (626)..(626): a, c, t, g, unknown or other
  misc_feature (626)..(626): n is a, c, g, or t
  modified_base (631)..(631): a, c, t, g, unknown or other
  misc_feature (631)..(631): n is a, c, g, or t
  modified_base (634)..(634): a, c, t, g, unknown or other
  misc_feature (634)..(634): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgcccccaaactcatgatttangatgtcagtaatcggccctcgaggggtttcaattccgcttctctggcctccaagtctggcaacaccggccctccctgaccctatcctctcgggcctccgacggctggaggaccgaggtctgtattattacngacacgctacagtataacaacgtcagtcgaagctaacctctaaacgttccgtttacgggaaaccgttcgggaaccgtaaagggtccctaaccgttacccgtacgggtaccaaccggtaccccgaacgggaccccaaaacccccgacttaccggtcctaaccgttaccttaccggttacccccacccgttacccttaccctactaaccttcggtaaccgtcggtacgccggtccgtggaccaagggcccgcgaacggttacacngctancgnc

SEQ ID NO: 199164 - DNA, 630 bp, Homo sapiens
  misc_feature: GYAE6OF02GUN7W.18.59.F04.1.454.CMB.1.raw
  modified_base (230)..(230): a, c, t, g, unknown or other
  misc_feature (230)..(230): n is a, c, g, or t
  modified_base (268)..(268): a, c, t, g, unknown or other
  misc_feature (268)..(268): n is a, c, g, or t
  modified_base (303)..(303): a, c, t, g, unknown or other
  misc_feature (303)..(303): n is a, c, g, or t
  modified_base (483)..(483): a, c, t, g, unknown or other
  misc_feature (483)..(483): n is a, c, g, or t
  modified_base (489)..(489): a, c, t, g, unknown or other
  misc_feature (489)..(489): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctctcactcagggcacagggtcctgggcccagtctgccctgactcagcctgcctccgtgtctgggtctcctggacagtcgatcaccatctcctgcactggaaccngcagtgacgttgtgttataactatgtctctggtaccanagccaccaggcaaacgcccccaaatcatgatttangatgtcactaatccgccctgtagggtttactaacgtcgtacttctcgtggtccttaccgaagtctaggaccaaacgccggtcccttcccgtcgacctattcccgtccgtgggtccctaccgacggcctacggaacgggacgtaggtcgttagtactttacttacgtcgtcctagtcctanacttanaacaacgtccaaccgaatccgtaactccttacttacgttcgttaccgttaccgggtaacgttacggggaacccgtaacggttcccgtaacccggttaccgtaacggtacccgaacgttacccccggaacggtaaccccccc

SEQ ID NO: 199165 - DNA, 676 bp, Homo sapiens
  misc_feature: GYAE6OF02GRDYK.18.59.F04.1.454.CMB.1.raw
  modified_base (255)..(255): a, c, t, g, unknown or other
  misc_feature (255)..(255): n is a, c, g, or t
  modified_base (316)..(316): a, c, t, g, unknown or other
  misc_feature (316)..(316): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatctcctgcactggaaccagcagtgacgttggtagttaataactntgtctcctggtaccaacacgccaccgaggacaaacgacccccaaaactccatcgtatttanagtatgtactaactaagtccggaccctcgttacgggtttactaacgtcgtcttctctcggtcctccaagttcgtacggacctaacgaccggtccctacccgtacgaccctacgtccgtccggtcggtcccgtccgacggtccgtagggaccggtacggagggtccgtagtaactttacgttacgtcgaccagtcctactaattacgtaacgacgaccaaccgacgtacctacctcttacgtacgttcgttccggttaacggtaacggtacgggtaaccctaagggttaccccgtaacccgttaccggtaacggtaccgtaacccggaacccgaacccggtacccctaaccccttaacccg

SEQ ID NO: 199166 - DNA, 606 bp, Homo sapiens
  misc_feature: GYAE6OF02HX5V9.18.59.F04.1.454.CMB.1.raw
  modified_base (432)..(432): a, c, t, g, unknown or other
  misc_feature (432)..(432): n is a, c, g, or t
tcagtacgagtatgcacgaccggtgctcgatttagtacacacacttagggattgggggagctctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcgttgggtaaaggccggggggtcccttagacctccccgtgtacagcctctggattcactttcagtaacgtcctggatgaactgggtccgccgaggcctccgaggggaaggggcgtgggagtggggttcggaccgtaattaaaaccaaatgagtggtaggacaacagactacgctcgacaccgtagaaaggcagacttcaccatctanaacgagatagaattacaaaaagcaacgtctagtatcgtagactaaagtgaacagctagaacgaaccggagaaccacgaacgccgtagttactacgtacgtaccacgtacctcccgtagaaacgtccgtaacaaccttaccgtaacctacctaacggtactcggtaccctacggg

SEQ ID NO: 199167 - DNA, 699 bp, Homo sapiens
  misc_feature: GYAE6OF02F1U65.18.59.F04.1.454.CMB.1.raw
  modified_base (257)..(257): a, c, t, g, unknown or other
  misc_feature (257)..(257): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacgagggtcctgggcccagtctgccctgactcagcctgcctccgtgtctgggtctccgtggacagtcgatcaccatcctctgcactggaaccagcagtgtacgttggtagttataactntgtctcctaggtaccaacacgaccacccaggaccaaaccgacccccaaactcaatacgtatttagtagattgtactaactaacgtccggtaccctacggttacgggtttactaactccgtcttcgtcgtcggtctacctaagtcgtcggaccaaccgtaccggtcccttcccgtacgtaccctacgttccgtccgtcggtcctaccggacggtcgtacggaacgggtacggaggtctagtactttaacgttactcggtacctacgttcctagtacgtacgtagtacggtacgggtcgtagggttggttacgggtttacgttagttcggttccgtttagggtacgttaccggtaacggggtaacccttaaccgggtcccttaacccggttaccgttaacgtccggaacccggtacccggaaccggtaccccctaccccgttcg

SEQ ID NO: 199168 - DNA, 528 bp, Homo sapiens
  misc_feature: GYAE6OF02HL41Z.18.59.F04.1.454.CMB.1.raw
  modified_base (251)..(251): a, c, t, g, unknown or other
  misc_feature (251)..(251): n is a, c, g, or t
  modified_base (460)..(460): a, c, t, g, unknown or other
  misc_feature (460)..(460): n is a, c, g, or t
  modified_base (521)..(521): a, c, t, g, unknown or other
  misc_feature (521)..(521): n is a, c, g, or t
  modified_base (526)..(528): a, c, t, g, unknown or other
  misc_feature (526)..(528): n is a, c, g, or t
tcagtacgagtatgcacgaccggtgctcgatttagtacacacacttagggagttgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaatcatgatttatgatgtcactaatcggccctnaggggtttctaatcgcttctctggctcaagtctggcaacacggcctccctgaccatctcgtgggctccaggcctgaggacgaggctgtattattactgcagctcatatacaagcaccagcactctctattgtcttcggaactcgggaccaaggtcaccgtctagggtcacgcccaaggcccaacccactgtccactccgtcgttccccnccttccctcactactcgactcggacgccgggtactcggactaacgggccgactacgtgccngtacnnn

SEQ ID NO: 199169 - DNA, 592 bp, Homo sapiens
  misc_feature: GYAE6OF02JVXBS.18.59.F04.1.454.CMB.1.raw
  modified_base (336)..(336): a, c, t, g, unknown or other
  misc_feature (336)..(336): n is a, c, g, or t
  modified_base (415)..(415): a, c, t, g, unknown or other
  misc_feature (415)..(415): n is a, c, g, or t
  modified_base (457)..(457): a, c, t, g, unknown or other
  misc_feature (457)..(457): n is a, c, g, or t
  modified_base (465)..(465): a, c, t, g, unknown or other
  misc_feature (465)..(465): n is a, c, g, or t
tcagtacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgcttattttaaaaggtgtccagtgtgaggtgcagctggtggagtcgtgggggagtcgttgggtaaaggccgggggggtccttaggacctcccctgtacacgcctcgtggattctactttcagtaacggcctggatgacgtggtccgcgaggctccgagggagggctggngtgggtggacgtaattaaaaccaaactgagtggtaggacaacgagactacgctacgcaccgtagaacggcagactcacntactacaagagatagaatacaaaagcacgtctagtactcganaactaagngaactacgactagaacgtaaccgacgacgacacgtaccgtagtacttacacgtaccacgtactcccgaggaactcgtaactaactactaacgtaacgtacgtagtacggtacctacggacggtaccg

SEQ ID NO: 199170 - DNA, 820 bp, Homo sapiens
  misc_feature: GYAE6OF02G01X6.18.59.F04.1.454.CMB.1.raw
  modified_base (233)..(233): a, c, t, g, unknown or other
  misc_feature (233)..(233): n is a, c, g, or t
  modified_base (815)..(815): a, c, t, g, unknown or other
  misc_feature (815)..(815): n is a, c, g, or t
  modified_base (817)..(817): a, c, t, g, unknown or other
  misc_feature (817)..(817): n is a, c, g, or t
tcagtacgagtatgcacgaccggtgctcgatttagtacacacacttagggattggggggctttgcctgggtcctgggcccagtctgccctgactcagcctgcctccgtgtctgggtcctcctggacagtcgatcaccatctcctgcactggaaccagcagtgacgttggtgttataactatgtctctggtaccaacagcacccaggcgaaacgcccccaaatcatcgatttangatcgtacactactcggccctacgtacgggtttactaagtccgtcttctctggtacctaccaagtctggacaaccgaccggtccctccccgtcgaccctacgttccgtccggtcggggcccttaccggagggtccgttacgggaacgggtaaccgggacgggttcggttagttaacgttttaagtttaaccgtcgtaacgtacgtacctttacctaaagtttaaactaaccgaaacgtacccaacccgtaacgtaccctaaacgtttcccgtttaccggttacgttttacccggtttacccggtttaaaccgggtaacccggttaacggggtaaacccgtaaacggggttaaccccgtaacccggtttacccgtaaccgggttaacccgtaacccggtaaaccccgtaaaccccgggtaacccctaaaacccccgttacgttaaccgtaccctaacccgtttcccggtttacccgttccccccgtacccgttaccccttacccgtaacttacccgttaccgtaacgtacggtacgggtccggtccgtacggacgaacgggacgtacgtacgacgactgtacngnacg

SEQ ID NO: 199171 - DNA, 624 bp, Homo sapiens
  misc_feature: GYAE6OF02GVITA.18.59.F04.1.454.CMB.1.raw
  modified_base (322)..(322): a, c, t, g, unknown or other
  misc_feature (322)..(322): n is a, c, g, or t
  modified_base (352)..(352): a, c, t, g, unknown or other
  misc_feature (352)..(352): n is a, c, g, or t
  modified_base (364)..(364): a, c, t, g, unknown or other
  misc_feature (364)..(364): n is a, c, g, or t
  modified_base (398)..(398): a, c, t, g, unknown or other
  misc_feature (398)..(398): n is a, c, g, or t
  modified_base (408)..(408): a, c, t, g, unknown or other
  misc_feature (408)..(408): n is a, c, g, or t
  modified_base (473)..(473): a, c, t, g, unknown or other
  misc_feature (473)..(473): n is a, c, g, or t
tcagtacgagtatgcacgaccggtgctcgatttagtacacacacttagggattgggggggagaggatccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcttgggtaaaggccgggggggtcccttaggactctcctgtgcagcctctggattcagtttcagtgcctactggatgcactggatccgccaagttccgagggaanagactggtgtgggtctcgacgtattaaagntgagtgggggtncgacatccgtaggcgacgtccgagacggggcccncttcgacctntccgtacccgagaccaacaccgaaacgaccacgcttagtactctacgacaaagtgagcgagtcgnggtagtcgaggacgacggctgttactattacgtgtacgacgaagggtacgggtaaccgttaacgggtcgaacccggttacgggtacggggtttacgggtccccggtaccccggtacgggggaccccgtaacgggggaccccgttaccgggg

SEQ ID NO: 199172 - DNA, 720 bp, Homo sapiens
  misc_feature: GYAE6OF02I3E4Q.18.59.F04.1.454.CMB.1.raw
tcagtacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttcctgctgctattttaaaaggtgtccagtgtgaggtgcagctggtggagtcgtgggggaggcgttgggtaaaggccgggggggttcccttaggacctccccgtgtaccagcctctggattcactttcagtaaggcctggatgaacgtgggtccgccaggctccgaggggaagggcgtgggaggtgggtggccgtaagttaaaaccaaagtgagtgggtaggacaacagactacgctcgcaccgtagaaaggcaagtacttacacctatctacaagacgatagaacttaacgaaaaagtccaacgtacttacgtaacttctacggaactaaagtacgaaaccacggtaccctaagggaacggtaaacccggacggaaacccgaacgtacggtacccgtttagttaaacgtttaccgtaacggttaacccaaccgtaaccgttaccccgtaaagggaaaccgtcccggtaaacctaaaacccgttaaccgttaaacccgttaaccgttaaccgggttaaccgttaccgggtaaccccgtttacgggtaccggggtaacccggg

SEQ ID NO: 199173 - DNA, 681 bp, Homo sapiens
  misc_feature: GYAE6OF02G8TFO.18.59.F04.1.454.CMB.1.raw
  modified_base (228)..(228): a, c, t, g, unknown or other
  misc_feature (228)..(228): n is a, c, g, or t
  modified_base (247)..(247): a, c, t, g, unknown or other
  misc_feature (247)..(247): n is a, c, g, or t
  modified_base (301)..(301): a, c, t, g, unknown or other
  misc_feature (301)..(301): n is a, c, g, or t
tcagtacgagtatgcacgaccggtgctcgatttagtacacacacttagggagttggggggggtctcaggaggcagcgctctcgggacgtctccaccatggcctgggctctgctattcctcaccctctcactcagggcacagggtcctgggcccagtctgccctgactcagcctgcctccgtgtctgggtctcctggacagtcgatcacgatctcctgcactggaaccngcagtgacgttggtgttanactatgtctcctggtacaacagcaccaggcaaacgccccaaatcagtgatttangatgtactataagtcggcctgacgggttacaatcgcttctcgtggctaccgaagtctacggacaacgaccggtccctaccgtgaacccgtattaccgtcgtcgggccttaccgaagggtcttacgggaacggacgggacgggaccttaggtaagtttaaccttaacgacgtacgaacggttcctacgaattaaccgtaactaaacggacctaccgaacgtaccgtaaccgtttcctaacttacgttaggttacccgtttaacggaaacccgggtttggggaaaccccgttaaagggtaccccgttacccgggttacccgttacgggtaacccggtaaccggtaccccggaaacggtaccccccgtaaacccctacccggg

SEQ ID NO: 199174 - DNA, 463 bp, Homo sapiens
  misc_feature: GYAE6OF02HEOA2.18.59.F04.1.454.CMB.1.raw
  modified_base (287)..(287): a, c, t, g, unknown or other
  misc_feature (287)..(287): n is a, c, g, or t
  modified_base (299)..(299): a, c, t, g, unknown or other
  misc_feature (299)..(299): n is a, c, g, or t
  modified_base (306)..(306): a, c, t, g, unknown or other
  misc_feature (306)..(306): n is a, c, g, or t
  modified_base (310)..(310): a, c, t, g, unknown or other
  misc_feature (310)..(310): n is a, c, g, or t
  modified_base (403)..(403): a, c, t, g, unknown or other
  misc_feature (403)..(403): n is a, c, g, or t
  modified_base (409)..(409): a, c, t, g, unknown or other
  misc_feature (409)..(409): n is a, c, g, or t
  modified_base (422)..(422): a, c, t, g, unknown or other
  misc_feature (422)..(422): n is a, c, g, or t
  modified_base (431)..(431): a, c, t, g, unknown or other
  misc_feature (431)..(431): n is a, c, g, or t
  modified_base (440)..(440): a, c, t, g, unknown or other
  misc_feature (440)..(440): n is a, c, g, or t
  modified_base (446)..(463): a, c, t, g, unknown or other
  misc_feature (446)..(463): n is a, c, g, or t
tcagtacgagtatgcacgaccggtgctcgatttagtacacacacttagggattgggggctttgtctgggtctcctggacagtcgatcaccatctcctgcactggaaccagcagtgacgttggtggttataactatgtctcctggtaccaacagcacccaggcaaagccccccaaactcatgatttatgatgtcactaatcggccctcaggggtttctaatcgcttctctggctcagtctggcacacggcctcctgaccatctctgggctccgaggctggacggacgngctgtattatcngcagctnatanacagcacagctactctctatgtacgtttggaactgggacaggtccacgtcctaggtcacgcccaaggcccacccactcgtcacctctctcccnccctcnccactctcgtacngcgcggtcnggcgacgcncagtgnnnnnnnnnnnnnnnnnn

SEQ ID NO: 199175 - DNA, 600 bp, Homo sapiens
  misc_feature: GYAE6OF02I49KI.18.59.F04.1.454.CMB.1.raw
  modified_base (321)..(321): a, c, t, g, unknown or other
  misc_feature (321)..(321): n is a, c, g, or t
  modified_base (418)..(418): a, c, t, g, unknown or other
  misc_feature (418)..(418): n is a, c, g, or t
tcagtacgagtatgcacgaccggtgctcgatttagtacacacacttagggattggggacgctctgggagaggagccccagccttgggagttcccaagtgttttcattcagtgatcaggactgaacacagaggactcaccatggagtttgggctgagctggatttcctgctcgctattttaaaggtgtccagtgtgaggtgcagctggtggagtcgtgggggaggcgttagggtaaacggccgggggggttacccttaggacctccccgtgtacagcctctggattcgactttcagtaacggcctaggatgaactgggtccncgaggcctcgagggagggctggagtgggtgctataaacaatgagtggtggacacagactacgctgcaccgtagaaagcagattcacctatcagaagnatacgattaacaaaagcacgtctagtactctagacaaagtcgaaactcgactaggaaccgacgaagacctacgacgtcgtagaacttaccgtaccgtaccacctaccggtaccccttagggaacgttcctaacctaacgttaccttacctaacgttaccggtacttaccggacccttacggg

SEQ ID NO: 199176 - DNA, 536 bp, Homo sapiens
  misc_feature: GYAE6OF02F4STX.18.59.F04.1.454.CMB.1.raw
  modified_base (441)..(441): a, c, t, g, unknown or other
  misc_feature (441)..(441): n is a, c, g, or t
  modified_base (453)..(453): a, c, t, g, unknown or other
  misc_feature (453)..(453): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgcccctgactcagcctgcctccgtgtctgggtctcctggacagtcgatcaccatctcctgcactggaaccagcagtgacgttggtggttataactatgtctcctggtaccaacagcacccaggcaaacgccccccaaactcatgatttatgatgtcactaactcggccctcgtaggggtttctaatcgcttctctggctccaagtctggcaacacggccctccctgaccatcctctgggcctccgaggctggaggacgaggctgattatactgcagctcatanacaagccaccancactctctatgtcttacggacgtcgggaacctaaggtccaccgttccgtaggtccacgccccgaacggaccccaacccctacg

SEQ ID NO: 199177 - DNA, 690 bp, Homo sapiens
  misc_feature: GYAE6OF02GO3NI.18.59.F04.1.454.CMB.1.raw
  modified_base (230)..(230): a, c, t, g, unknown or other
  misc_feature (230)..(230): n is a, c, g, or t
  modified_base (255)..(255): a, c, t, g, unknown or other
  misc_feature (255)..(255): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacgagggtcctgggcccagtctgccctgactcagcctgcctccgtgtctgggtctcctggacagtcgatcaccatcctctgcacgtggaaccngcagtgtacgttggtagttatactntgtctcctaggtaccaacacgccacccaggaccaaacgacccccaaatcatagtatttatgtatcgtactaactaacgtcccggtacccttacggttacggggttttactaacgttccggtcctttcctccgttcggtaccttaccgtaaggttccgtacggacctaaaccgtaccggtccctcccgtacgaccctagtccgtcggtacggtcctaccggagtcgtaggacggacggtacggtcgtagtaacttacgttactacgcctagtcctacgtaataacctaagaaccgaccaaccgtacgtacctacccttcgttaacctacgttccggtttacctaacgggtaccggtaacgggtaaccgtaccggtacccgtaccgttacggtaccggtccgaaccggacccgtaacccgaccccgtacccttaccg

SEQ ID NO: 199178 - DNA, 528 bp, Homo sapiens
  misc_feature: GYAE6OF02FT847.18.59.F04.1.454.CMB.1.raw
  modified_base (356)..(356): a, c, t, g, unknown or other
  misc_feature (356)..(356): n is a, c, g, or t
  modified_base (476)..(476): a, c, t, g, unknown or other
  misc_feature (476)..(476): n is a, c, g, or t
  modified_base (502)..(502): a, c, t, g, unknown or other
  misc_feature (502)..(502): n is a, c, g, or t
  modified_base (523)..(525): a, c, t, g, unknown or other
  misc_feature (523)..(525): n is a, c, g, or t
  modified_base (527)..(528): a, c, t, g, unknown or other
  misc_feature (527)..(528): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggcctccaggctggaggacgaggctagattattactgcagctnatatacaagcaccagcactctctatgttcttcgaactcgggaaccacggtccacccgtctaggtcacgacccgaagaccccaacccactcgtccacttcctaccgttccccacccttccncctatacctcgtactgacggcggtcnggaccgaggccgacgatacgnnncnn

SEQ ID NO: 199179 - DNA, 604 bp, Homo sapiens
  misc_feature: GYAE6OF02HBXPT.18.59.F04.1.454.CMB.1.raw
  modified_base (563)..(563): a, c, t, g, unknown or other
  misc_feature (563)..(563): n is a, c, g, or t
tcagtacgagtatgcacgaccggtgctcgatttagtacacacacttagggattggggctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcgttgggtaaaggccgggggggttcccttaggacctccccgtgtacagcctctggacttcactttcgagtaacggcctggatgaactgggtcccgcgaggctaccgaggggaaggggcgtgggaggtggggttcggaccgttaattaaaacccaaaacgtgaagtgggtagggaacaacgagactacgctagaccaccgtagaaacggcagacttccaacatctacaagagatgaattacaaaagcaacgactagtatcgagtaacaagtacgaactacgacgtagaacgaaccgaagacacgagaccgttagtacttactagtaccactactacccagaacncgtacaactactactacgtagtactcggactcgacggaccg

SEQ ID NO: 199180 - DNA, 613 bp, Homo sapiens
  misc_feature: GYAE6OF02H6CCS.18.59.F04.1.454.CMB.1.raw
  modified_base (200)..(200): a, c, t, g, unknown or other
  misc_feature (200)..(200): n is a, c, g, or t
  modified_base (228)..(228): a, c, t, g, unknown or other
  misc_feature (228)..(228): n is a, c, g, or t
  modified_base (253)..(253): a, c, t, g, unknown or other
  misc_feature (253)..(253): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacngtcgatcaccatctcctgcactggaccngcagtgtacgttggtgttataactntgtctctagtacacacgcaccagacaacgaccccaaactcatgtatttatgatgtacactaactccgccctcgtagggttctaactcgtcttctcgtcgtctacctagtcgtacggaccaacgccgtccctcccgtacgaccattcgtcgtcgggcctaccgcggtcgtaggacggacggaggtctagtaatttacttacgtcgcgtacgctactaatacgtaaacacgaccaccagcctaactcttaactacgttcgttaccggttaccggtacgtacgggtaaccctacggtacccgtacccgttccggttaacggtacccggaaccgtaccccggaacggaccccctaacccgtccg

SEQ ID NO: 199181 - DNA, 718 bp, Homo sapiens
  misc_feature: GYAE6OF02JX7UI.18.59.F04.1.454.CMB.1.raw
  modified_base (227)..(227): a, c, t, g, unknown or other
  misc_feature (227)..(227): n is a, c, g, or t
  modified_base (252)..(252): a, c, t, g, unknown or other
  misc_feature (252)..(252): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggacncacctccaacagtcggggcggttangatgtacacgtggtaccagtcagcttccgagggaccacggaccccccaaaacgtccctctaacttccgtttacggtacgaccaaacaacgtcccgggccccttacggtaaccggggtccccttggaacccgtactttccgtcgtccgggtaccttccgaacggttccgtacgggacctaacccgttcgaaccgtcccccgttacccgttacgggcccctaacgttcccgtaccggtcggggtccctcccggaacgggtccagggaacgggtacgacgggtcttagtactttacttacgcgactacgtctacgaatactacgacgtacccacacgtacccaacttccttacgttaacttcggttaccggtttaaccgacggtacgggtaaccttaaacgggtcccgtaccgtttaccggtacggttcccgaacgtacccccgggaacgttaccccaaccccgttacg

SEQ ID NO: 199182 - DNA, 587 bp, Homo sapiens
  misc_feature: GYAE6OF02F918F.18.59.F04.1.454.CMB.1.raw
  modified_base (255)..(255): a, c, t, g, unknown or other
  misc_feature (255)..(255): n is a, c, g, or t
  modified_base (308)..(308): a, c, t, g, unknown or other
  misc_feature (308)..(308): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgtttggtgttaataactntgtctcctggtaccaacagcaccaggacaaacgcccccaaactcatgatttangatgtcacttaatccggcctacgtaggggtttctaatcgcttctcgtcggtctacctagtctacgaacaacgacggcccttcccgtacgaccatcgtccgtcgggcctacccgaggtacgtggaacgggtacggacggtactggtaatttacgttactcgcagctacattactacacgtacaccagtcctaactctacttatcgtcgttaccgacgtacggtaccgaacgtctacccgtcgtacgtcgacccgaccgaaccggaccctaccctatcccg

SEQ ID NO: 199183 - DNA, 685 bp, Homo sapiens
  misc_feature: GYAE6OF02G0ZUO.18.59.F04.1.454.CMB.1.raw
  modified_base (308)..(309): a, c, t, g, unknown or other
  misc_feature (308)..(309): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatccaccatctcctgcactggaaccagcagtgacgttggtggttataactatgtctcctggtaccaacagccaccaggacaaacgcccccaaatcatgatttannatgtacactaactccggcctcgtacgggtttctaacgtcgtctttctcgtcggcctaccgaacgttctacgggaccaaacgaccggtccccttacccgtcgaaccctaacgttccgttcgtcggggcccttaccggaggtacgtacggaacgggacggtaggccgttagtaactttaacttaccgtgtacctacgtctactaacttaacgtaacctaacgaccctaaacggactacccgttacctccgtttaccgtacgtttccgtttaccggttaccggtaacggttccgggtaaccgtaaccgggttcccgtaccggttaccgtacggtaccgacccggtaccccggaaccggtaccccctaacccgttaaccg

SEQ ID NO: 199184 - DNA, 927 bp, Homo sapiens
  misc_feature: GYAE6OF02FWRA2.18.59.F04.1.454.CMB.1.raw
tcagtacgagtatgcacgaccggtgctcgatttagtacacacacttagggattggggggggtctcaggaggcagcgctctcgggacgtctccaccatggcctgggctctgctatttccctccaccctcctcactcgagggcacgacgggtccgtcgggcccagtctcgccctgactcgacgtcctcgtcccgtccgtgttcgtcgggtcctccgtggactagtacgtactaccaacctacttcccttccgtcgacctaacgtaccgggaaacccacggtacgtacgggttacggttacgggtttgggttacggtttaaacttaaacttacgttcgttaccttcccggtacggtaaacccaaacgacgtacccaaccccgaggaaccgaaaaccccgaacccccctaaaacttccaaagttacgttaatttacgtagtaacgttacgtacctaaaccgttaaccggtccccggtacccgtttaacgggtttacgggttttacctaacggttccgttacctttccgtacgttccggtacccttaaccgtaacggttcccggtacggtaaccgtaaacccggtaccccggtccccttacccccggtaacgtaacccctaacgttcccgttcggtacccgggtcctacccggtacgggttccgtaagggaaccggggtaaccggacgggttacccgtaaggttttaactttaaaccgttcgttaacggtaccgtacgtacctacctaagtttaaacccaacgaaccgtacctaacccacgtacctacctttacggttacttaccgtttacgttccgttaaccgggtaaccggtaaccgggtaacccgtaacgggttaccccttaccggttaccggtacggtaaccgtaccccgtaaacccggtaacccggaccccctaacccgttaacccg

SEQ ID NO: 199185 - DNA, 495 bp, Homo sapiens
  misc_feature: GYAE6OF02GISBL.18.59.F04.1.454.CMB.1.raw
  modified_base (471)..(471): a, c, t, g, unknown or other
  misc_feature (471)..(471): n is a, c, g, or t
  modified_base (473)..(473): a, c, t, g, unknown or other
  misc_feature (473)..(473): n is a, c, g, or t
  modified_base (475)..(495): a, c, t, g, unknown or other
  misc_feature (475)..(495): n is a, c, g, or t
tcagtacgagtatgcacgaccggtgctcgatttagtacacacacttagggattgggggctttgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggccctccctgaccatctctgggctccaggctgagacgaggctgattattactgcagctcatatacaagcaccagcactctctatgtcttcggactgggaccaaggtccaaccgtcctaggtcacgacccaaggcccaaccccactcgtcctacctcctcgttaccccacccttccctaccacttactccgtacttgacgcgggctggcgaaggcgacagtgnancnnnnnnnnnnnnnnnnnnnnn

SEQ ID NO: 199186 - DNA, 733 bp, Homo sapiens
  misc_feature: GYAE6OF02HYY8S.18.59.F04.1.454.CMB.1.raw
  modified_base (236)..(236): a, c, t, g, unknown or other
  misc_feature (236)..(236): n is a, c, g, or t
  modified_base (263)..(263): a, c, t, g, unknown or other
  misc_feature (263)..(263): n is a, c, g, or t
  modified_base (341)..(341): a, c, t, g, unknown or other
  misc_feature (341)..(341): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacgagggtcctgggcccagtctgccctgactcagcctgcctccgtgtctgggtctccgtggacagtcgactcaaccatcctccgtgcactaggaaccngcaggtgacggttggtgttaataactntgtactccgtaggtaccaacgacgaccacccgaggaccaaaccgacccccctaaaacgtctaagtaggtattttacgngtagttcgtacgaacttaacgtcccggacccttaggtacgggtttacctacgttcggtctttacgtcgttacggtccttaccgtaagtccgtaggaaccctaaccggaccgtccctccgtacgtaccctacgttccgtcggtcgggtccctaccggacggtcgtacggtacgggaaccggtaggaccgttagttaactttacgttacgtcgtaccgaacgttctacgaacttaacacgaagacccgtacacggccttaacgtcgtaccgttagtccggtttaccgttacgggaaccgttcgggaacccgttaacgggtaccttaaccccgggtacggttaacgggacccgtaaccggaaccccgtaaccggtacccccaacccggttaccgg

SEQ ID NO: 199187 - DNA, 541 bp, Homo sapiens
  misc_feature: GYAE6OF02GC9LH.18.59.F04.1.454.CMB.1.raw
  modified_base (308)..(308): a, c, t, g, unknown or other
  misc_feature (308)..(308): n is a, c, g, or t
  modified_base (456)..(456): a, c, t, g, unknown or other
  misc_feature (456)..(456): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggacaaacgcccccaaactcatgatttangatgtacactaatccgccctcgtagggtttctatcgtcttctctggctcagtctggacacgacgcctccctagaccctatctcgtcgggtcctccgaggtctggaggacgaggctagtattatactgcagtctcatatacagccacanctactctctagtcgttccgtcgaacgtcgggaactacggtcctaccggttctacggtcaccgcccgaacggaccccaaccctacg

SEQ ID NO: 199188 - DNA, 667 bp, Homo sapiens
  misc_feature: GYAE6OF02FQIID.18.59.F04.1.454.CMB.1.raw
  modified_base (391)..(391): a, c, t, g, unknown or other
  misc_feature (391)..(391): n is a, c, g, or t
tcagtacgagtatgcacgaccggtgctcgatttagtacacacacttagggattggggagctctgggagaggagcccccagccttgggattcccaagtgttttcattcagtgatcaggactgaacacagaggactcaccatggagtttgggctgagctggattttccttgctgcttattttaaaggtgtccagtgtgaggtgcagctggtggagtcgtgggggagcgttgggtaaaggcccgggggggttcccttagacctcccctgtacacgcctctggattcactttcagtaaggcctggatgaacgtgggtccgccgaggcctccgaggggacgggctgggaggtgggttgccgtaattaaaaccaaatgagtggaggacaacgagacncgctgccaccgtgaaagcagactcaccatcacaagagatgaacttaacaaaaacgcaacgtactacgttaatcgtagactaaagtacgaaactaacgaccctaaggaaccggtaaacccggaacggaaccgaaccgacggtacccgttaacggttaacttaacccgttacgttaccccaacctaccctaaccccgtaaggaaaccgtaccgttaacctaaaccgttaaccttaaccgttaacgttaaccggtaacgttaccggtacccgtaccggg

SEQ ID NO: 199189 - DNA, 691 bp, Homo sapiens
  misc_feature: GYAE6OF02G9EB8.18.59.F04.1.454.CMB.1.raw
  modified_base (204)..(204): a, c, t, g, unknown or other
  misc_feature (204)..(204): n is a, c, g, or t
  modified_base (320)..(320): a, c, t, g, unknown or other
  misc_feature (320)..(320): n is a, c, g, or t
tcagtacgagtatgcacgaccggtgctcgatttagtacacacacttagggagtttggggggctggggtctcaggaggcagcgctctcgggacgtctccaccatggcctgggctctgctattcctcaccctcctcactcagggcacagggtcctgggcccagtctgccctgactcaacctgcctccgtgtctgggtctctggacngtcgatcaccgatctccgtgcacgtgggaaccagcagtcgacgttggtgttatactatgtctcctgtaccacgagcaccgaggacaacgccccaagtcatagtattatagatgtanagtagccgcctgtacgggtttcagtcgtcttcgtacgtacgtctacgtagtctcggacaaccgaccggtcctacccgtagaccctacgttccgttcgaccgggcctaccgaggtacctaaggaggtacggtacgggtactttaggtaacttttaacgttaccgtcgtaaccgtacgtaccttaacgtaactttaacgaaccgtaacgtccgaaaccgtacgtaacccttaaccgttaccgttacgttaacgtttaccggttaacggttaccgggtaacgttaccggaaacccggttaacggttacccgttacccggttaccgtaacggtaccgtaaccggaaccccggttaaccgacccccttaaccccgg

SEQ ID NO: 199190 - DNA, 641 bp, Homo sapiens
  misc_feature: GYAE6OF02GTGOY.18.59.F04.1.454.CMB.1.raw
  modified_base (229)..(229): a, c, t, g, unknown or other
  misc_feature (229)..(229): n is a, c, g, or t
  modified_base (405)..(405): a, c, t, g, unknown or other
  misc_feature (405)..(405): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtcctgggtctcctggacagtcgatcaccatctcctgcactggaaccngcagtgacgttggtgttataactatgtctcctggtaccaacagcacccaggcaaacgcccccaaatcatgatttatgatgtacactaatcggccctgtacggggtttctaactcgtcttctctcggctccaagtctggacaacgacgccctcctgacctatctcgtggtctaccgnggctagacggacgacggtctagaatttatacgtgtacacgcctacgattaactaacaacgaccaaccgacgtaccaaccgttcttaccgttaacgttcggttaccttacccggggtaacgtaccggggtaacccgttaaaccgggtacccgttaacccgggttaccccggtaacggttcccggtaaccgtaaccccccggaaaaccgggtaccccccgtaaaccccgttaccccgg

SEQ ID NO: 199191 - DNA, 544 bp, Homo sapiens
  misc_feature: GYAE6OF02GNRKJ.18.59.F04.1.454.CMB.1.raw
  modified_base (254)..(254): a, c, t, g, unknown or other
  misc_feature (254)..(254): n is a, c, g, or t
  modified_base (368)..(368): a, c, t, g, unknown or other
  misc_feature (368)..(368): n is a, c, g, or t
  modified_base (382)..(382): a, c, t, g, unknown or other
  misc_feature (382)..(382): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactntgtctcctggtaccaacagccacccaggacaaacgccccccaaaactcatgatttatgatgtcactaatcggccctgagggttctaatcgtcttctctgctcagtctggcaacncggcctcctgaccntctcgtcggctccgaggtctggacggacgaggcctagtattattactgcacgtctacaatataacacgccaaccagctactctactatcgtacttacggacgtcgggaacctaggtccaccgttccgtacggtaccacgacccgacgaccccaacccgtacg

SEQ ID NO: 199192 - DNA, 636 bp, Homo sapiens
  misc_feature: GYAE6OF02IO7S2.18.59.F04.1.454.CMB.1.raw
  modified_base (313)..(313): a, c, t, g, unknown or other
  misc_feature (313)..(313): n is a, c, g, or t
  modified_base (424)..(424): a, c, t, g, unknown or other
  misc_feature (424)..(424): n is a, c, g, or t
tcagtacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcgttagggtaaacggccgggggggttcccttaggaccttcccctgtacagcctctggattcactttcagtaagcctggatgaactgggtccncaggctccgagggagggctggagtgggtgacgtaataaaacaaactgagtggtaggacaacgagactacgctagccaaccgtagaaacggcaagacttacaccaatcctanaagagagtagtaataacgaaaaagccaacgtctagtacgtactacgtacaaagtacgaactaacgacctagaacggaaaccgtaaggacgaacgacggaccgtagtaacgttaactagtaaccctactacctccctaaggaacgtaccgtaactaaacccgttactaaccgttaacgttacggtagtaccggtacctcggtacggaacccgg

SEQ ID NO: 199193 - DNA, 606 bp, Homo sapiens
  misc_feature: GYAE6OF02FM5B0.18.59.F04.1.454.CMB.1.raw
  modified_base (309)..(309): a, c, t, g, unknown or other
  misc_feature (309)..(309): n is a, c, g, or t
  modified_base (431)..(431): a, c, t, g, unknown or other
  misc_feature (431)..(431): n is a, c, g, or t
  modified_base (450)..(450): a, c, t, g, unknown or other
  misc_feature (450)..(450): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaacagtgacgttggtgttaataactatgtctcctggtaccaacagccaccaggaccaaacgcccccaaactcatgtatttangatgtcaactaatccggcctcgtagggtttctaatcgtcttctcgtcgctccgaagtctaggacaaccacggtccctccctcaccactcctacgtcgggcctccgacgtctaggacggacgnggctagtatttacgttacncgtcacgtctactaactaactacgaagccaaccgatacctacctctaccttagttccgttacgttaccgaaccggtcgggaacccgtaaggtcccgtaaccggtttccgacgggtaccgaccgaacccggtaacgacccccaacccgtacttacgg

SEQ ID NO: 199194 - DNA, 665 bp, Homo sapiens
  misc_feature: GYAE6OF02HZ5WU.18.59.F04.1.454.CMB.1.raw
  modified_base (254)..(254): a, c, t, g, unknown or other
  misc_feature (254)..(254): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtggaaccagcagtgacgttgtgttatactntgtctctgtacacacgcaccagacaaacgaccccaactcactgtattatgtactcgtactactaactccggtcccttacgttacggggtttacttaacgttccgtcgttccttcgtcggtacctactaacgttcgtcggacctaaccgaccggcccttccgtcgaccctagtccttcgtcgggtcctcccggtagtcgtacggacggaccggagggtaccttaggtactttaacgttaccgtcgacgtaacggtctaccgtaagttaacgtaacgaaccggacccgtaaccaccgtactaccttaccttacgttacgtccgttttcgtaaccggtaaccggttccgggaaaccgttacggttcccgtaccgttaccgtaccggttaccgacgtacccgaacggtaaccccc

SEQ ID NO: 199195 - DNA, 716 bp, Homo sapiens
  misc_feature: GYAE6OF02IKMZM.18.59.F04.1.454.CMB.1.raw
  modified_base (257)..(257): a, c, t, g, unknown or other
  misc_feature (257)..(257): n is a, c, g, or t
  modified_base (259)..(259): a, c, t, g, unknown or other
  misc_feature (259)..(259): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtcctcctggacagtcgatcaccatcctcctgctacgtcggaccagcagtgacgttggtagttatactntntctctgtaccacagcaccagacaacgccccaactcatactatttatgatcgtacactaactccgtacctcgtacgggttctaagtccgtacttccgtcgtacggtctaccgtaacgttcgtacggtaccaacgtaccggtacccttaccccgtacgacctacgttccgttaccgtcggggtaccctccgaacgggtcctagggaacgggttaaccggacgggttacgttacgttaacggttttaacttaaccgtggtaccgtacggtacctacgtaattaaccgtaaacgtaccgactaacccgaacgtacccgtacccttacgtaccttacggttacgtttaccggttaacggaccggttaaccgggtaaaccggtacgggtacccgttaacccgtacggttaccggtaccgtaaacccggaaccccgtaaccggacccccgtaacccgtacccgg

SEQ ID NO: 199196 - DNA, 674 bp, Homo sapiens
  misc_feature: GYAE6OF02GYXSM.18.59.F04.1.454.CMB.1.raw
  modified_base (200)..(200): a, c, t, g, unknown or other
  misc_feature (200)..(200): n is a, c, g, or t
  modified_base (228)..(228): a, c, t, g, unknown or other
  misc_feature (228)..(228): n is a, c, g, or t
  modified_base (251)..(251): a, c, t, g, unknown or other
  misc_feature (251)..(251): n is a, c, g, or t
  modified_base (268)..(268): a, c, t, g, unknown or other
  misc_feature (268)..(268): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacngtcgatcacatctcctgcactggaaccngcagtgacgttggtgttatactntgtctctggtaccaacngccaccaggacaaacgacccccaaactcatagtatttatagtatcgtacaacttaacgtccggtccctacggtacgggtttactaacgtcgtctttctcgtcgtcctaccgtaacgtcgtacggaccgtaaccgccggtccctccgtacgacctacgtccgtacgtcgggtccgtccgggtctacgggaacggacggtacggtcgtaggttaatttacgttaccgtgtcgtacgtctactaataactaacgaacgacctaaccgacgtacctaaccttccgttacttacgttcggtacccttacgggtaacgtaccgggtaaaccgtaccggttacccgtaccccggttaccgtacggtaccgtaccggaacccgtaaccggaccccctaacccgtaacgttcccg

SEQ ID NO: 199197 - DNA, 705 bp, Homo sapiens
  misc_feature: GYAE6OF02H8008.18.59.F04.1.454.CMB.1.raw
  modified_base (221)..(221): a, c, t, g, unknown or other
  misc_feature (221)..(221): n is a, c, g, or t
  modified_base (286)..(287): a, c, t, g, unknown or other
  misc_feature (286)..(287): n is a, c, g, or t
  modified_base (545)..(545): a, c, t, g, unknown or other
  misc_feature (545)..(545): n is a, c, g, or t
tcagtacgagtatgcacgaccggtgctcgatttagtacacacacttagggagttggggggggtctcaggaggcagcgctctcgggacgtctccaccatggcctgggctctgctattcctcaccctcctcactcagggcacgacgggtcctcgggcccagtctcgccctgactcagcctgccctccgtgtccgtgggtcctccgtggacaggtcgatcaccnttcctcctgcacgtggaaccagcagtgtacggtttggtagttaatactatgtctctagtaaccannccaccgagacaaccgaccccaatcatgtaatttatgatacgtctaacgtaacgtccggtacccgtacggttacgggtttactaacgttccgttcctttccgtcgttccggccttacgtaacgttcgacgtaaccgaacccgtacgtccctcccgtacgaacctcgtccgtcgtcggtccgtaccgtacggtcggtggacggacggacggtcgtagttattacgtttactcgtactacgtactacgtaactaactaacncgtaaaaaaaaaaaaaaaaaccgtccgtaacctacctacctacttacgttacgttaccggttacgttaaccggtaaccggtaacggtaaccgtaacggtaccgtaccgtaccgttacggtaccgtaccgaacccgtaccggtaccccgtacccgtacccg

SEQ ID NO: 199198 - DNA, 647 bp, Homo sapiens
  misc_feature: GYAE6OF02HNPWQ.18.59.F04.1.454.CMB.1.raw
  modified_base (249)..(249): a, c, t, g, unknown or other
  misc_feature (249)..(249): n is a, c, g, or t
tcagtacgagtatgcacgaccggtgctcgatttagtacacacacttagggagttggggggggtctcaggaggcagcgctctcgggacgtctccaccatggcctgggctctgctattcctcaccctctcactcagggcacagggtcctgggcccagtctgccctgactcagcctgcctcgtgtctgggtctcctggacagtcgatcacatctctgcactggaaccagcagtgacgttggtgttataactntgtctcgtggtaccaacagcaccaggacaaacgcccccaaatccatcgtattttactgatgtacaacttaacgtccggcccttaggtacgggttttactaagtccgtacttctcgtggcctaccgtaagtcgtacggaccaacgaccggtcccttacccgtgaacctacttcgtcgtacgggtccttaccgaggtcttaggaggaacggtacggctaggtaatttacttacgtgacagtctactataactacgaacgaccaacgacgaccgtaactccgttacttacgtcgttaccgttaacggtaacggttacggaaccgtaacggtacccgttacccggttacgtaacggttaccgaacccggtaccgaacccggtaccccgtaacccgttaccgg

SEQ ID NO: 199199 - DNA, 771 bp, Homo sapiens
  misc_feature: GYAE6OF02JVN3N.18.59.F04.1.454.CMB.1.raw
tcagtacgagtatgcacgaccggtgctcgatttagtacacacacttagggattgggggggagaggagccccagccttgggattcccaagtgttttcattcagtgatcaggactgaacacagaggactcaccatggagtttgggctgagctggattttccttgctgcttattttaaagtgtccagtgtgaggtgcagctggtggagtcgtgggggaggcgttagggtaaaggccggggggttccttaggacctccccgtgtacagtccgtcgtaggtattcctactttcaggtaacggtcctaggatagaacgtcgggtacccgcgacggtcctccggaggggaacgggtcgtaggggtaggtggggttcggaccgttaaagttaaaaccgaaacgtgagttacgggaggaacaacgagtacctacgcgtgccgtaaccgtagaaacgcgagtactaccacctacgtctaacgaagagtacgtagtaacttaaacgaaaaacgtcgtaaacgtcgttaacgtactaccgtaacgtaaactaaacgttaacggtaaacgtacgtaacccgtaaggaaaccggtaaacccggaaacggtaaccaacgtaaccgggtaccgttaacgttaaccgtttaaccgtaccggtaaaccctaccgtaacccgtacccgttacggaaaccgttcccgtaacttaaacccttacgtaaccttaaccggttaacggttacgtaccgtacccgttacgggtaccggacgtaacccggtacccgg

SEQ ID NO: 199200 - DNA, 554 bp, Homo sapiens
  misc_feature: GYAE6OF02HOQPV.18.59.F04.1.454.CMB.1.raw
  modified_base (240)..(240): a, c, t, g, unknown or other
  misc_feature (240)..(240): n is a, c, g, or t
  modified_base (250)..(250): a, c, t, g, unknown or other
  misc_feature (250)..(250): n is a, c, g, or t
  modified_base (265)..(265): a, c, t, g, unknown or other
  misc_feature (265)..(265): n is a, c, g, or t
  modified_base (294)..(294): a, c, t, g, unknown or other
  misc_feature (294)..(294): n is a, c, g, or t
  modified_base (380)..(380): a, c, t, g, unknown or other
  misc_feature (380)..(380): n is a, c, g, or t
  modified_base (388)..(388): a, c, t, g, unknown or other
  misc_feature (388)..(388): n is a, c, g, or t
  modified_base (428)..(428): a, c, t, g, unknown or other
  misc_feature (428)..(428): n is a, c, g, or t
  modified_base (456)..(456): a, c, t, g, unknown or other
  misc_feature (456)..(456): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcacgatctctagcactggaccagcagtgacgttggngttataactntgtctctggtacaanagcaccaggacaaacgcccaaactcagtntatttatgatgtcactaattcggcctcgaggggtttctaatcgtcttctctaggctcaagctggacacacgcctcctgaccatctnggctccgngcctggagaccgaggctaggaacttaacgtttcagtcgancgttaccataacgtaacaacgcaaaccncgtactactctagtacgtcgttacgttacggaacgtcggaaccgtacggtacctacgtaccgtacggtccgaccgtacccgaccgaccccgaacctcg

SEQ ID NO: 199201 - DNA, 649 bp, Homo sapiens
  misc_feature: GYAE6OF02I9LPI.18.59.F04.1.454.CMB.1.raw
  modified_base (183)..(183): a, c, t, g, unknown or other
  misc_feature (183)..(183): n is a, c, g, or t
  modified_base (229)..(229): a, c, t, g, unknown or other
  misc_feature (229)..(229): n is a, c, g, or t
  modified_base (256)..(256): a, c, t, g, unknown or other
  misc_feature (256)..(256): n is a, c, g, or t
  modified_base (261)..(261): a, c, t, g, unknown or other
  misc_feature (261)..(261): n is a, c, g, or t
  modified_base (272)..(272): a, c, t, g, unknown or other
  misc_feature (272)..(272): n is a, c, g, or t
  modified_base (292)..(292): a, c, t, g, unknown or other
  misc_feature (292)..(292): n is a, c, g, or t
  modified_base (306)..(306): a, c, t, g, unknown or other
  misc_feature (306)..(306): n is a, c, g, or t
tcagtacgagtatgcacgaccggtgctcgatttagtacacacacttagggattggggggggtctcaggaggcagcgctctcgggacgtctccaccatggcctgggctctgctattccctcaccctcctcactcagggcacagggtcctgggcccagtctgccctgactcaacctgcctccgtntctgggtctcctggacagtcatccaccatctcctgcactggaaccngcagtcgagttggtacgttataactangtccnctggtaccaanagcaccagcaaacgcccaancgaatgtaatttangtagtcgtacaagtactccggtacctacggttaggttctactccgtcttcctcgtccgacttaccgacgtcgtacggaccaaccgacccggtaccctacccgtacgaacctacgttcctcggtccggtacccgtaccgacggtcgtacggaacgggtacggtacggtacgttagttaaacgtttacttacgcgtacgagttacctaacgtaataactaacgaaccgtaccaccgaacgtccaccttacttacttagttaccgttacgtacgtaacggtacggtaacgaacgtccgtaccgtagtacggtaccgtacgacccgaaccgtaccctacctactacg

SEQ ID NO: 199202 - DNA, 632 bp, Homo sapiens
  misc_feature: GYAE6OF02GER1C.18.59.F04.1.454.CMB.1.raw
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggacaaacgcccccaaaatcatgatttatgatgtacactaatccggcctcgtagggtttctaatcgtcttctctggtctaccaagtctggacaacgacggtcctcccgtgaccctatccgtctcgggcctccgaggctggacggacggaggtctagaatttattacgttcggcctaagtcctataattaactaacgaacgaccaaccgacgcctaacttaccgttacttagttccgttaccgttaaccgggtaacccgttacggggaaacccttaacgggtaccctaacccggtttcccgtaacggttcccgaaccggttaacccccaaccgggtacccccaaccccggtaccg

SEQ ID NO: 199203 - DNA, 792 bp, Homo sapiens
  misc_feature: GYAE6OF02H7VSP.18.59.F04.1.454.CMB.1.raw
  modified_base (202)..(202): a, c, t, g, unknown or other
  misc_feature (202)..(202): n is a, c, g, or t
  modified_base (232)..(233): a, c, t, g, unknown or other
  misc_feature (232)..(233): n is a, c, g, or t
  modified_base (261)..(261): a, c, t, g, unknown or other
  misc_feature (261)..(261): n is a, c, g, or t
  modified_base (325)..(325): a, c, t, g, unknown or other
  misc_feature (325)..(325): n is a, c, g, or t
  modified_base (566)..(566): a, c, t, g, unknown or other
  misc_feature (566)..(566): n is a, c, g, or t
  modified_base (613)..(613): a, c, t, g, unknown or other
  misc_feature (613)..(613): n is a, c, g, or t
tcagtacgagtatgcacgaccggtgctcgatttagtacacacacttagggagttggggggggtctcgaggaggcagcgctctcgggacgtctccaccatggcctgggctctgctatcctcaccctctcactcaggcacagggtcctgggcccagtcctagccctgacctcagcctgccctcgtgtcgtgggtctcctggacngtcgatcaccatctcctgcacgtacggacnncgagtgacgtttgggtatactaactgtntacctcgtagtaccagacgaccaccagaccaacgacccctaaacactagtactacttagtacgnttacgtccaagttaaccgtccgtaccgttcgggttaacggtttacctaacgttctccgtttcctcggttacggtccctacgtaacggtttccacgggaacctcccggtaacccgttccccacccggtttactaaccctagtttaccctcggggtcctaccggttacccggtacggtaccggtacgggtaaccggacggggtaaacggttccgtaggtttaaccgtttaacgtttaaaccgnggttaaacccgtcggtacctaccttaaacgttaagttaaaccccganaaacccgtaccgaactaccctttacggtaccttaccgtttaggtaccggtttaccgtaaccgggtaaccggtacccggtaaccgttaaccgggtaccccggtttaaccgtccgggttcccgttaaacgggaccccgggttaaccccctaaaccggaccccgttaccccgtttaacccgg

SEQ ID NO: 199204 - DNA, 606 bp, Homo sapiens
  misc_feature: GYAE6OF02I7Q0V.18.59.F04.1.454.CMB.1.raw
  modified_base (311)..(311): a, c, t, g, unknown or other
  misc_feature (311)..(311): n is a, c, g, or t
  modified_base (505)..(505): a, c, t, g, unknown or other
  misc_feature (505)..(505): n is a, c, g, or t
  modified_base (598)..(598): a, c, t, g, unknown or other
  misc_feature (598)..(598): n is a, c, g, or t
  modified_base (603)..(603): a, c, t, g, unknown or other
  misc_feature (603)..(603): n is a, c, g, or t
tcagtacgagtatgcacgaccggtgctcgatttagtacacacacttagggattgggggagagagacccctcccctgggatcctgggcccagtctgccctgactcagcctgcctccgtgtctgggtctcctggacagtcgatcaccatctcctgcactggaaccagcagtgacgttggtggttataactatgtctcctggtaccaacagcacccaggccaaaacgcccccaaaatcatgatttatgatgtcagtaactccggccctcgaggggtttactaatcgtcttctctggctccaagtctggccaacnccggccctccgtgacccatcctctcggggcctccaggcgtggacggacggagggtctagaattttaacttactgacagtctactaatactaacaaggctaagcagacctactacaacgttctacggtaacgtacgggaacctaacggtcctaccggtacgtagtaccgacgacccgtaaccgcccctaaacccnctactccgtaccttacttcccgttacccctccctccctaccgtacctaccgtcttaccgtagacggccggtcgtaggaccgaacggcacgtanacgcnacg

SEQ ID NO: 199205 - DNA, 622 bp, Homo sapiens
  misc_feature: GYAE6OF02GEGHI.18.59.F04.1.454.CMB.1.raw
  modified_base (228)..(228): a, c, t, g, unknown or other
  misc_feature (228)..(228): n is a, c, g, or t
  modified_base (252)..(252): a, c, t, g, unknown or other
  misc_feature (252)..(252): n is a, c, g, or t
  modified_base (303)..(303): a, c, t, g, unknown or other
  misc_feature (303)..(303): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataactntgtctcctggtaccaacagcacccaggcaaagcccccaaatcatgatttangatgtcactaatccggccctcgtaggggtttctaatcgcttctctggctccaagtctggcaacgacgcctcctgaccatctcgtcgggctccgaggctggaggacgaggtctaggtactttaattacgtgctagtcctacaattactaacgaacgacctaaccgacgacctaaccttcttacttacgtcgttacccgtttacgggaaccgttcggggaaaccctaaacgggttcccctaacccggtttacccgttaacggggtaccctaacgggaaccccccgtaaacgggtacccccctaaacccccgtttaaccccg

SEQ ID NO: 199206 - DNA, 732 bp, Homo sapiens
  misc_feature: GYAE6OF02JEONE.18.59.F04.1.454.CMB.1.raw
  modified_base (228)..(228): a, c, t, g, unknown or other
  misc_feature (228)..(228): n is a, c, g, or t
  modified_base (252)..(252): a, c, t, g, unknown or other
  misc_feature (252)..(252): n is a, c, g, or t
  modified_base (268)..(268): a, c, t, g, unknown or other
  misc_feature (268)..(268): n is a, c, g, or t
  modified_base (302)..(302): a, c, t, g, unknown or other
  misc_feature (302)..(302): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataactntgtctctgtaccaacngcaccagcaaacgaccccaaatcatagtatttanagatgtactaagttaacgtccggtacccttacggtacggggttttactaaacgttccgtactttccgtcgttcgggtcccttaccgtaaacggtttcccgttacgggaccaaaacccggtacccggtcccccttaccccgttacgaacccctaacgtttccgtcccggttacgggtacccttaccggacgggtccgtagggtaacgggaccggtacggtcctaggtaacttttaacgttaccgtagtaccgacgtccgtacttaattaaccgtaacgaacgccaacggtccaagtaccctacttaaccgtaacgttaccgttaccggtaaccggtacgggtaaaccgtaacggtaccttaacccggtaccggttaaccggtaccaaccggtaccccgaaaccggtaccccctaacccggactttacccgg

SEQ ID NO: 199207 - DNA, 518 bp, Homo sapiens
  misc_feature: GYAE6OF02GB2R5.18.59.F04.1.454.CMB.1.raw
  modified_base (432)..(432): a, c, t, g, unknown or other
  misc_feature (432)..(432): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctcaagtctggcaacacgcctccctgaccatctcgtggctccaggctggaggacgaggctgtattattactgcagctcatanacagccacagcactctctatgtcttacggacgtcgggaccaaggtccaccgtccgtacggcacgcccgaacgacccaacccctacg

SEQ ID NO: 199208 - DNA, 538 bp, Homo sapiens
  misc_feature: GYAE6OF02GPNBI.18.59.F04.1.454.CMB.1.raw
  modified_base (445)..(445): a, c, t, g, unknown or other
  misc_feature (445)..(445): n is a, c, g, or t
  modified_base (530)..(530): a, c, t, g, unknown or other
  misc_feature (530)..(530): n is a, c, g, or t
  modified_base (533)..(533): a, c, t, g, unknown or other
  misc_feature (533)..(533): n is a, c, g, or t
  modified_base (536)..(537): a, c, t, g, unknown or other
  misc_feature (536)..(537): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacaccggccctccctgacctatcctcgtgggcctccgaggctggaggacgaggctgattattactgcagctcatatacaagcagcagcactacaacgtctacggaactgggaccaagtccaccgtccgtaggtcacgacccgaacgcccaaccccntcgtcaccgttctccgtcccctacccgtcctaccactacctcgtactcgacgccggtacgtcggacgaacgggcctacgatagcngcngcnnc

SEQ ID NO: 199209 - DNA, 760 bp, Homo sapiens
  misc_feature: GYAE6OF02JWDNW.18.59.F04.1.454.CMB.1.raw
  modified_base (252)..(252): a, c, t, g, unknown or other
  misc_feature (252)..(252): n is a, c, g, or t
  modified_base (269)..(269): a, c, t, g, unknown or other
  misc_feature (269)..(269): n is a, c, g, or t
  modified_base (304)..(304): a, c, t, g, unknown or other
  misc_feature (304)..(304): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactntgtctcctggtaccaancgcaccaggacaacgcccccaaatcatgattttangatcgtactaactaactccgggacccctcgtaggggttttactaattccggtcctttcgttcgttcgggtaccttacccgtaaagttccgttcgggacctaaaccgtacccgggcccttacccgtacggaccctacttccgttcgtccgggtccttacccgagggtaccttagggaacgggtaccggtaacgggtccttaggttaactttaacgtttacggttacgaccgtaacgtccctaacggtaatttaaaccgtaacgaaaccggtcgaaacggttcccgaagaccgttaaacccgttacgtaaacggtttacccggtttaccgggggaaacccggtttacggggaaccccttaaacgggttcccgtaaaccccgttcccggttaaacgtacccggtaaacccggaccccgtaaacccgggtccccctaaaaccccccggtgtttaccccgg

SEQ ID NO: 199210 - DNA, 503 bp, Homo sapiens
  misc_feature: GYAE6OF02I0AWB.18.59.F04.1.454.CMB.1.raw
  modified_base (273)..(273): a, c, t, g, unknown or other
  misc_feature (273)..(273): n is a, c, g, or t
  modified_base (299)..(299): a, c, t, g, unknown or other
  misc_feature (299)..(299): n is a, c, g, or t
  modified_base (339)..(339): a, c, t, g, unknown or other
  misc_feature (339)..(339): n is a, c, g, or t
  modified_base (356)..(356): a, c, t, g, unknown or other
  misc_feature (356)..(356): n is a, c, g, or t
  modified_base (364)..(364): a, c, t, g, unknown or other
  misc_feature (364)..(364): n is a, c, g, or t
  modified_base (374)..(374): a, c, t, g, unknown or other
  misc_feature (374)..(374): n is a, c, g, or t
  modified_base (380)..(380): a, c, t, g, unknown or other
  misc_feature (380)..(380): n is a, c, g, or t
  modified_base (390)..(390): a, c, t, g, unknown or other
  misc_feature (390)..(390): n is a, c, g, or t
  modified_base (402)..(402): a, c, t, g, unknown or other
  misc_feature (402)..(402): n is a, c, g, or t
  modified_base (422)..(422): a, c, t, g, unknown or other
  misc_feature (422)..(422): n is a, c, g, or t
tcagtacgagtatgcacgaccggtgctcgatttagtacacacacttagggattgggggggtctcaggaggcagcgctctcgggacgtctccaccatggcctgggctctgctattcctcaccctctcactcagggcacagggtcctgggcccagtctgccctgactcagcctgcctcgtgtctgggtctcctggacagtcgatcaccatctcctgcactggaaccagcagtgacgttggtgttataactatgtctcctggtaccaacagcaccnggcaaagcccccaaatcatgatttangatgtcactaatccggccctgtagggtttcaatcgcttcnctgctcagtctgcaacncgcctccngaccatctcnggctcngtctgagcgngctgattatacngactagctcatacgttacanccaacagcctaactctctatcgtctacgaacgtcggtaaccaggtccacggtctacggctacgaccacgtcccaccgtacg

SEQ ID NO: 199211 - DNA, 646 bp, Homo sapiens
  misc_feature: GYAE6OF02JJUSL.18.59.F04.1.454.CMB.1.raw
  modified_base (229)..(229): a, c, t, g, unknown or other
  misc_feature (229)..(229): n is a, c, g, or t
  modified_base (253)..(253): a, c, t, g, unknown or other
  misc_feature (253)..(253): n is a, c, g, or t
  modified_base (305)..(305): a, c, t, g, unknown or other
  misc_feature (305)..(305): n is a, c, g, or t
tcagtacgagtatgcacgaccggtgctcgatttagtacacacacttagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataactntgtctccgtgtaccaacagcaccaggcaaacgcccccaaatcatgactttangatgtacaactaacgtccgccctgtacggggtttactaactcgtcttactcgtcggcctaccacgttctgggactaaaccgacggtcccttcccgtagtaaccctacgttccgtccgtcggggtcctaccgtacgggcttagggacgcgtaaggtctaggactttagttccgcggaccacgtcctacgtaattagtaaaccacggacctaaccgtaacgcgtaaccttctaccgttacgtcgttacccgttaacgggaccgttaggggaacccttaagggtaccctaccggttaccgtagggttacccacgtaccccggaaaccggcccctaaccccgtag

SEQ ID NO: 199212 - DNA, 656 bp, Homo sapiens
  misc_feature: GYAE6OF02IUTAT.18.59.F04.1.454.CMB.1.raw
  modified_base (329)..(329): a, c, t, g, unknown or other
  misc_feature (329)..(329): n is a, c, g, or t
  modified_base (483)..(483): a, c, t, g, unknown or other
  misc_feature (483)..(483): n is a, c, g, or t
  modified_base (532)..(532): a, c, t, g, unknown or other
  misc_feature (532)..(532): n is a, c, g, or t
tcagtacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggtattttccttgctgcttattttaaaggtgtccagtgtgaggtgcagctggtggagtcgtgggggaggtcgttagggtaaacggccgggggggttacccttaggaccttcccccgtgtaccgacgcctctggacttctactttcagtaaggcctggatgaacgtcgggtccncgaggcgtaccggaggggacggggcgtgggagggttggggttcgggaccgttaacgttaaaaaacccgaaacgttggaagttggggaacgggaacaaacgagacgtaccgctacgccgaccggtagaaacggcagtactcactatacacaaganatagaacttaacaaaagcaacggactgtacttctagacaaatcgaaacncacgtagaacgaaccggagaacaccgagtaccgtagtacgttacaccgtacctaacacctaaccccgagaaacgccgttaactaacctacgttaacctacgtaggtacgtacggtccctacggg

SEQ ID NO: 199213 - DNA, 695 bp, Homo sapiens
  misc_feature: GYAE6OF02H3IM1.18.59.F04.1.454.CMB.1.raw
  modified_base (201)..(201): a, c, t, g, unknown or other
  misc_feature (201)..(201): n is a, c, g, or t
  modified_base (212)..(212): a, c, t, g, unknown or other
  misc_feature (212)..(212): n is a, c, g, or t
  modified_base (217)..(217): a, c, t, g, unknown or other
  misc_feature (217)..(217): n is a, c, g, or t
  modified_base (220)..(220): a, c, t, g, unknown or other
  misc_feature (220)..(220): n is a, c, g, or t
  modified_base (227)..(227): a, c, t, g, unknown or other
  misc_feature (227)..(227): n is a, c, g, or t
  modified_base (252)..(252): a, c, t, g, unknown or other
  misc_feature (252)..(252): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcgagggcacagggtcctgggcccagtctgccctgactcagcctgcctccgtgtctgggtcctcctggacngtcgatcaccntctcngcnctgaccngcagtgtagttggtagttataactntgtctctaggtaccacacgccaaccgaggacaaccgacccccaaacgtcattgtaatttagtgattacgtactaacttaacgtccgtacccgttacggttacgggttttactaacgttcgtctttctcgttcggtaccttaccgtagttcgtacgaccgaaccgtacccggtacccttacccgtacgtaacctctttcccgttacggtccgggtccctaccgggtacggtcggtacgggaacgggtacgtacgggtacttaaggttaactttaacttcgacgtacgacgtactactaagttaccaagacccgactaacacgtacctacgttactacttacgttccgtacgttaccgggtacgtaaccgggtaacctacgggtaccctacccggttacgtacggtacccgaacccggacccgtaacccggtccccaaccgtacg

SEQ ID NO: 199214 - DNA, 550 bp, Homo sapiens
  misc_feature: GYAE6OF02F89KW.18.59.F04.1.454.CMB.1.raw
  modified_base (307)..(307): a, c, t, g, unknown or other
  misc_feature (307)..(307): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggacaaacgcccccaaactcatgatttangatgtcactaatccggccctcgtaggggtttctaatcgtcttctcgtcggctccaagtctcggacaaccaccggccctccctcgacctatcctacgtcgggctccgaggctggacggacgagctgtattactacgtgcagctcaatactaacaagccaacagccactctctactcgtcttacggaacgtcggaaccaacggtccaccgtctacggcacgacccgtaacgccccaaccctaccg

SEQ ID NO: 199215 - DNA, 602 bp, Homo sapiens
  misc_feature: GYAE6OF02FN9KP.18.59.F04.1.454.CMB.1.raw
  modified_base (415)..(415): a, c, t, g, unknown or other
  misc_feature (415)..(415): n is a, c, g, or t
tcagtacgagtatgcacgaccggtgctcgatttagtacacacacttagggattggggtctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcttgggtaaaggccgggggggtccttagacctcccctgtacagcctctggattcactttcagtaaggcctggatgaactgggtccgccgaggctccgaggggaagggctgggaggtgggttggaccgttaattaaaaccaaaacgtgaagtgggtagggacaacgagactacgctgccaccgtgaaacggcagntcaccatcacaagagatgaattaacaaaagcaacgtctagtatctagacaaatacgaacacgacctaggaacgaaaccggaggaaccacgacgccgttagtattactacgtaacaccgactaccctagaaacgcgtaccaacctactacctaacgtacggtaatcggaccgttacgcgggtaacccg

SEQ ID NO: 199216 - DNA, 495 bp, Homo sapiens
  misc_feature: GYAE6OF02HM25Q.18.59.F04.1.454.CMB.1.raw
  modified_base (288)..(288): a, c, t, g, unknown or other
  misc_feature (288)..(288): n is a, c, g, or t
  modified_base (308)..(308): a, c, t, g, unknown or other
  misc_feature (308)..(308): n is a, c, g, or t
  modified_base (464)..(464): a, c, t, g, unknown or other
  misc_feature (464)..(464): n is a, c, g, or t
  modified_base (471)..(472): a, c, t, g, unknown or other
  misc_feature (471)..(472): n is a, c, g, or t
  modified_base (476)..(479): a, c, t, g, unknown or other
  misc_feature (476)..(479): n is a, c, g, or t
  modified_base (481)..(495): a, c, t, g, unknown or other
  misc_feature (481)..(495): n is a, c, g, or t
tcagtacgagtatgcacgaccggtgctcgatttagtacacacacttagggattgggggctttgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacgacggcctccctgaccatctctggctccgaggctgaggacgnggctgattatactgcagctnatataacagcacagccactctctatgtcttcggaactgggaaccaaggtccaccgtctacggcgacgacccaacggccccaacccactcgtcactcctcgtaccccaccctcctccactaccttcgtactgccgcggcctcgggacgaacgggccncgatcgnngctnnnncnnnnnnnnnnnnnnn

SEQ ID NO: 199217 - DNA, 592 bp, Homo sapiens
  misc_feature: GYAE6OF02GUUE4.18.59.F04.1.454.CMB.1.raw
  modified_base (229)..(229): a, c, t, g, unknown or other
  misc_feature (229)..(229): n is a, c, g, or t
  modified_base (254)..(254): a, c, t, g, unknown or other
  misc_feature (254)..(254): n is a, c, g, or t
  modified_base (314)..(314): a, c, t, g, unknown or other
  misc_feature (314)..(314): n is a, c, g, or t
  modified_base (488)..(488): a, c, t, g, unknown or other
  misc_feature (488)..(488): n is a, c, g, or t
  modified_base (497)..(497): a, c, t, g, unknown or other
  misc_feature (497)..(497): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatctcctgcactggaaccngcagtgacgttggtagttataactntgtctcctggtaccaacacgccacccaggaccaaacgcccccaaactcactgtatttagngtatgtacacttaacgtccggtaccctcgtaggggtttacctaacgttcgtcctttctcgtcggtccttaccgtaagtcgtaggaccaaccgtaccggtccctcccgtacgacctacttccgtcgtcgggtcctaccgaggtctacggacggacgaggtctagtatttacgtcngcacgtctnaatacacacgccacagcctactctactgtcgttcgtcgaacgtcggaacgtacgtccgtacgtcgtacgctaccgacccgtacgacccacctacg

SEQ ID NO: 199218 - DNA, 597 bp, Homo sapiens
  misc_feature: GYAE6OF02FRQDT.18.59.F04.1.454.CMB.1.raw
  modified_base (305)..(305): a, c, t, g, unknown or other
  misc_feature (305)..(305): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcctggtaccaacagcacccaggcaaacgcccccaaactcatgatttangatgtacactaactcggccctcgaggggtttctaatcgtcttctctggctccaagtctggacaacgaccggccctccctagaccctatcctcgtcgggcctccaggctggacggacgaggtctgtattacgttactgcctagtctacaattactaacaacgccaaccgacgtaccaccttcttacgttagtcgttccgttacggaacgttcggggaaccctaagggtccctacccggttccgtaacgggttccaacggtacccccgaacgggtaccccctaacccccgtacg

SEQ ID NO: 199219 - DNA, 717 bp, Homo sapiens
  misc_feature: GYAE6OF02H12S5.18.59.F04.1.454.CMB.1.raw
  modified_base (196)..(196): a, c, t, g, unknown or other
  misc_feature (196)..(196): n is a, c, g, or t
  modified_base (230)..(230): a, c, t, g, unknown or other
  misc_feature (230)..(230): n is a, c, g, or t
  modified_base (257)..(257): a, c, t, g, unknown or other
  misc_feature (257)..(257): n is a, c, g, or t
  modified_base (273)..(273): a, c, t, g, unknown or other
  misc_feature (273)..(273): n is a, c, g, or t
  modified_base (308)..(308): a, c, t, g, unknown or other
  misc_feature (308)..(308): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacgagggtcctgggcccagtctgccctgactcagcctgcctcgtgtcgtgggtctccgnggacagtcgatcacatctctgcactacggaaccngcagtgacggtttggtagttataactntcgtctctggtaccancgcaccgaggacaacgaccccaatcatgtatttanacgattcgtactactaacgtccgtaccgtacggttacgggtttactacgtcgtccttcgtcgtcggtacctacgtaacgtcgtacggtaacaaccgtacccgcccttaccctacggaaccttcgtccgtcggtaccgggtcctaccggtacggacccgttagggaaccgggtaacccgggtggttaccttaagggttaacctttaaacgggtttccgtacgggtacctaacggtaccttacttaaacgtaacttaaaccgaccgaacctaaccgacgtacttaaccttcttaacttacgttaccggttaccggttacggttaaccggcggttaacccggtacgtaccgttacccggttacggtaccggtaccaaccggacccggtaaaccgaccccgtaacccttacgg

SEQ ID NO: 199220 - DNA, 574 bp, Homo sapiens
  misc_feature: GYAE6OF02H7EBP.18.59.F04.1.454.CMB.1.raw
  modified_base (250)..(250): a, c, t, g, unknown or other
  misc_feature (250)..(250): n is a, c, g, or t
  modified_base (449)..(449): a, c, t, g, unknown or other
  misc_feature (449)..(449): n is a, c, g, or t
  modified_base (462)..(462): a, c, t, g, unknown or other
  misc_feature (462)..(462): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaagtgacgttggtgttaanaactatgtctcctaggtaaccaacagacacccgaggacaaacgaccccaaaactcaacttgaacttttatgattgtacactaagtccgccctagtagggtttactaagtcgtcttctcgtcgctacaagtctggacaacgcgcctccagacactctcgtcggcctccgagcgtggagacgagctagtaatttattacgngacgtactctaanaattacaacgacgacaccagacctacttcattactcgttacgttacggaagtcggaacctaacggtctaccgtacgttacggcaaccgacccgaacggtaccccaaccctcg

SEQ ID NO: 199221 - DNA, 623 bp, Homo sapiens
  misc_feature: GYAE6OF02G5Q6R.18.59.F04.1.454.CMB.1.raw
  modified_base (241)..(241): a, c, t, g, unknown or other
  misc_feature (241)..(241): n is a, c, g, or t
  modified_base (317)..(317): a, c, t, g, unknown or other
  misc_feature (317)..(317): n is a, c, g, or t
  modified_base (328)..(328): a, c, t, g, unknown or other
  misc_feature (328)..(328): n is a, c, g, or t
  modified_base (335)..(335): a, c, t, g, unknown or other
  misc_feature (335)..(335): n is a, c, g, or t
  modified_base (365)..(365): a, c, t, g, unknown or other
  misc_feature (365)..(365): n is a, c, g, or t
  modified_base (369)..(369): a, c, t, g, unknown or other
  misc_feature (369)..(369): n is a, c, g, or t
  modified_base (543)..(543): a, c, t, g, unknown or other
  misc_feature (543)..(543): n is a, c, g, or t
  modified_base (609)..(609): a, c, t, g, unknown or other
  misc_feature (609)..(609): n is a, c, g, or t
  modified_base (616)..(616): a, c, t, g, unknown or other
  misc_feature (616)..(616): n is a, c, g, or t
tcagtacgagtatgcacgaccggtgctcgatttagtacacacacttagggattggggagagagacccctcccctgggatcctgggcccagtctgccctgactcagcctgcctccgtgtctgggtctcctggacagtcgatcaccatctcctgcactaggaccagcagtgacgttggtggttataactatgtctccgtgtaccaacacgcacccaggcaaacgccccaaatcatagtattangatgcagtatccggccctgtagggttctaatcgtacttctcgtgtcctaccgatcgtgacctaacgccggcctccngaccatctcgnggcctcnggctcgaggcgagtctagtatttactacgngacngaccttagaacttacgtaacacggccgtaagccgtacgtaccaccgttacgaaccggtttacgtacggtaaccgtacggaaccgtacggtaccgaccgttaccgtacggtacaccgacccgaaccgccccaaccgtcctcgtccaccgttctacccttacccctaccgtacccnccgtaaccttccgtaccgaacgtcggacggaccggtacggtcggacccgtaggtaccgacgttaancggtacncgaatcg

SEQ ID NO: 199222 - DNA, 566 bp, Homo sapiens
  misc_feature: GYAE6OF02GAAZT.18.59.F04.1.454.CMB.1.raw
  modified_base (234)..(234): a, c, t, g, unknown or other
  misc_feature (234)..(234): n is a, c, g, or t
  modified_base (556)..(556): a, c, t, g, unknown or other
  misc_feature (556)..(556): n is a, c, g, or t
  modified_base (560)..(560): a, c, t, g, unknown or other
  misc_feature (560)..(560): n is a, c, g, or t
  modified_base (562)..(562): a, c, t, g, unknown or other
  misc_feature (562)..(562): n is a, c, g, or t
  modified_base (565)..(565): a, c, t, g, unknown or other
  misc_feature (565)..(565): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagccacccaggcaaaagcccccaaaactcatgatttangatgtcagtaatcggccctcgtaggggtttctaatcgcttctctggctcgaagtctggcaacacggccctccctgaccatctctgggctccaggctgaggacgaggctgatttatactgcagctcaataatacaagcagcacgcactacaagtctacggaactagggaaccaagtaccgaccgtcgtacggtacaacgcccaaacggcccaaacccctctcgtaccaccgtccttaccgttacccctacccttccctacctactacccgttacgtaccttacgacggtcggacgtcgggacgaacgggccgactaggtacgngacntnagnc

SEQ ID NO: 199223 - DNA, 700 bp, Homo sapiens
  misc_feature: GYAE6OF02JKAX2.18.59.F04.1.454.CMB.1.raw
  modified_base (248)..(248): a, c, t, g, unknown or other
  misc_feature (248)..(248): n is a, c, g, or t
  modified_base (253)..(253): a, c, t, g, unknown or other
  misc_feature (253)..(253): n is a, c, g, or t
tcagtacgagtatgcacgaccggtgctcgatttagtacacacacttagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttanaactntgtctcctggtaccaacagcacccgaggcaaacgcccccaaactcatgatttatgatgactagtaatccgcccgttagacggggttttactaagttcgtctttactcgtacggtcctaccgtaagtccgtacggtacctaaaccgtcccgggtacccctttaccccgacggtaaccctaactttcccgtccgttaccggggtccccttaccggtaaccgggtccgtttacgggaaacggggtaccggtaacgggtcccttaaggtaacttttaacgtttaccgttacggacgtaccgttaccgtactttaacttaaccgtaacgtaacggaccgtacgaccgtacgacctacgtactaacgttaccgttacgaacgtcgggtaaccaacggttccgaccgttaccgtggtaccaccggcccctaaggccccaacccgtacgttaccg

SEQ ID NO: 199224 - DNA, 597 bp, Homo sapiens
  misc_feature: GYAE6OF02FMUE6.18.59.F04.1.454.CMB.1.raw
  modified_base (454)..(454): a, c, t, g, unknown or other
  misc_feature (454)..(454): n is a, c, g, or t
  modified_base (483)..(483): a, c, t, g, unknown or other
  misc_feature (483)..(483): n is a, c, g, or t
tcagtacgagtatgcacgaccggtgctcgatttagtacacacacttagggattgggggggggtctcaggaggcagcgctctcgggacgtctccaccatggcctgggctctgctattcctcaccctcctcactcagtgcacagggtcctgggcccagtctgccctgactcagcctgcctcgtgtctgggtctctggacagtcgatcaccatctcctgcactcggaaccagcagtgacggttggtgttataactatgtctcctggtaccaacagccaccaggaccaaacgaccccaaactcatgtatttatgatcgtacagtaactccggcctcgtagggtttactaagtcgtcttctcgtcgctactagtctgacaacgaccgcctcctacgaccatccgtcgtcggcctacgtaggcttacggacggtacgacggtactagttattacgttacngactagtcctatactaacgaacagtaacngacagacctactaacgtacgttacgttaccggaacgttcgggaacctaccgggttaccgtaccgttaccggtacggtacccgaccggaccgaacccggtacccctaccgtaccg

SEQ ID NO: 199225 - DNA, 619 bp, Homo sapiens
  misc_feature: GYAE6OF02G3UXT.18.59.F04.1.454.CMB.1.raw
  modified_base (319)..(319): a, c, t, g, unknown or other
  misc_feature (319)..(319): n is a, c, g, or t
  modified_base (416)..(416): a, c, t, g, unknown or other
  misc_feature (416)..(416): n is a, c, g, or t
  modified_base (446)..(446): a, c, t, g, unknown or other
  misc_feature (446)..(446): n is a, c, g, or t
tcagtacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtcctgggtctcctggacagtcgatcaccatctcctgcactggaaccagcagtgacgttggtggttactaactatgtctcctggtaccaacgagccacccaggaccaaacgaccccaaactccatcgtactttangtactgtctaactaacgtccggaccctcggtacgggtttctaacgtcgtcttcgtctcggtctacgagtcgtcgacaacgaccggcctcctgacctntcctcggtcggctccgagcgtagaggacgnggtctagttacttatacgtgactagtcctcgtaatactaaccgaacgtcctaaacccgagtcctaacctcttacgttacttcggttaccgttaacggaaccgtaccgggtaacctacggttccctaacccggtcgttaaccggcctaacccggacccgtaacggtaacccccg

SEQ ID NO: 199226 - DNA, 544 bp, Homo sapiens
  misc_feature: GYAE6OF02G1C5X.18.59.F04.1.454.CMB.1.raw
  modified_base (228)..(228): a, c, t, g, unknown or other
  misc_feature (228)..(228): n is a, c, g, or t
  modified_base (427)..(427): a, c, t, g, unknown or other
  misc_feature (427)..(427): n is a, c, g, or t
  modified_base (431)..(431): a, c, t, g, unknown or other
  misc_feature (431)..(431): n is a, c, g, or t
tcagtacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcagtgacgttggtgttataactatgtctcctggtaccaacagcacccaggcaaacgcccccaaactccatgatttatgatgtcactaatcggccctcgtaggggtttctaatcgcttctcgtgctcatctgacacacgcctcctgaccatctcgtcggctccgagctgaggacgagctgtatttactactgcagctanatanacagccacacgctactctacttatcgttaccttacggaaccgtcgggaaccctaacggtccacccgttaccgtacggtaccacggtacccgaacggacccctaacccgtaccg

SEQ ID NO: 199227 - DNA, 509 bp, Homo sapiens
  misc_feature: GYAE6OF02IN9EC.18.59.F04.1.454.CMB.1.raw
  modified_base (231)..(231): a, c, t, g, unknown or other
  misc_feature (231)..(231): n is a, c, g, or t
  modified_base (503)..(509): a, c, t, g, unknown or other
  misc_feature (503)..(509): n is a, c, g, or t
tcagtacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagccccccaaatcatgatttangatgtcagtaatcggccctcaggggtttctaatcgcttctctggctccaagtctggcaacacggcctccctgaccatctctgggctccaggctgaggacgaggctgattattactgcagctcatataacaagcagcagcactcagtctcggaactgggaccaaggtcaccgtcctaggtcagcccaacggccaaccccactcgtcactctcgttcccgccctcctcctactactccgtactcgagccgggcgtggacgaaggcgcaatacgnnnnnnn

SEQ ID NO: 199228 - DNA, 577 bp, Homo sapiens
  misc_feature: GYAE6OF02GF32M.18.59.F04.1.454.CMB.1.raw
  modified_base (228)..(228): a, c, t, g, unknown or other
  misc_feature (228)..(228): n is a, c, g, or t
  modified_base (254)..(254): a, c, t, g, unknown or other
  misc_feature (254)..(254): n is a, c, g, or t
  modified_base (436)..(436): a, c, t, g, unknown or other
  misc_feature (436)..(436): n is a, c, g, or t
  modified_base (467)..(467): a, c, t, g, unknown or other
  misc_feature (467)..(467): n is a, c, g, or t
  modified_base (481)..(481): a, c, t, g, unknown or other
  misc_feature (481)..(481): n is a, c, g, or t
  modified_base (490)..(490): a, c, t, g, unknown or other
  misc_feature (490)..(490): n is a, c, g, or t
tcagtacgagtatgcacgaccggtgctcgatttagtacacacacttagggattggggggggtctcaggaggcagcgctctcgggacgtctccaccatggcctgggctctgctattcctcaccctctcactcagggcacagggtcctgggcccagtctgccctgactcagcctgcctccgtgtctgggtctcctggacagtcgatcaccatcctcctgcactggaaccngcagtgacgttggtgttataactatntctcctggtaccaacagccaccaggacaaacgccccccaaactcaatcgtatttatgatgtacactaatccggaccctcgtaggggtttactaatcgactttcctcgtcggtctaccaagtctaggccaaccgacggtccctcctcgacctactctcgtcggcctccgagctggacggacgnggctgactttagtactgcacgtctacattanaaccgagccaacanacacttctntattcgtcgttacggaacgtcgggaacctaggtacccgtaccgttcgtacggtccaacgaccccggtaacgacccccaacgtacccg

SEQ ID NO: 199229 - DNA, 604 bp, Homo sapiens
  misc_feature: GYAE6OF02F56WK.18.59.F04.1.454.CMB.1.raw
tcagtacgagtatgcacgaccggtgctcgatttagtacacacacttagggattggggagctctgggagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcgttagggtaaacgggccgggggggtcccttaggacctcccccgtgtacagcctctggattcactttcagtaaggcctggatgaacgtgggtccgcaggctccgagggagggctggagtgggtgcgtataaaaccaaatgagtggtggacaacgagactacgctgcaccgtgaaacggcagattcactatctacaagagatagaacttaacgaaaaacgcaacgtctagtactacgtagacaaatagaaccacgaccgtagaacggaaccggacgaacacgacgtccgtagttacttacgacgtaccactaccgtacccgtaagaaccgtcctacctaaactacctaaccttaaccgtacggtactaccggacctacggg
